United States Patent 11,725,251 (METHYLATION MARKERS AND TARGETED METHYLATION PROBE PANEL) - sequence listing, part 5

SEQ ID NO: 43725 - DNA, 84 bp, Homo sapiens
  misc_feature 1..84: note = chr12:132682582-132682666
  misc_feature 1..84: note = hypo
  source 1..84: mol_type = genomic DNA
gccttgagctgcaaacggggccctgcgcggctgccttggagcctcccaccccggggacgctgttgcgggcgggagaggaccgcc

SEQ ID NO: 43726 - DNA, 288 bp, Homo sapiens
  misc_feature 1..288: note = chr12:132687989-132688277
  misc_feature 1..288: note = hypo
  source 1..288: mol_type = genomic DNA
ccgtggcattgaccccgaccctggggcatggccccggctcccggcctgtgggggactcaccgacatggggatgttccaggccatgtacacgtgggacttgaagtcatccatccacacctcggcggcgcgcagggcgttgcgcttggcatagtagtcaatgtcgttgttgtagggcttcctggtgcgctcgatgtgggccacgcgggagcagggcagcacctccatgctgccgccacactgccacacctgcggggagacggcgctgggtgccggcgtccttcccaacgg

SEQ ID NO: 43727 - DNA, 23 bp, Homo sapiens
  misc_feature 1..23: note = chr12:132691177-132691200
  misc_feature 1..23: note = hypo
  source 1..23: mol_type = genomic DNA
cgagactccgtctcaaaaaaaaa

SEQ ID NO: 43728 - DNA, 41 bp, Homo sapiens
  misc_feature 1..41: note = chr12:132694981-132695022
  misc_feature 1..41: note = hypo
  source 1..41: mol_type = genomic DNA
tagaggggaggcaggcgaggctcagacgtcacactcatcac

SEQ ID NO: 43729 - DNA, 115 bp, Homo sapiens
  misc_feature 1..115: note = chr12:132983629-132983744
  misc_feature 1..115: note = hypo
  source 1..115: mol_type = genomic DNA
ccagaagagaagccacgtccactgcgagggccatccggtgtcatgtccctgcctccactcagccccaggcccacagctgcagccacgcagccccgcacagcgtcaccgtctccag

SEQ ID NO: 43730 - DNA, 48 bp, Homo sapiens
  misc_feature 1..48: note = chr12:132985665-132985713
  misc_feature 1..48: note = hypo
  source 1..48: mol_type = genomic DNA
ccccacatggagccccgtccagtcagccggccccgttctctgctgagc

SEQ ID NO: 43731 - DNA, 205 bp, Homo sapiens
  misc_feature 1..205: note = chr12:132986451-132986656
  misc_feature 1..205: note = hypo
  source 1..205: mol_type = genomic DNA
acccagagctgccaccgtcctgtgggtgacggcagaacatctggctgccgggtggcctccgtaaccgccacacacctgcctctgctggaatcacctgaggctctggtgcctcacacggattggccaaaacagggagcggagccgggaaggccacggacatctgtgtggtgtcacgaacaaggtccggccacgtgtgtgggagacg

SEQ ID NO: 43732 - DNA, 45 bp, Homo sapiens
  misc_feature 1..45: note = chr12:132987467-132987512
  misc_feature 1..45: note = hypo
  source 1..45: mol_type = genomic DNA
ggcagggatgggaaccgaactcttgtccaccgaggagcctgggag

SEQ ID NO: 43733 - DNA, 278 bp, Homo sapiens
  misc_feature 1..278: note = chr12:133002792-133003070
  misc_feature 1..278: note = hypo
  source 1..278: mol_type = genomic DNA
gagtctacagtcagccggctcttccagctttctgggagtgtcatattttgaaatctccttgttcactttcacgcctgctggcaggatggacaattcctgtctgggtctggctcctcaaaagatctcactggcatgtctgccgacgtgcgattttccagcctttccctagagctgcggtttcgtcaggttcatggtccaacttccaagttgccgagtccagtctgaccgagtgttccacaccgagtgtgctccggcctctgccccgccttctctctgtc

SEQ ID NO: 43734 - DNA, 60 bp, Homo sapiens
  misc_feature 1..60: note = chr12:133003308-133003368
  misc_feature 1..60: note = hypo
  source 1..60: mol_type = genomic DNA
tgacacacctttctgcgaggactcagttggccagaggagatgtggcgaaacgcgctgggc

SEQ ID NO: 43735 - DNA, 17 bp, Homo sapiens
  misc_feature 1..17: note = chr12:133019687-133019704
  misc_feature 1..17: note = hypo
  source 1..17: mol_type = genomic DNA
cccgaaaaaaaaaaaac

SEQ ID NO: 43736 - DNA, 190 bp, Homo sapiens
  misc_feature 1..190: note = chr12:133035657-133035847
  misc_feature 1..190: note = hypo
  source 1..190: mol_type = genomic DNA
ccaccacgcccagcccgatttctccagttttgtgtggtctagttctattccgcactgctcagcacacaaaggcttttgtgtctgctgaacctttggaaggcacaggacatttttgtccctttataaactcaaagcatgatcctatctatgtttaaaaagcagacgcggacagcggcggacatgaggaaag

SEQ ID NO: 43737 - DNA, 58 bp, Homo sapiens
  misc_feature 1..58: note = chr12:133060930-133060988
  misc_feature 1..58: note = hypo
  source 1..58: mol_type = genomic DNA
agccctgcctgaagccggggcctgtcaggaaccccacggggtacggggtgctgcctga

SEQ ID NO: 43738 - DNA, 46 bp, Homo sapiens
  misc_feature 1..46: note = chr12:133100409-133100455
  misc_feature 1..46: note = hypo
  source 1..46: mol_type = genomic DNA
ccccgcgttgagaaccgctaggagtgggacacgtggcttcctgcag

SEQ ID NO: 43739 - DNA, 30 bp, Homo sapiens; identical to SEQ ID NO: 15744
  misc_feature 1..30: note = chr12:133100990-133101020
  misc_feature 1..30: note = hypo
  source 1..30: mol_type = genomic DNA

SEQ ID NO: 43740 - DNA, 30 bp, Homo sapiens; identical to SEQ ID NO: 15745
  misc_feature 1..30: note = chr12:133122176-133122206
  misc_feature 1..30: note = hypo
  source 1..30: mol_type = genomic DNA

SEQ ID NO: 43741 - DNA, 30 bp, Homo sapiens
  misc_feature 1..30: note = chr12:133167902-133167932
  misc_feature 1..30: note = hypo
  source 1..30: mol_type = genomic DNA
gggcctcagcattcacgctgcttcctcctg

SEQ ID NO: 43742 - DNA, 256 bp, Homo sapiens
  misc_feature 1..256: note = chr12:133169847-133170103
  misc_feature 1..256: note = hypo
  source 1..256: mol_type = genomic DNA
gggcctgcatagaaacggaagctcacagtcggggctgtgtgtctggcttctgtcccccatcgccattctccaggctcaccccctgcagccgtgcgggcctcattcttttcctggtggaatcctgttccctggtgtggagggccacgctgggcttatctgtcgatcgtttgtggacacctgagcagctatgaagagtctgctttgaacatctgtggacaacaatttgtgtgacgtctgtttccgattctcttgggtt

SEQ ID NO: 43743 - DNA, 102 bp, Homo sapiens; identical to SEQ ID NO: 15747
  misc_feature 1..102: note = chr12:133188357-133188459
  misc_feature 1..102: note = hypo
  source 1..102: mol_type = genomic DNA

SEQ ID NO: 43744 - DNA, 30 bp, Homo sapiens
  misc_feature 1..30: note = chr12:133199671-133199701
  misc_feature 1..30: note = hypo
  source 1..30: mol_type = genomic DNA
gaagggcgggtaagacgaccctggtctgac

SEQ ID NO: 43745 - DNA, 43 bp, Homo sapiens
  misc_feature 1..43: note = chr12:133200007-133200050
  misc_feature 1..43: note = hypo
  source 1..43: mol_type = genomic DNA
gctgactggcgcccacggctgcaccgggcgacccctggtcctg

SEQ ID NO: 43746 - DNA, 43 bp, Homo sapiens
  misc_feature 1..43: note = chr12:133262739-133262782
  misc_feature 1..43: note = hypo
  source 1..43: mol_type = genomic DNA
ggtgtgagccaccgcgccgggcctcatccgttttctgcttatg

SEQ ID NO: 43747 - DNA, 79 bp, Homo sapiens
  misc_feature 1..79: note = chr12:133705743-133705822
  misc_feature 1..79: note = hypo
  source 1..79: mol_type = genomic DNA
atctaaaacagaatacgaactaaaaaacctaatcaatgagactttttaaaaaattgagtcagggccgggtgcggtggct

SEQ ID NO: 43748 - DNA, 162 bp, Homo sapiens
  misc_feature 1..162: note = chr13:19517741-19517903
  misc_feature 1..162: note = hypo
  source 1..162: mol_type = genomic DNA
gacacagggtgaagccggggactccacgaccccctgggccccacgcaggggctgcagggaaggcactggcctctgagggatgatcccagcctcctcggcctcaccgctttttcccccggctacctcaacctccccctgcaagcctggcgtcctgtacccgtg

SEQ ID NO: 43749 - DNA, 101 bp, Homo sapiens
  misc_feature 1..101: note = chr13:20078200-20078301
  misc_feature 1..101: note = hypo
  source 1..101: mol_type = genomic DNA
ctcacagttcactgatagctccactccagggtactgatttgaatttagacttggcagcgctacagaatttaaatatatatatgtatcgtccaacaccaata

SEQ ID NO: 43750 - DNA, 87 bp, Homo sapiens
  misc_feature 1..87: note = chr13:20392358-20392445
  misc_feature 1..87: note = hypo
  source 1..87: mol_type = genomic DNA
agatgacattcatgacgccagctcttctggaagtcatagtaaggcaccgaggggtggctcctctccctgcagcggctgtcgcttacc

SEQ ID NO: 43751 - DNA, 27 bp, Homo sapiens
  misc_feature 1..27: note = chr13:20692250-20692277
  misc_feature 1..27: note = hypo
  source 1..27: mol_type = genomic DNA
cgtgagccactgcgcctggccacattt

SEQ ID NO: 43752 - DNA, 165 bp, Homo sapiens
  misc_feature 1..165: note = chr13:21057336-21057501
  misc_feature 1..165: note = hypo
  source 1..165: mol_type = genomic DNA
acaataaaagataaacgtgtgaggttctggatatcctaatacaccgggattttaccatgacacactgaacacacaaatcaatcacacatgaatcccaaatatgtacaattaagatacagcaagtaattttttatttattattatttttttaagacggagtctcac

SEQ ID NO: 43753 - DNA, 30 bp, Homo sapiens
  misc_feature 1..30: note = chr13:21711382-21711412
  misc_feature 1..30: note = hypo
  source 1..30: mol_type = genomic DNA
gactattcttgaggtcgggtatcttcatat

SEQ ID NO: 43754 - DNA, 23 bp, Homo sapiens
  misc_feature 1..23: note = chr13:22049000-22049023
  misc_feature 1..23: note = hypo
  source 1..23: mol_type = genomic DNA
tttttttttttgagacggagtct

SEQ ID NO: 43755 - DNA, 30 bp, Homo sapiens
  misc_feature 1..30: note = chr13:22336937-22336967
  misc_feature 1..30: note = hypo
  source 1..30: mol_type = genomic DNA
cagtcgctgccgaaacgatcacccagtcgc

SEQ ID NO: 43756 - DNA, 30 bp, Homo sapiens
  misc_feature 1..30: note = chr13:22391874-22391904
  misc_feature 1..30: note = hypo
  source 1..30: mol_type = genomic DNA
ttttctcttgtctcacgtccttcctttttt

SEQ ID NO: 43757 - DNA, 30 bp, Homo sapiens
  misc_feature 1..30: note = chr13:23717527-23717557
  misc_feature 1..30: note = hypo
  source 1..30: mol_type = genomic DNA
gtgagccactgcacccggccccaatgtctg

SEQ ID NO: 43758 - DNA, 92 bp, Homo sapiens
  misc_feature 1..92: note = chr13:23896875-23896967
  misc_feature 1..92: note = hypo
  source 1..92: mol_type = genomic DNA
cggcgatgcacagaccgccccccacccatccacctccccccccccccccccccgccaacaggtgtaacgtggtgccgcgggcagaggattca

SEQ ID NO: 43759 - DNA, 62 bp, Homo sapiens
  misc_feature 1..62: note = chr13:24289608-24289670
  misc_feature 1..62: note = hypo
  source 1..62: mol_type = genomic DNA
gtttggggtgctatccgggtttgcattgcaggcggtggggccagctgcggtatggcggtggc

SEQ ID NO: 43760 - DNA, 30 bp, Homo sapiens
  misc_feature 1..30: note = chr13:25561078-25561108
  misc_feature 1..30: note = hypo
  source 1..30: mol_type = genomic DNA
tgtgggaaccatgcccgtgaccggtcctcg

SEQ ID NO: 43761 - DNA, 27 bp, Homo sapiens
  misc_feature 1..27: note = chr13:25668696-25668723
  misc_feature 1..27: note = hypo
  source 1..27: mol_type = genomic DNA
ctactctaggctaggcgcggcggctca

SEQ ID NO: 43762 - DNA, 71 bp, Homo sapiens; identical to SEQ ID NO: 15753
  misc_feature 1..71: note = chr13:25670585-25670656
  misc_feature 1..71: note = hypo
  source 1..71: mol_type = genomic DNA

SEQ ID NO: 43763 - DNA, 30 bp, Homo sapiens
  misc_feature 1..30: note = chr13:27278150-27278180
  misc_feature 1..30: note = hypo
  source 1..30: mol_type = genomic DNA
tagggtttgtaatttcgtgtcctatttatg

SEQ ID NO: 43764 - DNA, 108 bp, Homo sapiens
  misc_feature 1..108: note = chr13:28239991-28240099
  misc_feature 1..108: note = hypo
  source 1..108: mol_type = genomic DNA
tacaagcacagcttccgcgctcgaggttccgccagttactccccgccacgaaagcggagcagccaggacaagtacgaaaagcggtccaaccggcggtgaggctggaac

SEQ ID NO: 43765 - DNA, 84 bp, Homo sapiens
  misc_feature 1..84: note = chr13:29914132-29914216
  misc_feature 1..84: note = hypo
  source 1..84: mol_type = genomic DNA
tccgaagtctgcggccggggccaagtgtgctgagcttggtgaccgttggaatcaggacgccagaaagcgcgcaaagcatcgcaa

SEQ ID NO: 43766 - DNA, 30 bp, Homo sapiens
  misc_feature 1..30: note = chr13:29933609-29933639
  misc_feature 1..30: note = hypo
  source 1..30: mol_type = genomic DNA
ggtgaggccccatttcgtgaaggtccaagg

SEQ ID NO: 43767 - DNA, 19 bp, Homo sapiens
  misc_feature 1..19: note = chr13:30031261-30031280
  misc_feature 1..19: note = hypo
  source 1..19: mol_type = genomic DNA
acagcgagactccattcaa

SEQ ID NO: 43768 - DNA, 57 bp, Homo sapiens
  misc_feature 1..57: note = chr13:30107065-30107122
  misc_feature 1..57: note = hypo
  source 1..57: mol_type = genomic DNA
tgcctatcagctcgtcgaaggtggcgctccaggccctcgctacgcttgaagtacctg

SEQ ID NO: 43769 - DNA, 41 bp, Homo sapiens
  misc_feature 1..41: note = chr13:30123237-30123278
  misc_feature 1..41: note = hypo
  source 1..41: mol_type = genomic DNA
gaggcctcctctttacgtggagcggacgtgctagtgggcac

SEQ ID NO: 43770 - DNA, 36 bp, Homo sapiens
  misc_feature 1..36: note = chr13:30149052-30149088
  misc_feature 1..36: note = hypo
  source 1..36: mol_type = genomic DNA
ttaccggcatgagccaccgtgcgtggccagagcagc

SEQ ID NO: 43771 - DNA, 64 bp, Homo sapiens
  misc_feature 1..64: note = chr13:30574503-30574567
  misc_feature 1..64: note = hypo
  source 1..64: mol_type = genomic DNA
tagcacgagagaacccgaaacacaatatttacatgctgttattctttttcgtttctctttcttc

SEQ ID NO: 43772 - DNA, 26 bp, Homo sapiens
  misc_feature 1..26: note = chr13:30707178-30707204
  misc_feature 1..26: note = hypo
  source 1..26: mol_type = genomic DNA
aggtccaggccatagcgacggggacc

SEQ ID NO: 43773 - DNA, 117 bp, Homo sapiens
  misc_feature 1..117: note = chr13:30707244-30707361
  misc_feature 1..117: note = hypo
  source 1..117: mol_type = genomic DNA
cgtccctgcactgggtgggccgtgctgggagaaggtcccggggatcactcctcctaggccgccggggcagtctctccagccaccctctttccccagagccagcgggctggggttctt

SEQ ID NO: 43774 - DNA, 30 bp, Homo sapiens
  misc_feature 1..30: note = chr13:30707569-30707599
  misc_feature 1..30: note = hypo
  source 1..30: mol_type = genomic DNA
gctggctgcctgagccgagggttttacttc

SEQ ID NO: 43775 - DNA, 186 bp, Homo sapiens
  misc_feature 1..186: note = chr13:30761001-30761187
  misc_feature 1..186: note = hypo
  source 1..186: mol_type = genomic DNA
attaacaagccagagcgggggcaccagagtctacgtcagtctcatagaaaaggcatctttcaggtacttctcttctgggcatgactttgaagcaagaataaccgttctggccctttgtttgattaaatggctttgggaactgtgtttccgatctctgtgacaggcttatatcgcttcagtggctgt

SEQ ID NO: 43776 - DNA, 97 bp, Homo sapiens
  misc_feature 1..97: note = chr13:31742917-31743014
  misc_feature 1..97: note = hypo
  source 1..97: mol_type = genomic DNA
cccaggcagataacccgccggctggtgcctcccaactcccaaagctcctttcgcctgggttctggtgtgccatccatgcttacgcatctctctgtgc

SEQ ID NO: 43777 - DNA, 89 bp, Homo sapiens
  misc_feature 1..89: note = chr13:31821217-31821306
  misc_feature 1..89: note = hypo
  source 1..89: mol_type = genomic DNA
tacttccgttgttaccgcagtacgtttgtttaactcacctgtgaattactgacattcctacctgaacacttttacgcccttagtctttt

SEQ ID NO: 43778 - DNA, 21 bp, Homo sapiens
  misc_feature 1..21: note = chr13:32244681-32244702
  misc_feature 1..21: note = hypo
  source 1..21: mol_type = genomic DNA
acaggctaggctgggcgcggt

SEQ ID NO: 43779 - DNA, 30 bp, Homo sapiens
  misc_feature 1..30: note = chr13:32670558-32670588
  misc_feature 1..30: note = hypo
  source 1..30: mol_type = genomic DNA
tgctagggaaaactgcgggggggggcttca

SEQ ID NO: 43780 - DNA, 30 bp, Homo sapiens
  misc_feature 1..30: note = chr13:33113918-33113948
  misc_feature 1..30: note = hypo
  source 1..30: mol_type = genomic DNA
tacagatttctactacgacctttgtctcct

SEQ ID NO: 43781 - DNA, 29 bp, Homo sapiens
  misc_feature 1..29: note = chr13:36883103-36883132
  misc_feature 1..29: note = hypo
  source 1..29: mol_type = genomic DNA
aggtgtggtggctcacgcctgtaatccca

SEQ ID NO: 43782 - DNA, 300 bp, Homo sapiens
  misc_feature 1..300: note = chr13:37643672-37643972
  misc_feature 1..300: note = hypo
  source 1..300: mol_type = genomic DNA
gtcccctgtgccccacgtcccggaagcaacctcctgtgctgcccccaaactcatgcagccaggtgggacccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctatgaggccaggccaagtcgcccagcccagagg

SEQ ID NO: 43783 - DNA, 30 bp, Homo sapiens
  misc_feature 1..30: note = chr13:40020880-40020910
  misc_feature 1..30: note = hypo
  source 1..30: mol_type = genomic DNA
caatagcaaacttcacgatactaagtggca

SEQ ID NO: 43784 - DNA, 32 bp, Homo sapiens
  misc_feature 1..32: note = chr13:41103319-41103351
  misc_feature 1..32: note = hypo
  source 1..32: mol_type = genomic DNA
agtctgagaaactgtcgcggtcaagaggaggc

SEQ ID NO: 43785 - DNA, 53 bp, Homo sapiens; identical to SEQ ID NO: 15760
  misc_feature 1..53: note = chr13:41681520-41681573
  misc_feature 1..53: note = hypo
  source 1..53: mol_type = genomic DNA

SEQ ID NO: 43786 - DNA, 30 bp, Homo sapiens
  misc_feature 1..30: note = chr13:41705935-41705965
  misc_feature 1..30: note = hypo
  source 1..30: mol_type = genomic DNA
tctgctcactctccacgtccagactatcca

SEQ ID NO: 43787 - DNA, 181 bp, Homo sapiens
  misc_feature 1..181: note = chr13:42540722-42540903
  misc_feature 1..181: note = hypo
  source 1..181: mol_type = genomic DNA
ccaggcacacaggttcggcatgtgatttggcctcatagtgcttgacccggcaccaatcagagagctttgtcagagatggatataggtgcagggactctttctaagattatggatgcttatagcctcacataactccagaactgtcagggccatcttggctttaattcgagaagagcttgac

SEQ ID NO: 43788 - DNA, 30 bp, Homo sapiens
  misc_feature 1..30: note = chr13:43543197-43543227
  misc_feature 1..30: note = hypo
  source 1..30: mol_type = genomic DNA
ccctcattccggcagcggctgtgcttgctt

SEQ ID NO: 43789 - DNA, 108 bp, Homo sapiens
  misc_feature 1..108: note = chr13:43986042-43986150
  misc_feature 1..108: note = hypo
  source 1..108: mol_type = genomic DNA
aaagcttaccagacacgagctgctgtccaggcaaccctacgggaaccatgcccaggttattcatggctgtagcccaggctgtgggatctgtcacggacatgttgagct

SEQ ID NO: 43790 - DNA, 30 bp, Homo sapiens
  misc_feature 1..30: note = chr13:45165574-45165604
  misc_feature 1..30: note = hypo
  source 1..30: mol_type = genomic DNA
tcgagggggcgctgccggttgccggtgcga

SEQ ID NO: 43791 - DNA, 17 bp, Homo sapiens
  misc_feature 1..17: note = chr13:45562261-45562278
  misc_feature 1..17: note = hypo
  source 1..17: mol_type = genomic DNA
ctgcactacctggcccg

SEQ ID NO: 43792 - DNA, 229 bp, Homo sapiens
  misc_feature 1..229: note = chr13:45564574-45564803
  misc_feature 1..229: note = hypo
  source 1..229: mol_type = genomic DNA
ctttctttttgccctcgggttttttcctaattacattgcatatttagtacactgtatttgaataatttgtcgacataatctgtctccaccattgcactatggtcttctacctgaacacgcaacaggcacttggtatatacgaaacgaatgcttctcggattccggcatgcatacctatctgctttaatgtttattcacatttgtagactagcaccgacacccagttgga

SEQ ID NO: 43793 - DNA, 28 bp, Homo sapiens
  misc_feature 1..28: note = chr13:45905236-45905264
  misc_feature 1..28: note = hypo
  source 1..28: mol_type = genomic DNA
gctttgcttttgtcgatttgtcttttgt

SEQ ID NO: 43794 - DNA, 30 bp, Homo sapiens
  misc_feature 1..30: note = chr13:45939250-45939280
  misc_feature 1..30: note = hypo
  source 1..30: mol_type = genomic DNA
caggcagcagcaggacgagactcctttctg

SEQ ID NO: 43795 - DNA, 34 bp, Homo sapiens
  misc_feature 1..34: note = chr13:45950905-45950939
  misc_feature 1..34: note = hypo
  source 1..34: mol_type = genomic DNA
agggccccagagtttcggttaaaattccagctgc

SEQ ID NO: 43796 - DNA, 85 bp, Homo sapiens
  misc_feature 1..85: note = chr13:46659255-46659340
  misc_feature 1..85: note = hypo
  source 1..85: mol_type = genomic DNA
attacaggcacgagccactacacgtactttttcaaagcactttcacactcatttcctttgatatttataacgctttgatatagac

SEQ ID NO: 43797 - DNA, 120 bp, Homo sapiens
  misc_feature 1..120: note = chr13:46660682-46660802
  misc_feature 1..120: note = hypo
  source 1..120: mol_type = genomic DNA
ttcagatgggaggaagtgagtgctgattggttcatgggtggccataggcgggtgcggaaaaatcaccgtcagttcccactgcggtccacgggactggcagccttcctgggcttgaaggtg

SEQ ID NO: 43798 - DNA, 75 bp, Homo sapiens
  misc_feature 1..75: note = chr13:46661292-46661367
  misc_feature 1..75: note = hypo
  source 1..75: mol_type = genomic DNA
gggcagctgcagctgcgcctggggagcatgaggctgccgccctgccatcacagaagggggcgggacttttacctc

SEQ ID NO: 43799 - DNA, 172 bp, Homo sapiens; identical to SEQ ID NO: 15765
  misc_feature 1..172: note = chr13:46920144-46920316
  misc_feature 1..172: note = hypo
  source 1..172: mol_type = genomic DNA

SEQ ID NO: 43800 - DNA, 142 bp, Homo sapiens
  misc_feature 1..142: note = chr13:47528522-47528664
  misc_feature 1..142: note = hypo
  source 1..142: mol_type = genomic DNA
acacattttagtgctcgtgtagtgaagaatagttcctttacagtctctttagtgtacagattttctttccatctcccctttctcgcttgcaatttatttgttgaaaaaaccgagatctttgatccatcgtgtttcccccggt

SEQ ID NO: 43801 - DNA, 30 bp, Homo sapiens; identical to SEQ ID NO: 15766
  misc_feature 1..30: note = chr13:48667877-48667907
  misc_feature 1..30: note = hypo
  source 1..30: mol_type = genomic DNA

SEQ ID NO: 43802 - DNA, 63 bp, Homo sapiens
  misc_feature 1..63: note = chr13:49922188-49922251
  misc_feature 1..63: note = hypo
  source 1..63: mol_type = genomic DNA
agggagaccataggacgctggcaggctgaatggaggcctgtggacacccgagcaggctgcaaa

SEQ ID NO: 43803 - DNA, 49 bp, Homo sapiens
  misc_feature 1..49: note = chr13:49923030-49923079
  misc_feature 1..49: note = hypo
  source 1..49: mol_type = genomic DNA
cctccagggagaccacgccccgtccctcaccctccgccaggcattcttc

SEQ ID NO: 43804 - DNA, 19 bp, Homo sapiens
  misc_feature 1..19: note = chr13:50367846-50367865
  misc_feature 1..19: note = hypo
  source 1..19: mol_type = genomic DNA
agagctgctttcggccggg

SEQ ID NO: 43805 - DNA, 75 bp, Homo sapiens
  misc_feature 1..75: note = chr13:52532595-52532670
  misc_feature 1..75: note = hypo
  source 1..75: mol_type = genomic DNA
ccaggacgatgagcacgtccatgttggctgacctgtgtctcagagatttgtaggcctgaacgtagaagtaccacc

SEQ ID NO: 43806 - DNA, 36 bp, Homo sapiens
  misc_feature 1..36: note = chr13:53025686-53025722
  misc_feature 1..36: note = hypo
  source 1..36: mol_type = genomic DNA
ctctcacccaccaggcggcctcgtgcccctagccat

SEQ ID NO: 43807 - DNA, 17 bp, Homo sapiens
  misc_feature 1..17: note = chr13:53580919-53580936
  misc_feature 1..17: note = hypo
  source 1..17: mol_type = genomic DNA
ggcgtgagccaccgcgc

SEQ ID NO: 43808 - DNA, 30 bp, Homo sapiens
  misc_feature 1..30: note = chr13:56180149-56180179
  misc_feature 1..30: note = hypo
  source 1..30: mol_type = genomic DNA
ttgtggacaagtactcggaaccgctgaacg

SEQ ID NO: 43809 - DNA, 30 bp, Homo sapiens
  misc_feature 1..30: note = chr13:60614880-60614910
  misc_feature 1..30: note = hypo
  source 1..30: mol_type = genomic DNA
aactccatagaaatacgatgtgaatctgct

SEQ ID NO: 43810 - DNA, 31 bp, Homo sapiens
  misc_feature 1..31: note = chr13:64311606-64311637
  misc_feature 1..31: note = hypo
  source 1..31: mol_type = genomic DNA
ctggctctcagttcccgcctcgcggcggggg

SEQ ID NO: 43811 - DNA, 30 bp, Homo sapiens
  misc_feature 1..30: note = chr13:65904937-65904967
  misc_feature 1..30: note = hypo
  source 1..30: mol_type = genomic DNA
gggttctcctccgatcgccctggccaaact

SEQ ID NO: 43812 - DNA, 51 bp, Homo sapiens
  misc_feature 1..51: note = chr13:68343951-68344002
  misc_feature 1..51: note = hypo
  source 1..51: mol_type = genomic DNA
tctcctactgcttggcgagcgggagggcgtggtacccgcagcttggcgaat

SEQ ID NO: 43813 - DNA, 30 bp, Homo sapiens
  misc_feature 1..30: note = chr13:74987640-74987670
  misc_feature 1..30: note = hypo
  source 1..30: mol_type = genomic DNA
gagccccctcagcctcgcgggctcagaagt

SEQ ID NO: 43814 - DNA, 28 bp, Homo sapiens
  misc_feature 1..28: note = chr13:77553713-77553741
  misc_feature 1..28: note = hypo
  source 1..28: mol_type = genomic DNA
gggcgcggtgactcacgactgtaagtcg

SEQ ID NO: 43815 - DNA, 44 bp, Homo sapiens
  misc_feature 1..44: note = chr13:78081890-78081934
  misc_feature 1..44: note = hypo
  source 1..44: mol_type = genomic DNA
tcggcctcccaaagtgctgggattacaggcgtaactcatagtaa

SEQ ID NO: 43816 - DNA, 16 bp, Homo sapiens
  misc_feature 1..16: note = chr13:78567988-78568004
  misc_feature 1..16: note = hypo
  source 1..16: mol_type = genomic DNA
gcgcctggcatgtagt

SEQ ID NO: 43817 - DNA, 30 bp, Homo sapiens
  misc_feature 1..30: note = chr13:91948489-91948519
  misc_feature 1..30: note = hypo
  source 1..30: mol_type = genomic DNA
agcagcggcagcaaccgaacagatgagcca

SEQ ID NO: 43818 - DNA, 30 bp, Homo sapiens
  misc_feature 1..30: note = chr13:95711256-95711286
  misc_feature 1..30: note = hypo
  source 1..30: mol_type = genomic DNA
tagaaaatatcagggcgcagaagcatggag

SEQ ID NO: 43819 - DNA, 50 bp, Homo sapiens
  misc_feature 1..50: note = chr13:95718425-95718475
  misc_feature 1..50: note = hypo
  source 1..50: mol_type = genomic DNA
cttggcatatgccatcgtgcctttcacatgcatttcgacctgctgaaatc

SEQ ID NO: 43820 - DNA, 37 bp, Homo sapiens
  misc_feature 1..37: note = chr13:95858839-95858876
  misc_feature 1..37: note = hypo
  source 1..37: mol_type = genomic DNA
gaagaagagggtaaccgtcagccgcacagccccatac

SEQ ID NO: 43821 - DNA, 30 bp, Homo sapiens
  misc_feature 1..30: note = chr13:95888816-95888846
  misc_feature 1..30: note = hypo
  source 1..30: mol_type = genomic DNA
ccaacaagcctgtctcggcatgtgaacgcg

SEQ ID NO: 43822 - DNA, 25 bp, Homo sapiens
  misc_feature 1..25: note = chr13:96031705-96031730
  misc_feature 1..25: note = hypo
  source 1..25: mol_type = genomic DNA
ataaaaagaaatgaccggccgggca

SEQ ID NO: 43823 - DNA, 66 bp, Homo sapiens
  misc_feature 1..66: note = chr13:96409578-96409644
  misc_feature 1..66: note = hypo
  source 1..66: mol_type = genomic DNA
taagaaagtgaaaaacgtgctttccttcctccgttcttctctgtcctttcacgtgcctacatgtat

SEQ ID NO: 43824 - DNA, 18 bp, Homo sapiens
  misc_feature 1..18: note = chr13:97599727-97599745
  misc_feature 1..18: note = hypo
  source 1..18: mol_type = genomic DNA
tctcgcctcactgcaacc

SEQ ID NO: 43825 - DNA, 16 bp, Homo sapiens
  misc_feature 1..16: note = chr13:98426774-98426790
  misc_feature 1..16: note = hypo
  source 1..16: mol_type = genomic DNA
tgcctgatctcagctc

SEQ ID NO: 43826 - DNA, 30 bp, Homo sapiens
  misc_feature 1..30: note = chr13:98866341-98866371
  misc_feature 1..30: note = hypo
  source 1..30: mol_type = genomic DNA
ctcagcagctggagccgttggagccgctgg

SEQ ID NO: 43827 - DNA, 30 bp, Homo sapiens
  misc_feature 1..30: note = chr13:99083172-99083202
  misc_feature 1..30: note = hypo
  source 1..30: mol_type = genomic DNA
ggaaattaaacaaatcgtgaaatagagagt

SEQ ID NO: 43828 - DNA, 42 bp, Homo sapiens
  misc_feature 1..42: note = chr13:99083425-99083467
  misc_feature 1..42: note = hypo
  source 1..42: mol_type = genomic DNA
aacaccttcctcctgcggccactgcaccggctcatgcactac

SEQ ID NO: 43829 - DNA, 30 bp, Homo sapiens
  misc_feature 1..30: note = chr13:99189615-99189645
  misc_feature 1..30: note = hypo
  source 1..30: mol_type = genomic DNA
tgctttgaacagcagcgggctcattcacaa

SEQ ID NO: 43830 - DNA, 30 bp, Homo sapiens
  misc_feature 1..30: note = chr13:99428706-99428736
  misc_feature 1..30: note = hypo
  source 1..30: mol_type = genomic DNA
ttttcaggcagggcgcggtggctcaaggcc

SEQ ID NO: 43831 - DNA, 30 bp, Homo sapiens
  misc_feature 1..30: note = chr13:100095884-100095914
  misc_feature 1..30: note = hypo
  source 1..30: mol_type = genomic DNA
cagagacagcaaattcgcagctttctgtct

SEQ ID NO: 43832 - DNA, 37 bp, Homo sapiens
  misc_feature 1..37: note = chr13:100146505-100146542
  misc_feature 1..37: note = hypo
  source 1..37: mol_type = genomic DNA
ggttccctccactatcgggggaaattcagcccctgat

SEQ ID NO: 43833 - DNA, 81 bp, Homo sapiens; identical to SEQ ID NO: 15770
  misc_feature 1..81: note = chr13:100356871-100356952
  misc_feature 1..81: note = hypo
  source 1..81: mol_type = genomic DNA

SEQ ID NO: 43834 - DNA, 276 bp, Homo sapiens
  misc_feature 1..276: note = chr13:100575337-100575613
  misc_feature 1..276: note = hypo
  source 1..276: mol_type = genomic DNA
aacccatacccaggccgtctggggccttcccttctgccccggcctgcctggtctctgctgccagagcaaggtctgcagcttccgatctccccgcctttcccaaatatgcacgccctgtaccgccgtcccaggctccgtgccaggcggcagcagccactgtgctcacactcatgtgtcgtgtctctcctcccaggtaacttgtttccgtgttaacaggtaatcttcctgctgaggatgtcaggcaacatgccaacctgggaacgaccacctttgggg

SEQ ID NO: 43835 - DNA, 30 bp, Homo sapiens
  misc_feature 1..30: note = chr13:100583792-100583822
  misc_feature 1..30: note = hypo
  source 1..30: mol_type = genomic DNA
ttagcttggatgagccgcttcttaggatga

SEQ ID NO: 43836 - DNA, 30 bp, Homo sapiens
  misc_feature 1..30: note = chr13:102206088-102206118
  misc_feature 1..30: note = hypo
  source 1..30: mol_type = genomic DNA
ttcacaaggcattctcggtgtgcctgccgc

SEQ ID NO: 43837 - DNA, 30 bp, Homo sapiens
  misc_feature 1..30: note = chr13:102385630-102385660
  misc_feature 1..30: note = hypo
  source 1..30: mol_type = genomic DNA
aagcataattatgtacgagtttaagagaca

SEQ ID NO: 43838 - DNA, 27 bp, Homo sapiens
  misc_feature 1..27: note = chr13:103569166-103569193
  misc_feature 1..27: note = hypo
  source 1..27: mol_type = genomic DNA
ccggccgtcccccgttaatcttactcc

SEQ ID NO: 43839 - DNA, 143 bp, Homo sapiens
  misc_feature 1..143: note = chr13:108218849-108218992
  misc_feature 1..143: note = hypo
  source 1..143: mol_type = genomic DNA
acactaagcagccaacgtgatccaacaagaagcaggtccaagggcactaggcaggccaccctaaccagagcctcaccaacctcacggaaaggggttcgcacggtaacaccagattcacgttgtggttccgtttcagacatctt

SEQ ID NO: 43840 - DNA, 24 bp, Homo sapiens
  misc_feature 1..24: note = chr13:110053866-110053890
  misc_feature 1..24: note = hypo
  source 1..24: mol_type = genomic DNA
tacctgagattcaatcgctgaggc

SEQ ID NO: 43841 - DNA, 2065 bp, Homo sapiens
  misc_feature 1..2065: note = chr13:110434379-110436444
  misc_feature 1..2065: note = hypo
  source 1..2065: mol_type = genomic DNA
cctcctcacctttcacgatggtggcctccttcaagtggtgggacaagaagtcaatgctggcgtaggtgttggcagggggcagggcaccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgta

SEQ ID NO: 43842 - DNA, 30 bp, Homo sapiens
  misc_feature 1..30: note = chr13:110659714-110659744
  misc_feature 1..30: note = hypo
  source 1..30: mol_type = genomic DNA
acaaactgcatctagcgtaacaggatcaaa

SEQ ID NO: 43843 - DNA, 77 bp, Homo sapiens
  misc_feature 1..77: note = chr13:110998830-110998907
  misc_feature 1..77: note = hypo
  source 1..77: mol_type = genomic DNA
agtgaccaagacattcgaagacaggcaaggaaaccttcaaatgcaggcaactcatatttcgacggggcaccctccag

SEQ ID NO: 43844 - DNA, 149 bp, Homo sapiens
  misc_feature 1..149: note = chr13:111144888-111145037
  misc_feature 1..149: note = hypo
  source 1..149: mol_type = genomic DNA
gcctccttacagccccgagacgggccaccctgccatgctcactgcccatgtaacagaaggaattgccacctgtttgctgtgtcctgctttagaaatatttaccctcagaaatccagagggaatggaaatgacaccgggctatttgttcc

SEQ ID NO: 43845 - DNA, 496 bp, Homo sapiens
  misc_feature 1..496: note = chr13:111277129-111277625
  misc_feature 1..496: note = hypo
  source 1..496: mol_type = genomic DNA
aacctaaagcgtgatttgtattgtactccaccaaagtgcacctgggatgcctttgtaggtcgcagctgaagccgctgatcctgcagtttcccatgagctgagcaagtgctaacggccggcctcttcctgtgacccttcctcctggagggtgaccagaccgagctgggccgtgctggtgtgtgtggctctgaccctgcctctgcagtggcggcaaaagtctttctttttaggtattgtgctctgcgccctggccctttgctaagccacctggctgggtgtaatccgagctagtacgtttctcatgcacgtcaccagggctgagtaatgagcgctggacgcctgtgtctggcgggtgggcagcgatgccggagcgatccctgagtcggcctcttgtgctccttcatcagggcgcagacttgtcccacgtgttctgtgccagtgcggccgcacctgtgattaaggcctacagcccggagctgatcgtccacccagttct

SEQ ID NO: 43846 - DNA, 89 bp, Homo sapiens
  misc_feature 1..89: note = chr13:111278321-111278410
  misc_feature 1..89: note = hypo
  source 1..89: mol_type = genomic DNA
agcacagtgtgatgacgcctgggtcgagcccggcctctccacaccagagaggagccggcgcggagctccaggtgcggtgctgtgatgtg

SEQ ID NO: 43847 - DNA, 56 bp, Homo sapiens; identical to SEQ ID NO: 15777
  misc_feature 1..56: note = chr13:111289222-111289278
  misc_feature 1..56: note = hypo
  source 1..56: mol_type = genomic DNA

SEQ ID NO: 43848 - DNA, 141 bp, Homo sapiens
  misc_feature 1..141: note = chr13:111363831-111363972
  misc_feature 1..141: note = hypo
  source 1..141: mol_type = genomic DNA
attacaggcgtgagccaccgcgtccggccaagtgttatagtcttttgtgcagaccaagtagtggccaataaatcttgtagaaactaaagtactcatttgcttttaactaggccaagactagaatagcgtgatctgtaagta

SEQ ID NO: 43849 - DNA, 31 bp, Homo sapiens
  misc_feature 1..31: note = chr13:111704359-111704390
  misc_feature 1..31: note = hypo
  source 1..31: mol_type = genomic DNA
cccagaagcaggtcacgagaccctcatgtga

SEQ ID NO: 43850 - DNA, 30 bp, Homo sapiens
  misc_feature 1..30: note = chr13:111764740-111764770
  misc_feature 1..30: note = hypo
  source 1..30: mol_type = genomic DNA
gtcccccaaaagatacgttgggctctgctg

SEQ ID NO: 43851 - DNA, 234 bp, Homo sapiens
  misc_feature 1..234: note = chr13:111978711-111978945
  misc_feature 1..234: note = hypo
  source 1..234: mol_type = genomic DNA
tggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagact

SEQ ID NO: 43852 - DNA, 30 bp, Homo sapiens
  misc_feature 1..30: note = chr13:112062748-112062778
  misc_feature 1..30: note = hypo
  source 1..30: mol_type = genomic DNA
gaaaacctattctggcgtggggtaaagatt

SEQ ID NO: 43853 - DNA, 56 bp, Homo sapiens
  misc_feature 1..56: note = chr13:112078451-112078507
  misc_feature 1..56: note = hypo
  source 1..56: mol_type = genomic DNA
gtctcatttaaccagcgccgctgactgggaaggaaccactgcggccacctccacct

SEQ ID NO: 43854 - DNA, 30 bp, Homo sapiens
  misc_feature 1..30: note = chr13:112090544-112090574
  misc_feature 1..30: note = hypo
  source 1..30: mol_type = genomic DNA
gacagcagacacccccgggagtcagaatcc

SEQ ID NO: 43855 - DNA, 30 bp, Homo sapiens
  misc_feature 1..30: note = chr13:112243149-112243179
  misc_feature 1..30: note = hypo
  source 1..30: mol_type = genomic DNA
ctctgactacacttccgaggccttcaattg

SEQ ID NO: 43856 - DNA, 30 bp, Homo sapiens
  misc_feature 1..30: note = chr13:112272991-112273021
  misc_feature 1..30: note = hypo
  source 1..30: mol_type = genomic DNA
acatggtgagaccaacgtctggaatggcca

SEQ ID NO: 43857 - DNA, 68 bp, Homo sapiens
  misc_feature 1..68: note = chr13:112274715-112274783
  misc_feature 1..68: note = hypo
  source 1..68: mol_type = genomic DNA
tcaatcagacagaaacggtcccttggggcccggcctcctgggtgctgcccgggcgctgccatccaccc

SEQ ID NO: 43858 - DNA, 30 bp, Homo sapiens
  misc_feature 1..30: note = chr13:112320732-112320762
  misc_feature 1..30: note = hypo
  source 1..30: mol_type = genomic DNA
gcagacaatccctgtcgttaacctggaact

SEQ ID NO: 43859 - DNA, 41 bp, Homo sapiens
  misc_feature 1..41: note = chr13:112559680-112559721
  misc_feature 1..41: note = hypo
  source 1..41: mol_type = genomic DNA
agtggactagcaaggcgggaggagcacgtgtttggagtgtg

SEQ ID NO: 43860 - DNA, 30 bp, Homo sapiens
  misc_feature 1..30: note = chr13:112573448-112573478
  misc_feature 1..30: note = hypo
  source 1..30: mol_type = genomic DNA
ccatgccggggactgcgtgagagcccccat

SEQ ID NO: 43861 - DNA, 35 bp, Homo sapiens
  misc_feature 1..35: note = chr13:112573696-112573731
  misc_feature 1..35: note = hypo
  source 1..35: mol_type = genomic DNA
gttgtaaggaggaggcgattcggcagacctaagcc

SEQ ID NO: 43862 - DNA, 30 bp, Homo sapiens
  misc_feature 1..30: note = chr13:112618950-112618980
  misc_feature 1..30: note = hypo
  source 1..30: mol_type = genomic DNA
agcgctctggtccagcgtttccacccacag

SEQ ID NO: 43863 - DNA, 38 bp, Homo sapiens
  misc_feature 1..38: note = chr13:112682862-112682900
  misc_feature 1..38: note = hypo
  source 1..38: mol_type = genomic DNA
cagagggaggaaaaacggcccagcgggagggaggacaa

SEQ ID NO: 43864 - DNA, 50 bp, Homo sapiens
  misc_feature 1..50: note = chr13:112690800-112690850
  misc_feature 1..50: note = hypo
  source 1..50: mol_type = genomic DNA
agcaggcctgagagccggacatgcttccgtgtggccgtcacatccccaga

SEQ ID NO: 43865 - DNA, 30 bp, Homo sapiens
  misc_feature 1..30: note = chr13:112800543-112800573
  misc_feature 1..30: note = hypo
  source 1..30: mol_type = genomic DNA
agcttggacttgattcgagatcacttttac

SEQ ID NO: 43866 - DNA, 41 bp, Homo sapiens
  misc_feature 1..41: note = chr13:112830483-112830524
  misc_feature 1..41: note = hypo
  source 1..41: mol_type = genomic DNA
tcctgcccaggatagcggcagcacctcggggaatggagccc

SEQ ID NO: 43867 - DNA, 32 bp, Homo sapiens
  misc_feature 1..32: note = chr13:112882268-112882300
  misc_feature 1..32: note = hypo
  source 1..32: mol_type = genomic DNA
acatctcttcatttacggaggaagtttcagtg

SEQ ID NO: 43868 - DNA, 32 bp, Homo sapiens
  misc_feature 1..32: note = chr13:112882360-112882392
  misc_feature 1..32: note = hypo
  source 1..32: mol_type = genomic DNA
attcaaggttatgatcacgcactttcgtggag

SEQ ID NO: 43869 - DNA, 42 bp, Homo sapiens
  misc_feature 1..42: note = chr13:113099281-113099323
  misc_feature 1..42: note = hypo
  source 1..42: mol_type = genomic DNA
agaaagcctcctcagcgacagcggctgcgacccagaaagccc

SEQ ID NO: 43870 - DNA, 73 bp, Homo sapiens
  misc_feature 1..73: note = chr13:113107030-113107103
  misc_feature 1..73: note = hypo
  source 1..73: mol_type = genomic DNA
actcctggcagcagacggaagggcggctgccgggccctcagacccaggacgggcaccacgctggagctcagcc

SEQ ID NO: 43871 - DNA, 30 bp, Homo sapiens
  misc_feature 1..30: note = chr13:113319347-113319377
  misc_feature 1..30: note = hypo
  source 1..30: mol_type = genomic DNA
ttggtgaacctgcatcgttggcagagctgc

SEQ ID NO: 43872 - DNA, 210 bp, Homo sapiens
  misc_feature 1..210: note = chr13:113400400-113400610
  misc_feature 1..210: note = hypo
  source 1..210: mol_type = genomic DNA
tgatggactcttgggcgtctgccgtaggccgctgtgaatgctggcggcggtgatcgtgtgctgacgtctcctccacgtactgagttcgtgtcttttggatgcgcgcccagaggtggcactgctggatcctgtgctgggtcatacctatgtttaattctctgaggaacctccgtgctgtctccatagcagccgtgtcgtttcacacttgca

SEQ ID NO: 43873 - DNA, 39 bp, Homo sapiens
  misc_feature 1..39: note = chr13:113401430-113401469
  misc_feature 1..39: note = hypo
  source 1..39: mol_type = genomic DNA
atcacccgtctgctccggagggatcgcttgttgagatga

SEQ ID NO: 43874 - DNA, 30 bp, Homo sapiens
  misc_feature 1..30: note = chr13:113424905-113424935
  misc_feature 1..30: note = hypo
  source 1..30: mol_type = genomic DNA
aaggtgggagagaaccgtgcatctcagcac

SEQ ID NO: 43875 - DNA, 125 bp, Homo sapiens
  misc_feature 1..125: note = chr13:113598563-113598688
  misc_feature 1..125: note = hypo
  source 1..125: mol_type = genomic DNA
atgaagggagggtcccgggtgaagagcaagctcatgaccctcatttactgggaatccattgctctggccccgtcatgagtggggttcgcagactgggccaatccctacagcgtatgtgtgctctg

SEQ ID NO: 43876 - DNA, 30 bp, Homo sapiens
  misc_feature 1..30: note = chr13:113608292-113608322
  misc_feature 1..30: note = hypo
  source 1..30: mol_type = genomic DNA
tgtctgctctgagaacgctgtggcatgctg

SEQ ID NO: 43877 - DNA, 79 bp, Homo sapiens
  misc_feature 1..79: note = chr13:113648553-113648632
  misc_feature 1..79: note = hypo
  source 1..79: mol_type = genomic DNA
actatgcaggtgtctcgggcaggggctggcgtggctgtcggcgtgacggggcgcggcgcgtgggacgccaagctgacgt

SEQ ID NO: 43878 - DNA, 44 bp, Homo sapiens
  misc_feature 1..44: note = chr13:113763552-113763596
  misc_feature 1..44: note = hypo
  source 1..44: mol_type = genomic DNA
tgtcccgggggtcgtgggtgtcccgggagcgtgggtgtcgggga

SEQ ID NO: 43879 - DNA, 42 bp, Homo sapiens
  misc_feature 1..42: note = chr13:113776004-113776046
  misc_feature 1..42: note = hypo
  source 1..42: mol_type = genomic DNA
gaggaccaggctgtgcgtggtgcccgccgtgggaggccagcc

SEQ ID NO: 43880 - DNA, 277 bp, Homo sapiens
  misc_feature 1..277: note = chr13:113985679-113985956
  misc_feature 1..277: note = hypo
  source 1..277: mol_type = genomic DNA
gagtgaccacagctgcggggctgggataccaggaggcacgggctgcagcatgggaggcggcccaggaggagatgccaagaaggcacagcaaggacagccagtgcaggagccacccgggtgcccacccagcagctgcgcacccccactgcccgagccagcctctctgcatctcttttcctgagaagacttcggcgtggcacagcccttacagggcgtgagccttctcagacgcagctcaggttacagcaaggaagctgcaaggctggttttgctgttt

SEQ ID NO: 43881 - DNA, 182 bp, Homo sapiens
  misc_feature 1..182: note = chr13:114055958-114056140
  misc_feature 1..182: note = hypo
  source 1..182: mol_type = genomic DNA
gggagctgtggggaccggccccccagagctcagcacagcccggccctccttccagacaccagcactcgcatgtcccagcaggtgagggtgggtcaaacctgctggatctgaagttaattgttcgactggaaggaaacctgtgcgctccccggagcatgacgccacgccgcctccttggcgct

SEQ ID NO: 43882 - DNA, 30 bp, Homo sapiens
  misc_feature 1..30: note = chr13:114059583-114059613
  misc_feature 1..30: note = hypo
  source 1..30: mol_type = genomic DNA
agatggggagggccccgctggtgggtgcca

SEQ ID NO: 43883 - DNA, 479 bp, Homo sapiens
  misc_feature 1..479: note = chr13:114059986-114060465
  misc_feature 1..479: note = hypo
  source 1..479: mol_type = genomic DNA
cctctgggtgctggacgagggccacgcctctcaggaggctcctccctgctgctccactcttgggctccaaggatcccccaggggccaggaggccgtggctgtgagggtctcgagggagagcctctcctctggggtggctttcggacaaggctctgcttccccactggcccagcgtctctggctctcccgctgtgcggtctccagggctctgggtgctgcctggcgctggtgcaggcgtggcgcggctcgcaacgctccctgcagctgccatcgccccacaggctttcatacctggtttgggtggttcatttaatgaggacagtgggttctcgcgaacatcatggctggtgatttcctcggcagccttcaggggctgagaagactctattagcagcggccttctgcattcctccagcgcaccgggcactgtcatgcccatcggggtgacaccctcaggccccgtacgccccttggatgat

SEQ ID NO: 43884 - DNA, 106 bp, Homo sapiens
  misc_feature 1..106: note = chr13:114060775-114060881
  misc_feature 1..106: note = hypo
  source 1..106: mol_type = genomic DNA
ctgggacactgtggtcggcgcccacagcccctcttgctgctgccagacgcggagctgcccgtggcccctgcggcgaagaggcgctgagtcccgcctgcatccctga

SEQ ID NO: 43885 - DNA, 33 bp, Homo sapiens
  misc_feature 1..33: note = chr13:114064741-114064774
  misc_feature 1..33: note = hypo
  source 1..33: mol_type = genomic DNA
aaccactgaggcagacggcgctccttccaaacc

SEQ ID NO: 43886 - DNA, 715 bp, Homo sapiens
  misc_feature 1..715: note = chr13:114074574-114075289
  misc_feature 1..715: note = hypo
  source 1..715: mol_type = genomic DNA
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggagagggaagcccactttccggtaagcgggcaaaacaggtactacgaccgtgttacttatgctagcaacagttccgacttaccttaattgggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccctgggacacctctacccctgggacacacctagccccaggacccgcccacccccgggacccgctcaccccgggacaccactacccctgggacatgcccacccctgggacaaccctaccccccccgacacgccctgggacacgc

SEQ ID NO: 43887 - DNA, 30 bp, Homo sapiens
  misc_feature 1..30: note = chr13:114108109-114108139
  misc_feature 1..30: note = hypo
  source 1..30: mol_type = genomic DNA
gcagatgtgtgcaggcgtgcctgtcactgc

SEQ ID NO: 43888 - DNA, 43 bp, Homo sapiens; identical to SEQ ID NO: 15787
  misc_feature 1..43: note = chr13:114122929-114122972
  misc_feature 1..43: note = hypo
  source 1..43: mol_type = genomic DNA

SEQ ID NO: 43889 - DNA, 86 bp, Homo sapiens; identical to SEQ ID NO: 15788
  misc_feature 1..86: note = chr13:114188403-114188489
  misc_feature 1..86: note = hypo
  source 1..86: mol_type = genomic DNA

SEQ ID NO: 43890 - DNA, 30 bp, Homo sapiens
  misc_feature 1..30: note = chr13:114189602-114189632
  misc_feature 1..30: note = hypo
  source 1..30: mol_type = genomic DNA
tgggcttctgcttaccgagacgacagtctt

SEQ ID NO: 43891 - DNA, 57 bp, Homo sapiens
  misc_feature 1..57: note = chr13:114220577-114220634
  misc_feature 1..57: note = hypo
  source 1..57: mol_type = genomic DNA
ggcgacagcggggctcggagccaccgccacagccctgcccgacgtaggtaattcacc

SEQ ID NO: 43892 - DNA, 42 bp, Homo sapiens
  misc_feature 1..42: note = chr13:114221622-114221664
  misc_feature 1..42: note = hypo
  source 1..42: mol_type = genomic DNA
taaaccaccagtttccgacttctgtactaaaacatgttctct

SEQ ID NO: 43893 - DNA, 62 bp, Homo sapiens
  misc_feature 1..62: note = chr13:114271940-114272002
  misc_feature 1..62: note = hypo
  source 1..62: mol_type = genomic DNA
gctcacctgcagagccgctcacctgcagagccgctcacctgcagagccgctcacctgcagag

SEQ ID NO: 43894 - DNA, 30 bp, Homo sapiens
  misc_feature 1..30: note = chr13:114285192-114285222
  misc_feature 1..30: note = hypo
  source 1..30: mol_type = genomic DNA
cagtgtccacactggcgttgcctctggtgg

SEQ ID NO: 43895 - DNA, 30 bp, Homo sapiens
  misc_feature 1..30: note = chr13:114285597-114285627
  misc_feature 1..30: note = hypo
  source 1..30: mol_type = genomic DNA
aaacttgaccgttagcgccttgtgtgcggt

SEQ ID NO: 43896 - DNA, 159 bp, Homo sapiens; identical to SEQ ID NO: 5147
  misc_feature 1..159: note = chr13:114304752-114304911
  misc_feature 1..159: note = hypo
  source 1..159: mol_type = genomic DNA

SEQ ID NO: 43897 - DNA, 53 bp, Homo sapiens
  misc_feature 1..53: note = chr13:114312349-114312402
  misc_feature 1..53: note = hypo
  source 1..53: mol_type = genomic DNA
cacctggacagggtgcggcccagcatctgccccgtgtccgggttccagcagta

SEQ ID NO: 43898 - DNA, 30 bp, Homo sapiens
  misc_feature 1..30: note = chr13:114318203-114318233
  misc_feature 1..30: note = hypo
  source 1..30: mol_type = genomic DNA
ttcttcaaaactaaacgtgcaattacgaca

SEQ ID NO: 43899 - DNA, 30 bp, Homo sapiens
  misc_feature 1..30: note = chr13:114426896-114426926
  misc_feature 1..30: note = hypo
  source 1..30: mol_type = genomic DNA
gcacacatgtgtatccgtgtgcctgtgtct

SEQ ID NO: 43900 - DNA, 46 bp, Homo sapiens
  misc_feature 1..46: note = chr13:114450608-114450654
  misc_feature 1..46: note = hypo
  source 1..46: mol_type = genomic DNA
tctgggcacagaatccgccgggcacagattccgctgggcacagaat

SEQ ID NO: 43901 - DNA, 22 bp, Homo sapiens
  misc_feature 1..22: note = chr13:114454880-114454902
  misc_feature 1..22: note = hypo
  source 1..22: mol_type = genomic DNA
cagttgtgccagctccgtggct

SEQ ID NO: 43902 - DNA, 59 bp, Homo sapiens
  misc_feature 1..59: note = chr13:114479383-114479442
  misc_feature 1..59: note = hypo
  source 1..59: mol_type = genomic DNA
cgcacctctcttctgcgggcggcacctgcttcctgtcgtcctcccgacagctacgtcca

SEQ ID NO: 43903 - DNA, 30 bp, Homo sapiens
  misc_feature 1..30: note = chr13:114497409-114497439
  misc_feature 1..30: note = hypo
  source 1..30: mol_type = genomic DNA
cgggacggaaccaagcgagatgccaactcg

SEQ ID NO: 43904 - DNA, 434 bp, Homo sapiens
  misc_feature 1..434: note = chr13:114497844-114498278
  misc_feature 1..434: note = hypo
  source 1..434: mol_type = genomic DNA
gttgcttctcagaggcgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagttctgtgaaagaagccccgacctcgagctgggactttgaattggtttgcgtttgaaaaccggggttggtaaaagctgggcacccacacctctccttctgttgcagctggtggcagcgatcgtgtttatcagttttggcgtggtggccgccttctgctgcgccatcgtggacggcgtatttgcagcacagcacattgtgagtacattgtcattgtgtgcacagtcgctttccggggctgaaagagtcgacgtgaaaaaagtaca

SEQ ID NO: 43905 - DNA, 175 bp, Homo sapiens
  misc_feature 1..175: note = chr13:114502787-114502962
  misc_feature 1..175: note = hypo
  source 1..175: mol_type = genomic DNA
caggtgagtgagatgcggggagtaatgacccgcgggcggccgccgccttcgccaggaccgtcggagggcacagctctgtgacggcgctctctgtgtgtctcgcacctgccctgtgtggattcctggctttaactaaacgcagcctctcatcctcagcacgcgtgtcagaggagga

SEQ ID NO: 43906 - DNA, 45 bp, Homo sapiens
  misc_feature 1..45: note = chr13:114506372-114506417
  misc_feature 1..45: note = hypo
  source 1..45: mol_type = genomic DNA
acattccaagctggacgtgcccttcgtagacgagggcaaattact

SEQ ID NO: 43907 - DNA, 123 bp, Homo sapiens
  misc_feature 1..123: note = chr13:114526487-114526610
  misc_feature 1..123: note = hypo
  source 1..123: mol_type = genomic DNA
aggttgattcagtcccgacgtccagaggggtccgcactgcaatgaaagcggtgcattatagggtggtatgcacggtggagaggccacagtgaggtcggagcagggcctcgagagatgcagtcc

SEQ ID NO: 43908 - DNA, 154 bp, Homo sapiens
  misc_feature 1..154: note = chr13:114742788-114742942
  misc_feature 1..154: note = hypo
  source 1..154: mol_type = genomic DNA
ctgctcatgaaaaaccgcagtcacggagccggacgaggatacaagtgactctccctctagtcccctcacgtgtaaattgtgtgttcagtgaaaggctgatcgagacccaaagaatgcagccctgtgtctcctctacctacgacctggaagcccc

SEQ ID NO: 43909 - DNA, 77 bp, Homo sapiens
  misc_feature 1..77: note = chr13:114746775-114746852
  misc_feature 1..77: note = hypo
  source 1..77: mol_type = genomic DNA
aggttatcacagggccggactctcacctgaggcaccacaggtgaatgccactgtcagagcagcgctgcccatcacca

SEQ ID NO: 43910 - DNA, 783 bp, Homo sapiens
  misc_feature 1..783: note = chr13:114748353-114749136
  misc_feature 1..783: note = hypo
  source 1..783: mol_type = genomic DNA
tgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtg

SEQ ID NO: 43911 - DNA, 32 bp, Homo sapiens
  misc_feature 1..32: note = chr13:114749950-114749982
  misc_feature 1..32: note = hypo
  source 1..32: mol_type = genomic DNA
aacagcatcatgcttcgcgcattttcaacctg

SEQ ID NO: 43912 - DNA, 30 bp, Homo sapiens
  misc_feature 1..30: note = chr13:114751360-114751390
  misc_feature 1..30: note = hypo
  source 1..30: mol_type = genomic DNA
tacacatccttccaacgcaagctcctccag

SEQ ID NO: 43913 - DNA, 64 bp, Homo sapiens
  misc_feature 1..64: note = chr13:114760951-114761015
  misc_feature 1..64: note = hypo
  source 1..64: mol_type = genomic DNA
tggccacaacaacagcgaggtgcatctcacggagcataaccagggggaccgccaggcacccagg

SEQ ID NO: 43914 - DNA, 56 bp, Homo sapiens
  misc_feature 1..56: note = chr13:114765157-114765213
  misc_feature 1..56: note = hypo
  source 1..56: mol_type = genomic DNA
gactgtcagtgggtgcgggccccgctgtcccggctggggtccgggtggggctgagg

SEQ ID NO: 43915 - DNA, 137 bp, Homo sapiens
  misc_feature 1..137: note = chr13:114767508-114767645
  misc_feature 1..137: note = hypo
  source 1..137: mol_type = genomic DNA
gggccctctgaggctcggccttcattgccgggcaggggtccctgaccagaaccggcggccgagctggaggagaagaaagtggccagacagagtgactggaggacagaggtggaagctgaggacgagaagccaagctg

SEQ ID NO: 43916 - DNA, 81 bp, Homo sapiens
  misc_feature 1..81: note = chr13:114767926-114768007
  misc_feature 1..81: note = hypo
  source 1..81: mol_type = genomic DNA
ggacccagtgggatgcgcagggcggggcctacacagacgggggttggggggggactgggagctccacgacatgccggcctc

SEQ ID NO: 43917 - DNA, 206 bp, Homo sapiens
  misc_feature 1..206: note = chr13:114769986-114770192
  misc_feature 1..206: note = hypo
  source 1..206: mol_type = genomic DNA
tgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaaccc

SEQ ID NO: 43918 - DNA, 124 bp, Homo sapiens
  misc_feature 1..124: note = chr13:114770941-114771065
  misc_feature 1..124: note = hypo
  source 1..124: mol_type = genomic DNA
cccctccaaggtcaccgagaaggtggcagaggggtcccaggctgaaggcgcaggggccagacccccagggctgtcccctctgactctggttccctgagcaaagagccctcgggagcctggaggg

SEQ ID NO: 43919 - DNA, 179 bp, Homo sapiens
  misc_feature 1..179: note = chr13:114774968-114775147
  misc_feature 1..179: note = hypo
  source 1..179: mol_type = genomic DNA
cagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagac

SEQ ID NO: 43920 - DNA, 64 bp, Homo sapiens
  misc_feature 1..64: note = chr13:114776318-114776382
  misc_feature 1..64: note = hypo
  source 1..64: mol_type = genomic DNA
gcaacgcccaggaggcgccaggttaggccatctgcctggcctgttcagccgcttcccacacctg

SEQ ID NO: 43921 - DNA, 40 bp, Homo sapiens
  misc_feature 1..40: note = chr13:114777010-114777050
  misc_feature 1..40: note = hypo
  source 1..40: mol_type = genomic DNA
gtcatggctctggggcgctgagtctcggggtgctgagtct

SEQ ID NO: 43922 - DNA, 34 bp, Homo sapiens
  misc_feature 1..34: note = chr13:114778697-114778731
  misc_feature 1..34: note = hypo
  source 1..34: mol_type = genomic DNA
ctgcagtgtacctgacgtccgggtcatctgcggg

SEQ ID NO: 43923 - DNA, 78 bp, Homo sapiens
  misc_feature 1..78: note = chr13:114779945-114780023
  misc_feature 1..78: note = hypo
  source 1..78: mol_type = genomic DNA
tgtctgcagctgtcccgaggccacaggacacgcaaggaagagaggagccggcagcaaggccctcgctgagcctctcag

SEQ ID NO: 43924 - DNA, 528 bp, Homo sapiens; identical to SEQ ID NO: 1603
  misc_feature 1..528: note = chr13:114780555-114781083
  misc_feature 1..528: note = hypo
  source 1..528: mol_type = genomic DNA

SEQ ID NO: 43925 - DNA, 30 bp, Homo sapiens
  misc_feature 1..30: note = chr13:114784556-114784586
  misc_feature 1..30: note = hypo
  source 1..30: mol_type = genomic DNA
agcagggctggtcaccggggatccccagga

SEQ ID NO: 43926 - DNA, 66 bp, Homo sapiens
  misc_feature 1..66: note = chr13:114785766-114785832
  misc_feature 1..66: note = hypo
  source 1..66: mol_type = genomic DNA
gtctgaggcattagccgccccccatcgccccaggtaggtagagcctgtgtgcgaggcattagcacc

SEQ ID NO: 43927 - DNA, 35 bp, Homo sapiens
  misc_feature 1..35: note = chr13:114786866-114786901
  misc_feature 1..35: note = hypo
  source 1..35: mol_type = genomic DNA
aacatcatcttaccacgcctcgtaggagctggact

SEQ ID NO: 43928 - DNA, 30 bp, Homo sapiens
  misc_feature 1..30: note = chr13:114789401-114789431
  misc_feature 1..30: note = hypo
  source 1..30: mol_type = genomic DNA
acccgccaggccctgcgacctctgagtgag

SEQ ID NO: 43929 - DNA, 36 bp, Homo sapiens
  misc_feature 1..36: note = chr13:114802282-114802318
  misc_feature 1..36: note = hypo
  source 1..36: mol_type = genomic DNA
aattacaagcatgagccaccgcgcccagcctggagt

SEQ ID NO: 43930 - DNA, 30 bp, Homo sapiens
  misc_feature 1..30: note = chr13:114802665-114802695
  misc_feature 1..30: note = hypo
  source 1..30: mol_type = genomic DNA
tttgtggagatgcaacgtctgagtcctgat

SEQ ID NO: 43931 - DNA, 225 bp, Homo sapiens
  misc_feature 1..225: note = chr13:114807622-114807847
  misc_feature 1..225: note = hypo
  source 1..225: mol_type = genomic DNA
gaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctaggg

SEQ ID NO: 43932 - DNA, 18 bp, Homo sapiens
  misc_feature 1..18: note = chr13:114812180-114812198
  misc_feature 1..18: note = hypo
  source 1..18: mol_type = genomic DNA
gtccgagccctgccttca

SEQ ID NO: 43933 - DNA, 53 bp, Homo sapiens
  misc_feature 1..53: note = chr13:114843043-114843096
  misc_feature 1..53: note = hypo
  source 1..53: mol_type = genomic DNA
ctggcaccaatgcaccggattcatccttcctccctgcccgacaatgcccagtc

SEQ ID NO: 43934 - DNA, 195 bp, Homo sapiens
  misc_feature 1..195: note = chr13:114855474-114855669
  misc_feature 1..195: note = hypo
  source 1..195: mol_type = genomic DNA
tgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaa

SEQ ID NO: 43935 - DNA, 38 bp, Homo sapiens
  misc_feature 1..38: note = chr13:114917035-114917073
  misc_feature 1..38: note = hypo
  source 1..38: mol_type = genomic DNA
cactcaccagtgccacgtgcacacggatcatctaattc

SEQ ID NO: 43936 - DNA, 189 bp, Homo sapiens
  misc_feature 1..189: note = chr13:114961744-114961933
  misc_feature 1..189: note = hypo
  source 1..189: mol_type = genomic DNA
ttcagaacttcaggccgtgtgctgacatggaatccctggtgccacgaaagaccccagagcagcacaatctgagctcactctgtttccaatactgcgcccaggtaacgctgcctcctcatgccacaggtccagagcgcccagccgctggtagacacccgcgccccgctgacgttccgccatctccacctg

SEQ ID NO: 43937 - DNA, 50 bp, Homo sapiens
  misc_feature 1..50: note = chr13:114989948-114989998
  misc_feature 1..50: note = hypo
  source 1..50: mol_type = genomic DNA
ctctccaggcagccccgcccccctgtgtcgtgaagcgcaactgggcacag

SEQ ID NO: 43938 - DNA, 30 bp, Homo sapiens
  misc_feature 1..30: note = chr14:19828313-19828343
  misc_feature 1..30: note = hypo
  source 1..30: mol_type = genomic DNA
gcccagcgcaagggtcgatgggaagacact

SEQ ID NO: 43939 - DNA, 30 bp, Homo sapiens
  misc_feature 1..30: note = chr14:20928272-20928302
  misc_feature 1..30: note = hypo
  source 1..30: mol_type = genomic DNA
tacattctctgtatacgctcatcctttttt

SEQ ID NO: 43940 - DNA, 107 bp, Homo sapiens
  misc_feature 1..107: note = chr14:21190405-21190512
  misc_feature 1..107: note = hypo
  source 1..107: mol_type = genomic DNA
gctgccgttaactgacgccatctttctggcacggatgtcacagccaaatcacgcaaagtggaaggtggtggtaaggagggatggggtgatgccggcagacagaggaa

SEQ ID NO: 43941 - DNA, 24 bp, Homo sapiens
  misc_feature 1..24: note = chr14:21265229-21265253
  misc_feature 1..24: note = hypo
  source 1..24: mol_type = genomic DNA
gcacctggccgtagcttctaattc

SEQ ID NO: 43942 - DNA, 23 bp, Homo sapiens
  misc_feature 1..23: note = chr14:21282035-21282058
  misc_feature 1..23: note = hypo
  source 1..23: mol_type = genomic DNA
atgtttctggctgggcgcagtgg

SEQ ID NO: 43943 - DNA, 32 bp, Homo sapiens
  misc_feature 1..32: note = chr14:21657875-21657907
  misc_feature 1..32: note = hypo
  source 1..32: mol_type = genomic DNA
agctttcccactggccgggcgcggtggctcac

SEQ ID NO: 43944 - DNA, 30 bp, Homo sapiens
  misc_feature 1..30: note = chr14:21721854-21721884
  misc_feature 1..30: note = hypo
  source 1..30: mol_type = genomic DNA
ttaagtattagtggccgctaacactgccaa

SEQ ID NO: 43945 - DNA, 42 bp, Homo sapiens
  misc_feature 1..42: note = chr14:21980230-21980272
  misc_feature 1..42: note = hypo
  source 1..42: mol_type = genomic DNA
gaggtgaggagggggcggtggtgggtgcgggcatgcttcttt

SEQ ID NO: 43946 - DNA, 38 bp, Homo sapiens
  misc_feature 1..38: note = chr14:22551269-22551307
  misc_feature 1..38: note = hypo
  source 1..38: mol_type = genomic DNA
aattgttttagtggccgggcgcggtggctcacgcctgt

SEQ ID NO: 43947 - DNA, 30 bp, Homo sapiens
  misc_feature 1..30: note = chr14:23183874-23183904
  misc_feature 1..30: note = hypo
  source 1..30: mol_type = genomic DNA
tacacccctcccccccgtgatatagttcct

SEQ ID NO: 43948 - DNA, 46 bp, Homo sapiens
  misc_feature 1..46: note = chr14:23355390-23355436
  misc_feature 1..46: note = hypo
  source 1..46: mol_type = genomic DNA
cgttggaaacaagagcgacttggcccgctcccgggaggtatcactg

SEQ ID NO: 43949 - DNA, 41 bp, Homo sapiens
  misc_feature 1..41: note = chr14:23426904-23426945
  misc_feature 1..41: note = hypo
  source 1..41: mol_type = genomic DNA
ggccaggcctcgtttagttcttaaagcgtcctgtgagaaag

SEQ ID NO: 43950 - DNA, 38 bp, Homo sapiens
  misc_feature 1..38: note = chr14:23706727-23706765
  misc_feature 1..38: note = hypo
  source 1..38: mol_type = genomic DNA
aaattttcctgtttccgattttacgctattctttcaaa

SEQ ID NO: 43951 - DNA, 141 bp, Homo sapiens
  misc_feature 1..141: note = chr14:23707497-23707638
  misc_feature 1..141: note = hypo
  source 1..141: mol_type = genomic DNA
aaagttagtgtatcacgatcgaacaaataggacaacgaagctcgtggcactgtgggatgcgtttgcgttgagctgtttattcagtacattttttatcgtaaatcttacgaagtttgtatccctcagcggttacacacacac

SEQ ID NO: 43952 - DNA, 285 bp, Homo sapiens
  misc_feature 1..285: note = chr14:23776954-23777239
  misc_feature 1..285: note = hypo
  source 1..285: mol_type = genomic DNA
cttgcctcttatagccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttca

SEQ ID NO: 43953 - DNA, 94 bp, Homo sapiens
  misc_feature 1..94: note = chr14:23884288-23884382
  misc_feature 1..94: note = hypo
  source 1..94: mol_type = genomic DNA
tcattctccagctcccgcacccgcgcttccagcttctgcagctgcttcttgccgcccttgagggcgatctgctcggcttcgtccagccggtgct

SEQ ID NO: 43954 - DNA, 93 bp, Homo sapiens
  misc_feature 1..93: note = chr14:24021398-24021491
  misc_feature 1..93: note = hypo
  source 1..93: mol_type = genomic DNA
tctgcctcctccacacggttacatagtcccctgagctgggttgggggaggttcgggctcctcctcatcttcagtttatcgcttattaagtgct

SEQ ID NO: 43955 - DNA, 153 bp, Homo sapiens; identical to SEQ ID NO: 15809
  misc_feature 1..153: note = chr14:24862082-24862235
  misc_feature 1..153: note = hypo
  source 1..153: mol_type = genomic DNA

SEQ ID NO: 43956 - DNA, 30 bp, Homo sapiens
  misc_feature 1..30: note = chr14:24901976-24902006
  misc_feature 1..30: note = hypo
  source 1..30: mol_type = genomic DNA
cagtacttctgggaccgtggtcaccgtgac

SEQ ID NO: 43957 - DNA, 100 bp, Homo sapiens
  misc_feature 1..100: note = chr14:31027393-31027493
  misc_feature 1..100: note = hypo
  source 1..100: mol_type = genomic DNA
aggcgtgagccaccgcgcccggccctcaaactgtatttttgacaaaggctaaaggtatgctgtcatggtttggtttgtactgatccgtttaggtaattca

SEQ ID NO: 43958 - DNA, 119 bp, Homo sapiens
  misc_feature 1..119: note = chr14:31534496-31534615
  misc_feature 1..119: note = hypo
  source 1..119: mol_type = genomic DNA
gtagctcattcttcacgacctcacatcagtgccccttctccgggaagcagttcttcactctcctgtgatgttccttgtccctcccttctgtacacctatggaagcggacctgtcccagt

SEQ ID NO: 43959 - DNA, 100 bp, Homo sapiens
  misc_feature 1..100: note = chr14:31925624-31925724
  misc_feature 1..100: note = hypo
  source 1..100: mol_type = genomic DNA
taaaaaataaaataaatgtaaaataataactaaaattgttttaagtaatgctagatctgggaccgaattcagcagaaaaggcgagcgaatgagattttgc

SEQ ID NO: 43960 - DNA, 97 bp, Homo sapiens
  misc_feature 1..97: note = chr14:32597741-32597838
  misc_feature 1..97: note = hypo
  source 1..97: mol_type = genomic DNA
gtgctgaggctggcccgcctctgcgtgggcaggatcttggcattccttttgctccatggacgctgcctccctgggctcgccgcgcctggccgcccgg

SEQ ID NO: 43961 - DNA, 23 bp, Homo sapiens
  misc_feature 1..23: note = chr14:34920639-34920662
  misc_feature 1..23: note = hypo
  source 1..23: mol_type = genomic DNA
caattctaggctgggcgcggtag

SEQ ID NO: 43962 - DNA, 16 bp, Homo sapiens
  misc_feature 1..16: note = chr14:34921211-34921227
  misc_feature 1..16: note = hypo
  source 1..16: mol_type = genomic DNA
tagcgtggtggctcac

SEQ ID NO: 43963 - DNA, 30 bp, Homo sapiens
  misc_feature 1..30: note = chr14:35017114-35017144
  misc_feature 1..30: note = hypo
  source 1..30: mol_type = genomic DNA
cttttaggagagtctcgtgacagcctctgt

SEQ ID NO: 43964 - DNA, 443 bp, Homo sapiens
  misc_feature 1..443: note = chr14:35023168-35023611
  misc_feature 1..443: note = hypo
  source 1..443: mol_type = genomic DNA
aatacttaataacaataaagaagaattcgtccattcaacaaccgttcactgagcgcatagcctgtgcccagacactgttccaggcctctgggagcaaaaaggcctcggtgcccgtattctagttagacaacgagaagcgcggggaggtggggggcgggggtgggagagagaaaatctacaccgggctgcataggtaaattcgtaggttaggtgctaagtgctttgaaaaagcaaacaaacacagggaaagtgagataaggagttgcggcaaggggcaggtggctgtgttaaatcgagtggttggaagaagctgctatgagaaggtaccgtatgagcaaaggacttgaagcaggtgaagggagttggtcacggggcatccccagcacaaacatcagctacagcaaaggcccaggtaggactgggtttggcgaacagcaaggagg

SEQ ID NO: 43965 - DNA, 20 bp, Homo sapiens
  misc_feature 1..20: note = chr14:35024446-35024466
  misc_feature 1..20: note = hypo
  source 1..20: mol_type = genomic DNA
tatttatttttgagacggag

SEQ ID NO: 43966 - DNA, 17 bp, Homo sapiens
  misc_feature 1..17: note = chr14:35507705-35507722
  misc_feature 1..17: note = hypo
  source 1..17: mol_type = genomic DNA
ttacgaatagagcgccg

SEQ ID NO: 43967 - DNA, 30 bp, Homo sapiens; identical to SEQ ID NO: 15815
  misc_feature 1..30: note = chr14:35866882-35866912
  misc_feature 1..30: note = hypo
  source 1..30: mol_type = genomic DNA

SEQ ID NO: 43968 - DNA, 30 bp, Homo sapiens
  misc_feature 1..30: note = chr14:36458365-36458395
  misc_feature 1..30: note = hypo
  source 1..30: mol_type = genomic DNA
ttgtcttagttttggcgagtgttccacact

SEQ ID NO: 43969 - DNA, 20 bp, Homo sapiens
  misc_feature 1..20: note = chr14:40125126-40125146
  misc_feature 1..20: note = hypo
  source 1..20: mol_type = genomic DNA
tcccagtatgagcaacgcag

SEQ ID NO: 43970 - DNA, 23 bp, Homo sapiens
  misc_feature 1..23: note = chr14:40221669-40221692
  misc_feature 1..23: note = hypo
  source 1..23: mol_type = genomic DNA
cgagagtccgtctcaaaaaaaaa

SEQ ID NO: 43971 - DNA, 25 bp, Homo sapiens
  misc_feature 1..25: note = chr14:45382862-45382887
  misc_feature 1..25: note = hypo
  source 1..25: mol_type = genomic DNA
ggtctcgaaacgctagcctccagtt

SEQ ID NO: 43972 - DNA, 27 bp, Homo sapiens
  misc_feature 1..27: note = chr14:48095553-48095580
  misc_feature 1..27: note = hypo
  source 1..27: mol_type = genomic DNA
attcttcttcctgtccgctacactgtg

SEQ ID NO: 43973 - DNA, 30 bp, Homo sapiens
  misc_feature 1..30: note = chr14:48135049-48135079
  misc_feature 1..30: note = hypo
  source 1..30: mol_type = genomic DNA
caccatggactcctgcgttgcctcagcctc

SEQ ID NO: 43974 - DNA, 40 bp, Homo sapiens
  misc_feature 1..40: note = chr14:50098049-50098089
  misc_feature 1..40: note = hypo
  source 1..40: mol_type = genomic DNA
cagaagatttgcagccgggcgcggtggctcatgcctgtaa

SEQ ID NO: 43975 - DNA, 180 bp, Homo sapiens
  misc_feature 1..180: note = chr14:50233117-50233297
  misc_feature 1..180: note = hypo
  source 1..180: mol_type = genomic DNA
gcactcaagcctgggggacaagagcgagacttctctcgaacaaacaaaaaacaaaaacgatgatagaagggtaatgtagctggaaggaggacacagccaggaattgaagctggaaaggcaagctgggtctggaccatgctgggtcttcttgcacagcactgtgatatgaatttttttttt

SEQ ID NO: 43976 - DNA, 144 bp, Homo sapiens
  misc_feature 1..144: note = chr14:50233597-50233741
  misc_feature 1..144: note = hypo
  source 1..144: mol_type = genomic DNA
ccgagatattaattttggattctactaaggacgacgggagccagctcaaggtttttaagtgactcgatcagattcacgaggttggttcacaaggaacttcgataaccccaaagtctagtgagcataattcgactgggagaagac

SEQ ID NO: 43977 - DNA, 30 bp, Homo sapiens
  misc_feature 1..30: note = chr14:50287126-50287156
  misc_feature 1..30: note = hypo
  source 1..30: mol_type = genomic DNA
gtcactgcatgacttcgctgaagttcctta

SEQ ID NO: 43978 - DNA, 120 bp, Homo sapiens
  misc_feature 1..120: note = chr14:50333963-50334083
  misc_feature 1..120: note = hypo
  source 1..120: mol_type = genomic DNA
caggcgtgagccaccgcgcccggccagccgtttgcttttttaacagtgcaaaaaacaaggccgtgtctggctatatggggctttgcttgttcaaaatgtaacctctatacggccgcgcgc

SEQ ID NO: 43979 - DNA, 29 bp, Homo sapiens
  misc_feature 1..29: note = chr14:50434015-50434044
  misc_feature 1..29: note = hypo
  source 1..29: mol_type = genomic DNA
catttatgcataaacgatcacatgacatg

SEQ ID NO: 43980 - DNA, 27 bp, Homo sapiens
  misc_feature 1..27: note = chr14:50681830-50681857
  misc_feature 1..27: note = hypo
  source 1..27: mol_type = genomic DNA
ggcgtgagccaccgcgcccggcaaggt

SEQ ID NO: 43981 - DNA, 54 bp, Homo sapiens
  misc_feature 1..54: note = chr14:50777944-50777998
  misc_feature 1..54: note = hypo
  source 1..54: mol_type = genomic DNA
ttttaaatagcttcccgtggctcttagaataaaagtcaacgtgtggttaaaata

SEQ ID NO: 43982 - DNA, 43 bp, Homo sapiens
  misc_feature 1..43: note = chr14:52226966-52227009
  misc_feature 1..43: note = hypo
  source 1..43: mol_type = genomic DNA
ggtgcctcacccccccgtccatgtggatcgtcatatccagggt

SEQ ID NO: 43983 - DNA, 30 bp, Homo sapiens
  misc_feature 1..30: note = chr14:52321518-52321548
  misc_feature 1..30: note = hypo
  source 1..30: mol_type = genomic DNA
ccgcacccggccggccgtggctctttctta

SEQ ID NO: 43984 - DNA, 15 bp, Homo sapiens
  misc_feature 1..15: note = chr14:54956536-54956551
  misc_feature 1..15: note = hypo
  source 1..15: mol_type = genomic DNA
cgctgggatcacagg

SEQ ID NO: 43985 - DNA, 39 bp, Homo sapiens
  misc_feature 1..39: note = chr14:55517158-55517197
  misc_feature 1..39: note = hypo
  source 1..39: mol_type = genomic DNA
aaaatgtatattggccgggcacagtggctcacgcctgta

SEQ ID NO: 43986 - DNA, 30 bp, Homo sapiens; identical to SEQ ID NO: 15822
  misc_feature 1..30: note = chr14:55664068-55664098
  misc_feature 1..30: note = hypo
  source 1..30: mol_type = genomic DNA

SEQ ID NO: 43987 - DNA, 234 bp, Homo sapiens; identical to SEQ ID NO: 15823
  misc_feature 1..234: note = chr14:55765372-55765606
  misc_feature 1..234: note = hypo
  source 1..234: mol_type = genomic DNA

SEQ ID NO: 43988 - DNA, 30 bp, Homo sapiens
  misc_feature 1..30: note = chr14:56077686-56077716
  misc_feature 1..30: note = hypo
  source 1..30: mol_type = genomic DNA
tttatttagcaatttcggtaggatgttgat

SEQ ID NO: 43989 - DNA, 267 bp, Homo sapiens
  misc_feature 1..267: note = chr14:57045520-57045787
  misc_feature 1..267: note = hypo
  source 1..267: mol_type = genomic DNA
tgctggccccatgaccgtcaaggtaggtatatgttactctatagtttagtcactgtgtctctatcaaattgcgcgtaacacgtttgagattgtcactggttttcagtgtgtctttgagatacattttatgcgggttgctctcctccccgcccactccaggataattgctttaataataaaacataagcttaaaaagcttaactgcgctgttatgtagttgtccttattaacggctccgattctttttttttgcgttacagctcattg

SEQ ID NO: 43990 - DNA, 30 bp, Homo sapiens
  misc_feature 1..30: note = chr14:58410326-58410356
  misc_feature 1..30: note = hypo
  source 1..30: mol_type = genomic DNA
ctcttcaccaatctgcgacttcccaccgcc

SEQ ID NO: 43991 - DNA, 23 bp, Homo sapiens
  misc_feature 1..23: note = chr14:58599589-58599612
  misc_feature 1..23: note = hypo
  source 1..23: mol_type = genomic DNA
actgcgcccggccaacccttgtc

SEQ ID NO: 43992 - DNA, 40 bp, Homo sapiens
  misc_feature 1..40: note = chr14:58893188-58893228
  misc_feature 1..40: note = hypo
  source 1..40: mol_type = genomic DNA
ctgggattacaggcgtgagccaccgcgctcagactttaaa

SEQ ID NO: 43993 - DNA, 88 bp, Homo sapiens
  misc_feature 1..88: note = chr14:64022981-64023069
  misc_feature 1..88: note = hypo
  source 1..88: mol_type = genomic DNA
aaagagaaacagaggcggtgatactggttatactcagaattctccttcaggcctggcctggcacacttggcctccttttgtttgttta

SEQ ID NO: 43994 - DNA, 30 bp, Homo sapiens
  misc_feature 1..30: note = chr14:65086478-65086508
  misc_feature 1..30: note = hypo
  source 1..30: mol_type = genomic DNA
cagcttcttctagagcgaggtgggacttca

SEQ ID NO: 43995 - DNA, 161 bp, Homo sapiens
  misc_feature 1..161: note = chr14:65233318-65233479
  misc_feature 1..161: note = hypo
  source 1..161: mol_type = genomic DNA
ggggaggatggagggcggggctgcgccagctcatctcgcctccacctgggctgagcctagtaggggtgagagggctctggctgcagtgactcccaggaactagacaaacgagaccagagactgaccggggacgttctctcggtggccgcatggtgggaaac

SEQ ID NO: 43996 - DNA, 399 bp, Homo sapiens
  misc_feature 1..399: note = chr14:65239395-65239794
  misc_feature 1..399: note = hypo
  source 1..399: mol_type = genomic DNA
cgcggtgcttctcgtcgatgaggcccaggatctcggcacccgtgtagaagtagcggtgcaggtcataggaggcggccagcagctgcatgcgcgtgtcaatgagctccaggaggtctgcccacatctcgttcagcccgtccttccactcggcgatggtggccgcctcgctgtggcccgcgtcgatgagtcgctcgatgaaggcattcacattgtccacccgctcctgcccaatcgccccggtctcccgggcaaagtcccggaacttgtcccgcagaagctaggcatggggcagacagaaatgtggttatggggggcacaggggttacaggtgtcaccagcttagccaaagactttcccaggcagcaactgcagctccgggagctgcgctgtcacaccttc

SEQ ID NO: 43997 - DNA, 63 bp, Homo sapiens
  misc_feature 1..63: note = chr14:65273132-65273195
  misc_feature 1..63: note = hypo
  source 1..63: mol_type = genomic DNA
tggcctagccaggagcggggtctgcccggtcggagcaggctgtgtgctcgactgagcctcaac

SEQ ID NO: 43998 - DNA, 107 bp, Homo sapiens
  misc_feature 1..107: note = chr14:65406280-65406387
  misc_feature 1..107: note = hypo
  source 1..107: mol_type = genomic DNA
gaagggctctccctccggccctatgaggaacttctcaaagttccaggccacatctgagcggcgcacagggctccaaatgatgagcttgggatcggtcatgagggaaa

SEQ ID NO: 43999 - DNA, 17 bp, Homo sapiens
  misc_feature 1..17: note = chr14:66499286-66499303
  misc_feature 1..17: note = hypo
  source 1..17: mol_type = genomic DNA
accggagctgttcctgt

SEQ ID NO: 44000 - DNA, 41 bp, Homo sapiens
  misc_feature 1..41: note = chr14:66560653-66560694
  misc_feature 1..41: note = hypo
  source 1..41: mol_type = genomic DNA
cacctgcccaggctgcgacagcgtccaggcttgactacaac

SEQ ID NO: 44001 - DNA, 189 bp, Homo sapiens
  misc_feature 1..189: note = chr14:66792112-66792301
  misc_feature 1..189: note = hypo
  source 1..189: mol_type = genomic DNA
atggcactccattcccgaatacagatccagcatctgacagcaatgccagcagcgggaacttccagtgtgggaatgtagatgggagtggtgcaacaggccacctgggcattccagacaatccagatacagtggtactgcccggcagcctcagcacccaccctgaatccacctggccgtgaggcatcacgt

SEQ ID NO: 44002 - DNA, 181 bp, Homo sapiens
  misc_feature 1..181: note = chr14:67688245-67688426
  misc_feature 1..181: note = hypo
  source 1..181: mol_type = genomic DNA
gattacatattattacgtacaataaacttttacggcttttacagattgaatagtccacatgttgcagaaatttaggtaattttattctcatatgttctataatcagcaatggcctaggtttgctaaacgtgtttcattactacccacagagcatttaaagaatgaccggttattttatatc

SEQ ID NO: 44003 - DNA, 30 bp, Homo sapiens
  misc_feature 1..30: note = chr14:67879219-67879249
  misc_feature 1..30: note = hypo
  source 1..30: mol_type = genomic DNA
ggacagtgggtgagccgaaactggtatggg

SEQ ID NO: 44004 - DNA, 83 bp, Homo sapiens; identical to SEQ ID NO: 5152
  misc_feature 1..83: note = chr14:67886562-67886645
  misc_feature 1..83: note = hypo
  source 1..83: mol_type = genomic DNA

SEQ ID NO: 44005 - DNA, 139 bp, Homo sapiens
  misc_feature 1..139: note = chr14:68067690-68067829
  misc_feature 1..139: note = hypo
  source 1..139: mol_type = genomic DNA
actcttttcctgtgccgggtagtttgaggtgcttgaggatgcagcagtgaacgatgttgatgacagtctctgccctcgggcagcttcctttctagtaggagacaatatggaaataagagagtatcgttggcaatactat

SEQ ID NO: 44006 - DNA, 30 bp, Homo sapiens
  misc_feature 1..30: note = chr14:68231335-68231365
  misc_feature 1..30: note = hypo
  source 1..30: mol_type = genomic DNA
aagtgatttgcatggcgacacatgtgagca

SEQ ID NO: 44007 - DNA, 36 bp, Homo sapiens
  misc_feature 1..36: note = chr14:68284131-68284167
  misc_feature 1..36: note = hypo
  source 1..36: mol_type = genomic DNA
gagcaaaggctttttcgcaaacacaataatctgaaa

SEQ ID NO: 44008 - DNA, 30 bp, Homo sapiens
  misc_feature 1..30: note = chr14:69014075-69014105
  misc_feature 1..30: note = hypo
  source 1..30: mol_type = genomic DNA
cctttcacttcctgtcggcacgtacaggcc

SEQ ID NO: 44009 - DNA, 30 bp, Homo sapiens
  misc_feature 1..30: note = chr14:69245934-69245964
  misc_feature 1..30: note = hypo
  source 1..30: mol_type = genomic DNA
agtgccaggcatcagcgttgacatgaaata

SEQ ID NO: 44010 - DNA, 160 bp, Homo sapiens
  misc_feature 1..160: note = chr14:69867036-69867196
  misc_feature 1..160: note = hypo
  source 1..160: mol_type = genomic DNA
acgttttgacattttcgttaatttgattggcaccttgaacagatgttaagcgagggtcccgggaagagggatagatgaaagcactgttcagtgaacatgctgataggtcctttaggtaggcaaaaggaattcacgaagtgcacagcgttcaaagatttag

SEQ ID NO: 44011 - DNA, 132 bp, Homo sapiens
  misc_feature 1..132: note = chr14:70701228-70701360
  misc_feature 1..132: note = hypo
  source 1..132: mol_type = genomic DNA
ctgggaccccaactacgaagccaaagcaggacctcggctggtttggggggccaactgtagctcaggagcctcgttctcaggccagacggtgtgtcacccctcgttctggccgctgtacgaggcagcctcggg

SEQ ID NO: 44012 - DNA, 30 bp, Homo sapiens; identical to SEQ ID NO: 15833
  misc_feature 1..30: note = chr14:72892242-72892272
  misc_feature 1..30: note = hypo
  source 1..30: mol_type = genomic DNA

SEQ ID NO: 44013 - DNA, 30 bp, Homo sapiens
  misc_feature 1..30: note = chr14:72976891-72976921
  misc_feature 1..30: note = hypo
  source 1..30: mol_type = genomic DNA
atggggcttctctttcgatgagatattgaa

SEQ ID NO: 44014 - DNA, 73 bp, Homo sapiens
  misc_feature 1..73: note = chr14:73029715-73029788
  misc_feature 1..73: note = hypo
  source 1..73: mol_type = genomic DNA
caggcactgctttcacgtaaaatgtccaaatcacatcttcagcaagaaagcaacctcacggattgccccgcct

SEQ ID NO: 44015 - DNA, 250 bp, Homo sapiens
  misc_feature 1..250: note = chr14:73140612-73140862
  misc_feature 1..250: note = hypo
  source 1..250: mol_type = genomic DNA
cactacaagaaagcacgttgccttctctccaggtttttccactctacctcgctgtggtccgtaaaaacacgcacaaagaaatatgcacctcatggaaaggccagacacaaacccaaaacttctctttgccctttcccccggatcctagggcataacttttggttcttgagacccaaagaagaaaaatatcagaatgagctgaaaactcctctccactcgaaagcattgccaccatcgcttccctctccag

SEQ ID NO: 44016 - DNA, 30 bp, Homo sapiens
  misc_feature 1..30: note = chr14:73146807-73146837
  misc_feature 1..30: note = hypo
  source 1..30: mol_type = genomic DNA
gagggttaaaagtggcgtgatagagactgt

SEQ ID NO: 44017 - DNA, 221 bp, Homo sapiens
  misc_feature 1..221: note = chr14:73147279-73147500
  misc_feature 1..221: note = hypo
  source 1..221: mol_type = genomic DNA
aagtaaaggggactacgctggagcggatgcggaaggcgctgaggccagggctgctgtcatgagtcctcacatttatggatggggctgataaactgtcacactccgcaccgtcaaggacaaggtgagaagatgagctggaatggcagcacatgccacaggagagctggaaaggcaggtggctaacaacgaaagccatggccagagggcgggcttctctggag

SEQ ID NO: 44018 - DNA, 30 bp, Homo sapiens
  misc_feature 1..30: note = chr14:73150302-73150332
  misc_feature 1..30: note = hypo
  source 1..30: mol_type = genomic DNA
tcagctaaggtcacacgttagtcagtggct

SEQ ID NO: 44019 - DNA, 37 bp, Homo sapiens
  misc_feature 1..37: note = chr14:73157349-73157386
  misc_feature 1..37: note = hypo
  source 1..37: mol_type = genomic DNA
cacgcatagacacacacacacccggctcataatgagg

SEQ ID NO: 44020 - DNA, 149 bp, Homo sapiens; identical to SEQ ID NO: 5153
  misc_feature 1..149: note = chr14:73167750-73167899
  misc_feature 1..149: note = hypo
  source 1..149: mol_type = genomic DNA

SEQ ID NO: 44021 - DNA, 151 bp, Homo sapiens
  misc_feature 1..151: note = chr14:73172944-73173095
  misc_feature 1..151: note = hypo
  source 1..151: mol_type = genomic DNA
tcaattccatccatgcgccctaagggccttcttggcatcccggggctgcactctctgacacagcagcccctcttcgtgtgaccactccctgccctgttccttcagtgctcactgtcccctcaattaaataccgccccggcagtgtgctatc

SEQ ID NO: 44022 - DNA, 92 bp, Homo sapiens
  misc_feature 1..92: note = chr14:73175118-73175210
  misc_feature 1..92: note = hypo
  source 1..92: mol_type = genomic DNA
ctttcctcccctccccgatcctacccccatccaaggacctgcaagacaactgagtgatgagcccagcttcccttccgcgacaaaggcagtga

SEQ ID NO: 44023 - DNA, 30 bp, Homo sapiens
  misc_feature 1..30: note = chr14:73176464-73176494
  misc_feature 1..30: note = hypo
  source 1..30: mol_type = genomic DNA
gcctcagtttcttcacggtaaagtgaggtc

SEQ ID NO: 44024 - DNA, 30 bp, Homo sapiens
  misc_feature 1..30: note = chr14:73178102-73178132
  misc_feature 1..30: note = hypo
  source 1..30: mol_type = genomic DNA
gaaggaataatcaaacgcataagtagaaaa

SEQ ID NO: 44025 - DNA, 117 bp, Homo sapiens
  misc_feature 1..117: note = chr14:73178835-73178952
  misc_feature 1..117: note = hypo
  source 1..117: mol_type = genomic DNA
agccaagaaagcagccgctgagacttccagaaagcctgccgtcaggcctcccaggcactacagggcacacagaaggtgggagagagcctgcggggagggcatcgagagaagcaaacg

SEQ ID NO: 44026 - DNA, 146 bp, Homo sapiens
  misc_feature 1..146: note = chr14:73180113-73180259
  misc_feature 1..146: note = hypo
  source 1..146: mol_type = genomic DNA
gccccacccctaccccgccttgccagctctctccctgccttcagggagactgcagaccctggcgagatgggtgggacacccagagggagacccgtgccagggtccagcctcgactgtttcactgccatcctcgctgcagcctcttc

SEQ ID NO: 44027 - DNA, 37 bp, Homo sapiens
  misc_feature 1..37: note = chr14:73185482-73185519
  misc_feature 1..37: note = hypo
  source 1..37: mol_type = genomic DNA
tttttttttttgagacggagtcactctgtcatgcagg

SEQ ID NO: 44028 - DNA, 146 bp, Homo sapiens
  misc_feature 1..146: note = chr14:73194579-73194725
  misc_feature 1..146: note = hypo
  source 1..146: mol_type = genomic DNA
aagtcaataaaaacacgtaaactcatttgacttatggtcctggctttgtcttctagcacagtagacagcagacccatgcgctgcactcagcagaccttcagtttacataggagatgatggtgacatgatgacgacaatacagcacc

SEQ ID NO: 44029 - DNA, 166 bp, Homo sapiens; identical to SEQ ID NO: 15840
  misc_feature 1..166: note = chr14:73195193-73195359
  misc_feature 1..166: note = hypo
  source 1..166: mol_type = genomic DNA

SEQ ID NO: 44030 - DNA, 79 bp, Homo sapiens
  misc_feature 1..79: note = chr14:73195581-73195660
  misc_feature 1..79: note = hypo
  source 1..79: mol_type = genomic DNA
aaagcagagtggaatcgggaggcaggggcagtcagggcaagggtgtgagatgaagtacggcacggtcagggacatcttt

SEQ ID NO: 44031 - DNA, 30 bp, Homo sapiens
  misc_feature 1..30: note = chr14:73196936-73196966
  misc_feature 1..30: note = hypo
  source 1..30: mol_type = genomic DNA
tgttgaaggcacagtcgacaaggctcctga

SEQ ID NO: 44032 - DNA, 30 bp, Homo sapiens
  misc_feature 1..30: note = chr14:73197190-73197220
  misc_feature 1..30: note = hypo
  source 1..30: mol_type = genomic DNA
attcaatgcctttatcgagactcaactcta

SEQ ID NO: 44033 - DNA, 35 bp, Homo sapiens
  misc_feature 1..35: note = chr14:73198555-73198590
  misc_feature 1..35: note = hypo
  source 1..35: mol_type = genomic DNA
tcttctcaaccccctcgccacggagcaaggcttcc

SEQ ID NO: 44034 - DNA, 152 bp, Homo sapiens
  misc_feature 1..152: note = chr14:73202868-73203020
  misc_feature 1..152: note = hypo
  source 1..152: mol_type = genomic DNA
ataagatattgtatccgatctggtatttctaaaacattaccattcaacatgaaatcaacataaaaatatggacgcaaaattttacattcttttatctgcattgtcttcaaagtctggtgggtattttccatttagagcgtatctcaattcag

SEQ ID NO: 44035 - DNA, 445 bp, Homo sapiens
  misc_feature 1..445: note = chr14:73209603-73210048
  misc_feature 1..445: note = hypo
  source 1..445: mol_type = genomic DNA
agactcaagtccctccgcctggaccacccctttgggagatacccctctgcaggtccctacgacttgcttgttggccagcctgtggccctctctgctttgggacaccttaagccactgtcgtcttcggggtgcatgccctcttgtctgagtttcccccaacgacatgggatgggggcgatcatcctggtcgttcatccccagtcattgaaggactgccaaaaacagaaaaaatacaagagaaagaacactatccctggctgccctccctcccatcaccctcggaattcggcaagggtggcaaagagccaccctgctccccaagagtcctggagcagaagggatcgacaaggcctcaggtgcattccaggtacaggaggagcgtcaactgtaaagcccttttcatctgcgggtccaggataagtgagtgtgtcgggccttcaagcaa

SEQ ID NO: 44036 - DNA, 96 bp, Homo sapiens
  misc_feature 1..96: note = chr14:73226814-73226910
  misc_feature 1..96: note = hypo
  source 1..96: mol_type = genomic DNA
acatgaataattatacgagatgtttttcttattattttaaactcattaaaagatgatcaactatttttaaaaatacaatgatggccgggcgcggtg

SEQ ID NO: 44037 - DNA, 114 bp, Homo sapiens
  misc_feature 1..114: note = chr14:73273305-73273419
  misc_feature 1..114: note = hypo
  source 1..114: mol_type = genomic DNA
cccacccgcactgggcgaaagaacctattcttgcaaccaacactatcctgaaaatgtggaaaacctctaatggaagtgcaaccaagtgctcctggaattcgacatgctttttta

SEQ ID NO: 44038 - DNA, 30 bp, Homo sapiens; identical to SEQ ID NO: 15844
  misc_feature 1..30: note = chr14:73275087-73275117
  misc_feature 1..30: note = hypo
  source 1..30: mol_type = genomic DNA

SEQ ID NO: 44039 - DNA, 30 bp, Homo sapiens
  misc_feature 1..30: note = chr14:73300028-73300058
  misc_feature 1..30: note = hypo
  source 1..30: mol_type = genomic DNA
caacactcaccctgacggggaatccgggag

SEQ ID NO: 44040 - DNA, 32 bp, Homo sapiens; identical to SEQ ID NO: 15845
  misc_feature 1..32: note = chr14:73313912-73313944
  misc_feature 1..32: note = hypo
  source 1..32: mol_type = genomic DNA

SEQ ID NO: 44041 - DNA, 244 bp, Homo sapiens
  misc_feature 1..244: note = chr14:73318385-73318629
  misc_feature 1..244: note = hypo
  source 1..244: mol_type = genomic DNA
cacaaactaacttcccgagggatgagtattttgatgcagatacttcttcaagtgaaaaatgtacaatgtacaaaatgtccactcgaggatctgttcctccccgtgtgggtaatcgccctcctaccacgggcaacgggtaggcaaccgatatgcccagaaaggcggccaatgggaggacagctcgcccagcctcccgattggccaggcccgccaccagctggaaccatggcgagctttgaggaca

SEQ ID NO: 44042 - DNA, 30 bp, Homo sapiens
  misc_feature 1..30: note = chr14:73318945-73318975
  misc_feature 1..30: note = hypo
  source 1..30: mol_type = genomic DNA
tcccctaggagaccacggagtgaaaaaagt

SEQ ID NO: 44043 - DNA, 30 bp, Homo sapiens
  misc_feature 1..30: note = chr14:73331141-73331171
  misc_feature 1..30: note = hypo
  source 1..30: mol_type = genomic DNA
gggactttgttttatcgactgccatatccc

SEQ ID NO: 44044 - DNA, 138 bp, Homo sapiens
  misc_feature 1..138: note = chr14:73333156-73333294
  misc_feature 1..138: note = hypo
  source 1..138: mol_type = genomic DNA
gaacccaagcttattcgaatgcacaggctcaggtacccgcctctgctccatcgataccagccatggagtcttgggcaaatcttgggcaactccttggagttttctcatcgataaaaaagttaatatggctgggtgtgg

SEQ ID NO: 44045 - DNA, 81 bp, Homo sapiens
  misc_feature 1..81: note = chr14:73602385-73602466
  misc_feature 1..81: note = hypo
  source 1..81: mol_type = genomic DNA
ggatttttaaagaaactttagaagaatgtaacttgcccagataccatgtaccgttaatttcattttcggttttttgaatac

SEQ ID NO: 44046 - DNA, 30 bp, Homo sapiens
  misc_feature 1..30: note = chr14:73691528-73691558
  misc_feature 1..30: note = hypo
  source 1..30: mol_type = genomic DNA
tgatgagaatgaggacggactttgagcagg

SEQ ID NO: 44047 - DNA, 30 bp, Homo sapiens; identical to SEQ ID NO: 15848
  misc_feature 1..30: note = chr14:73958845-73958875
  misc_feature 1..30: note = hypo
  source 1..30: mol_type = genomic DNA

SEQ ID NO: 44048 - DNA, 109 bp, Homo sapiens
  misc_feature 1..109: note = chr14:73959120-73959229
  misc_feature 1..109: note = hypo
  source 1..109: mol_type = genomic DNA
cagattctaaggatccgcgaagaaccgctttcatggagaaggtgcgggtcttggttgcccgcctgggacactttgctcctgttgatgctgtggccgaccagcgagccaa

SEQ ID NO: 44049 - DNA, 60 bp, Homo sapiens
  misc_feature 1..60: note = chr14:74717689-74717749
  misc_feature 1..60: note = hypo
  source 1..60: mol_type = genomic DNA
aacacccagcaattccgatttaattggtttaaaatcaaacatcttcggcaggtcacagtg

SEQ ID NO: 44050 - DNA, 38 bp, Homo sapiens
  misc_feature 1..38: note = chr14:75389373-75389411
  misc_feature 1..38: note = hypo
  source 1..38: mol_type = genomic DNA
caaagggatgacagccgtggctgcgggaagggaagggg

SEQ ID NO: 44051 - DNA, 18 bp, Homo sapiens
  misc_feature 1..18: note = chr14:75390699-75390717
  misc_feature 1..18: note = hypo
  source 1..18: mol_type = genomic DNA
gatcgtgtcactgcactc

SEQ ID NO: 44052 - DNA, 30 bp, Homo sapiens
  misc_feature 1..30: note = chr14:75446328-75446358
  misc_feature 1..30: note = hypo
  source 1..30: mol_type = genomic DNA
ggcaagaaggcaagacggattgcatttcag

SEQ ID NO: 44053 - DNA, 18 bp, Homo sapiens
  misc_feature 1..18: note = chr14:75517394-75517412
  misc_feature 1..18: note = hypo
  source 1..18: mol_type = genomic DNA
gcccggccagaaggtcat

SEQ ID NO: 44054 - DNA, 153 bp, Homo sapiens
  misc_feature 1..153: note = chr14:75760140-75760293
  misc_feature 1..153: note = hypo
  source 1..153: mol_type = genomic DNA
taatatagtctggggcgcagaggtctgctcaagatcatccaactggagtggcagcgctggaattagagtccaggcagtgtggcttcaatgcctgaactcttagccattagaaaggaaaaacaaagcaaaatcagtatccgcaacaaccttgca

SEQ ID NO: 44055 - DNA, 30 bp, Homo sapiens
  misc_feature 1..30: note = chr14:76101271-76101301
  misc_feature 1..30: note = hypo
  source 1..30: mol_type = genomic DNA
gaagaattggcctgacgatcgtcattgcag

SEQ ID NO: 44056 - DNA, 172 bp, Homo sapiens
  misc_feature 1..172: note = chr14:76998049-76998221
  misc_feature 1..172: note = hypo
  source 1..172: mol_type = genomic DNA
gtcacaggcatctgccgtacagcacacactaatttctggcgataattatctcttgggtttcccaccctctcctccttgtgtcaccctggctaaatgacacacgcagatttcattgaccagccatgaacctcaccttcatggagaccgacgatgtgatcgggtttccgcttct

SEQ ID NO: 44057 - DNA, 30 bp, Homo sapiens
  misc_feature 1..30: note = chr14:77242483-77242513
  misc_feature 1..30: note = hypo
  source 1..30: mol_type = genomic DNA
ccagagcgtgtcacacgacccgcacagcgt

SEQ ID NO: 44058 - DNA, 30 bp, Homo sapiens
  misc_feature 1..30: note = chr14:78141401-78141431
  misc_feature 1..30: note = hypo
  source 1..30: mol_type = genomic DNA
ataccaaaggtcactcgctttgcttttatg

SEQ ID NO: 44059 - DNA, 34 bp, Homo sapiens
  misc_feature 1..34: note = chr14:78247790-78247824
  misc_feature 1..34: note = hypo
  source 1..34: mol_type = genomic DNA
aaaaataattaggtgcggccgggtgcggtggctc

SEQ ID NO: 44060 - DNA, 30 bp, Homo sapiens
  misc_feature 1..30: note = chr14:79111630-79111660
  misc_feature 1..30: note = hypo
  source 1..30: mol_type = genomic DNA
ctctgaaggatggtgcggtctccttggtca

SEQ ID NO: 44061 - DNA, 30 bp, Homo sapiens
  misc_feature 1..30: note = chr14:81489175-81489205
  misc_feature 1..30: note = hypo
  source 1..30: mol_type = genomic DNA
aaaaaagatgtggggcgtttgggaggtgat

SEQ ID NO: 44062 - DNA, 30 bp, Homo sapiens
  misc_feature 1..30: note = chr14:88673478-88673508
  misc_feature 1..30: note = hypo
  source 1..30: mol_type = genomic DNA
atacaatactagtttcgatttcaaggtcac

SEQ ID NO: 44063 - DNA, 33 bp, Homo sapiens
  misc_feature 1..33: note = chr14:89606032-89606065
  misc_feature 1..33: note = hypo
  source 1..33: mol_type = genomic DNA
ctttaaaagatgactcggcggcttttctttagg

SEQ ID NO: 44064 - DNA, 98 bp, Homo sapiens
  misc_feature 1..98: note = chr14:89657653-89657751
  misc_feature 1..98: note = hypo
  source 1..98: mol_type = genomic DNA
gaacatctgccccagcgcagcgtcccagctgccctggggcgaaattcactaatagtgcggtgatgccgcgtgacagaagctgccgcctgtgccctgtc

SEQ ID NO: 44065 - DNA, 30 bp, Homo sapiens
  misc_feature 1..30: note = chr14:89895234-89895264
  misc_feature 1..30: note = hypo
  source 1..30: mol_type = genomic DNA
aatggcagagctctccggaggctgcccagg

SEQ ID NO: 44066 - DNA, 30 bp, Homo sapiens
  misc_feature 1..30: note = chr14:89918720-89918750
  misc_feature 1..30: note = hypo
  source 1..30: mol_type = genomic DNA
cccatctccccagcacgctggggagggccg

SEQ ID NO: 44067 - DNA, 20 bp, Homo sapiens
  misc_feature 1..20: note = chr14:89962546-89962566
  misc_feature 1..20: note = hypo
  source 1..20: mol_type = genomic DNA
aactccgtctcaaaaaaaga

SEQ ID NO: 44068 - DNA, 30 bp, Homo sapiens
  misc_feature 1..30: note = chr14:90043896-90043926
  misc_feature 1..30: note = hypo
  source 1..30: mol_type = genomic DNA
aaatccatatattcccggggcaatcacggg

SEQ ID NO: 44069 - DNA, 30 bp, Homo sapiens
  misc_feature 1..30: note = chr14:90650692-90650722
  misc_feature 1..30: note = hypo
  source 1..30: mol_type = genomic DNA
gccctccgtgtactacgtcatgctgatcct

SEQ ID NO: 44070 - DNA, 32 bp, Homo sapiens
  misc_feature 1..32: note = chr14:90724207-90724239
  misc_feature 1..32: note = hypo
  source 1..32: mol_type = genomic DNA
acaggcgtgagccaccgcgcccggcctcatag

SEQ ID NO: 44071 - DNA, 30 bp, Homo sapiens; identical to SEQ ID NO: 15852
  misc_feature 1..30: note = chr14:90983280-90983310
  misc_feature 1..30: note = hypo
  source 1..30: mol_type = genomic DNA

SEQ ID NO: 44072 - DNA, 30 bp, Homo sapiens
  misc_feature 1..30: note = chr14:91059804-91059834
  misc_feature 1..30: note = hypo
  source 1..30: mol_type = genomic DNA
gggttgtgggtgaggcggagggtacctgca

SEQ ID NO: 44073 - DNA, 40 bp, Homo sapiens
  misc_feature 1..40: note = chr14:91691266-91691306
  misc_feature 1..40: note = hypo
  source 1..40: mol_type = genomic DNA
gtaaacactggtcttcggtgagcaacgaacactcgcctgg

SEQ ID NO: 44074 - DNA, 114 bp, Homo sapiens
  misc_feature 1..114: note = chr14:91747935-91748049
  misc_feature 1..114: note = hypo
  source 1..114: mol_type = genomic DNA
acctcgcctggcacccggatcccagtagctccagctcttggggatgagggaatggcatgcagatgctgcctttgggacctgcctctcctacccctccaccgtttctcctgctgg

SEQ ID NO: 44075 - DNA, 30 bp, Homo sapiens
  misc_feature 1..30: note = chr14:91754764-91754794
  misc_feature 1..30: note = hypo
  source 1..30: mol_type = genomic DNA
tatatacatggagaacgtgttgagtgcacc

SEQ ID NO: 44076 - DNA, 251 bp, Homo sapiens
  misc_feature 1..251: note = chr14:91766265-91766516
  misc_feature 1..251: note = hypo
  source 1..251: mol_type = genomic DNA
ctcacctgtccagctcgccccgcagcctctggttctcgcccatggcgagggcgtttgtcctctgctcctgctgcagcgcctctcgctcagtggtcaagaccttctcccgctcctccagctccgccttgcgcttcagcatgtcaccgtgcctgttggagggaagcacctgccgtgagtctggccagggccttcttttccgacaggtaactcacatcccagaggatctgcgtgcctcccgtgagaaaatggga

SEQ ID NO: 44077 - DNA, 90 bp, Homo sapiens
  misc_feature 1..90: note = chr14:91849645-91849735
  misc_feature 1..90: note = hypo
  source 1..90: mol_type = genomic DNA
ggctggccatgctgccgtggggggcccagccaggaatctcagggggccatgaacagaacccccaagaaagactgtcgttgtttccaccaa

SEQ ID NO: 44078 - DNA, 30 bp, Homo sapiens
  misc_feature 1..30: note = chr14:91850063-91850093
  misc_feature 1..30: note = hypo
  source 1..30: mol_type = genomic DNA
agacacaaggactcccgcaggtcacaaacc

SEQ ID NO: 44079 - DNA, 30 bp, Homo sapiens
  misc_feature 1..30: note = chr14:92801258-92801288
  misc_feature 1..30: note = hypo
  source 1..30: mol_type = genomic DNA
catcatcatcgtcatcgaggtgaagtccag

SEQ ID NO: 44080 - DNA, 191 bp, Homo sapiens
  misc_feature 1..191: note = chr14:92829024-92829215
  misc_feature 1..191: note = hypo
  source 1..191: mol_type = genomic DNA
gtgatccccccgaggcggcaccagtgtgctgcgtcccaagtctcctgtgtcaccatgcgctcctcctctctgaatgtctacagtgcttttctggtgcctgggcttgtgctgggtcaacacattttgctcaaaaagttttgcagaatgaatgcgcagagagaggcggcagctccgggcgggatcaggcatgc

SEQ ID NO: 44081 - DNA, 30 bp, Homo sapiens
  misc_feature 1..30: note = chr14:93065511-93065541
  misc_feature 1..30: note = hypo
  source 1..30: mol_type = genomic DNA
cctggggaaccccagcgaaggacattaagt

SEQ ID NO: 44082 - DNA, 79 bp, Homo sapiens
  misc_feature 1..79: note = chr14:93151456-93151535
  misc_feature 1..79: note = hypo
  source 1..79: mol_type = genomic DNA
actctcaacaaggcccgggcctcccgctcctccgtacaggtgaggcctgagagcgggaggggcccggtggggccatgtc

SEQ ID NO: 44083 - DNA, 309 bp, Homo sapiens
  misc_feature 1..309: note = chr14:93154937-93155246
  misc_feature 1..309: note = hypo
  source 1..309: mol_type = genomic DNA
cacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaac

SEQ ID NO: 44084 - DNA, 30 bp, Homo sapiens
  misc_feature 1..30: note = chr14:93454054-93454084
  misc_feature 1..30: note = hypo
  source 1..30: mol_type = genomic DNA
tctgtaaagggggaacgctacagctgaggg

SEQ ID NO: 44085 - DNA, 37 bp, Homo sapiens; identical to SEQ ID NO: 15855
  misc_feature 1..37: note = chr14:93697020-93697057
  misc_feature 1..37: note = hypo
  source 1..37: mol_type = genomic DNA

SEQ ID NO: 44086 - DNA, 30 bp, Homo sapiens
  misc_feature 1..30: note = chr14:93706848-93706878
  misc_feature 1..30: note = hypo
  source 1..30: mol_type = genomic DNA
gccctgcatagttttcgagtgagtgtgagt

SEQ ID NO: 44087 - DNA, 30 bp, Homo sapiens
  misc_feature 1..30: note = chr14:95200361-95200391
  misc_feature 1..30: note = hypo
  source 1..30: mol_type = genomic DNA
ctggccttagacccacgacagactcaggga

SEQ ID NO: 44088 - DNA, 55 bp, Homo sapiens
  misc_feature 1..55: note = chr14:95522889-95522944
  misc_feature 1..55: note = hypo
  source 1..55: mol_type = genomic DNA
aaacaatgtgccactcgtcagaccccagcgtacccccctccgccccacccatcag

SEQ ID NO: 44089 - DNA, 30 bp, Homo sapiens
  misc_feature 1..30: note = chr14:95906326-95906356
  misc_feature 1..30: note = hypo
  source 1..30: mol_type = genomic DNA
acaacgatccactgccgcagctccagcagc

SEQ ID NO: 44090 - DNA, 130 bp, Homo sapiens
  misc_feature 1..130: note = chr14:95927934-95928064
  misc_feature 1..130: note = hypo
  source 1..130: mol_type = genomic DNA
aaaatgggttttcctcgttggagcagtggcctgttctagcatggcaagcagtggcaatgggctctcataggtaaaagtaggggcactaacctgaacctagagaccaatcccaccccgaggccaggcctcg

SEQ ID NO: 44091 - DNA, 39 bp, Homo sapiens
  misc_feature 1..39: note = chr14:96967321-96967360
  misc_feature 1..39: note = hypo
  source 1..39: mol_type = genomic DNA
tgcaatatatccaaaatatttcaacgtgcaatcaatata

SEQ ID NO: 44092 - DNA, 30 bp, Homo sapiens
  misc_feature 1..30: note = chr14:97045401-97045431
  misc_feature 1..30: note = hypo
  source 1..30: mol_type = genomic DNA
gtgctcttctgtgtgcgtggaagttcttgc

SEQ ID NO: 44093 - DNA, 109 bp, Homo sapiens
  misc_feature 1..109: note = chr14:97188235-97188344
  misc_feature 1..109: note = hypo
  source 1..109: mol_type = genomic DNA
ttcacaaggagagcacggaagtagatacagcagggtctgtgggctggtggaggctgagccagcctccctctgaccaagtctgtcccgggagctgcggggagcagcaagg

SEQ ID NO: 44094 - DNA, 205 bp, Homo sapiens
  misc_feature 1..205: note = chr14:97262648-97262853
  misc_feature 1..205: note = hypo
  source 1..205: mol_type = genomic DNA
aaagaaaagtaaaatcgacaaataaacccccaaagctatgtaaactcattgagggacctgcgcaagtgaggtcctgaagcttacgcttcattggcttcattgttaatctccctctgcctgtgacttcagtgattttgacctagaacaatgacccagtgcccaataagctctcagcctcatgggtgatggagacttagctgattat

SEQ ID NO: 44095 - DNA, 32 bp, Homo sapiens
  misc_feature 1..32: note = chr14:99532995-99533027
  misc_feature 1..32: note = hypo
  source 1..32: mol_type = genomic DNA
cagagcctggaaacacgcggggcttcccagga

SEQ ID NO: 44096 - DNA, 30 bp, Homo sapiens
  misc_feature 1..30: note = chr14:99615561-99615591
  misc_feature 1..30: note = hypo
  source 1..30: mol_type = genomic DNA
gcccattcggtcaaacgctgccgagagcac

SEQ ID NO: 44097 - DNA, 30 bp, Homo sapiens
  misc_feature 1..30: note = chr14:99626459-99626489
  misc_feature 1..30: note = hypo
  source 1..30: mol_type = genomic DNA
agcatgagagggaggcgggaaaacagacgg

SEQ ID NO: 44098 - DNA, 30 bp, Homo sapiens
  misc_feature 1..30: note = chr14:99804005-99804035
  misc_feature 1..30: note = hypo
  source 1..30: mol_type = genomic DNA
atgtgatctgtgcaacgtatgttttttggg

SEQ ID NO: 44099 - DNA, 30 bp, Homo sapiens
  misc_feature 1..30: note = chr14:99848008-99848038
  misc_feature 1..30: note = hypo
  source 1..30: mol_type = genomic DNA
agccctaggacccttcggctctcacatctg

SEQ ID NO: 44100 - DNA, 154 bp, Homo sapiens
  misc_feature 1..154: note = chr14:99849909-99850063
  misc_feature 1..154: note = hypo
  source 1..154: mol_type = genomic DNA
tgggtggagcacaggcgggaagccctgccccgtctctttgtgagctgtgggtgcgcttggcgagtcacaagcctctctgggcccagttctttctatggaagtcatgggttgcagtgttgttgagggagccggtggtgcacgtggtgaagacctg

SEQ ID NO: 44101 - DNA, 36 bp, Homo sapiens
  misc_feature 1..36: note = chr14:100209839-100209875
  misc_feature 1..36: note = hypo
  source 1..36: mol_type = genomic DNA
ggacaggcccccttccgtgtgcggcctgagagatgc

SEQ ID NO: 44102 - DNA, 38 bp, Homo sapiens
  misc_feature 1..38: note = chr14:100591043-100591081
  misc_feature 1..38: note = hypo
  source 1..38: mol_type = genomic DNA
gacgccaggtgtaagcgtacaggcgtggatggctaaat

SEQ ID NO: 44103 - DNA, 30 bp, Homo sapiens; identical to SEQ ID NO: 15860
  misc_feature 1..30: note = chr14:100611919-100611949
  misc_feature 1..30: note = hypo
  source 1..30: mol_type = genomic DNA

SEQ ID NO: 44104 - DNA, 82 bp, Homo sapiens
  misc_feature 1..82: note = chr14:100637036-100637118
  misc_feature 1..82: note = hypo
  source 1..82: mol_type = genomic DNA
gccaccgcgcccggcccaaaggcattaaaattaactccaccccagtcaacaaccatgaagtattttgcgctgacagctttgg

SEQ ID NO: 44105 - DNA, 196 bp, Homo sapiens
  misc_feature 1..196: note = chr14:100643285-100643481
  misc_feature 1..196: note = hypo
  source 1..196: mol_type = genomic DNA
ggcaccgagtccctacggtgggaccatgcccgcagcggcagtgtggaagatgggacagacacagcgaaatgcctccagggcgtggtgggaggggccggaacagggagatggcgcgtgagtagcatctgttcttacagcaaaacctgtaaaagtaaaatatacgtaggtttgtcactaaagacgtgtctgcataaat

SEQ ID NO: 44106 - DNA, 79 bp, Homo sapiens; identical to SEQ ID NO: 15862
  misc_feature 1..79: note = chr14:100644399-100644478
  misc_feature 1..79: note = hypo
  source 1..79: mol_type = genomic DNA

SEQ ID NO: 44107 - DNA, 27 bp, Homo sapiens
  misc_feature 1..27: note = chr14:100747273-100747300
  misc_feature 1..27: note = hypo
  source 1..27: mol_type = genomic DNA
gaagcctgataatttcgggaggctgag

SEQ ID NO: 44108 - DNA, 35 bp, Homo sapiens
  misc_feature 1..35: note = chr14:100780162-100780197
  misc_feature 1..35: note = hypo
  source 1..35: mol_type = genomic DNA
ggggcagccctgggacgctgcgggggcctggctgt

SEQ ID NO: 44109 - DNA, 19 bp, Homo sapiens
  misc_feature 1..19: note = chr14:100843965-100843984
  misc_feature 1..19: note = hypo
  source 1..19: mol_type = genomic DNA
tttgcgtgtggaagttgtt

SEQ ID NO: 44110 - DNA, 32 bp, Homo sapiens
  misc_feature 1..32: note = chr14:101198835-101198867
  misc_feature 1..32: note = hypo
  source 1..32: mol_type = genomic DNA
aaaagattggagctccgcggggctgaggctgt

SEQ ID NO: 44111 - DNA, 116 bp, Homo sapiens
  misc_feature 1..116: note = chr14:101200602-101200718
  misc_feature 1..116: note = hypo
  source 1..116: mol_type = genomic DNA
cacccccaacccatgcgagaacgacggcgtctgcactgacattgggggcgacttccgctgccggtgcccagccggcttcatcgacaagacctgcagccgcccggtgaccaactgcg

SEQ ID NO: 44112 - DNA, 44 bp, Homo sapiens
  misc_feature 1..44: note = chr14:101201633-101201677
  misc_feature 1..44: note = hypo
  source 1..44: mol_type = genomic DNA
ctgtgcaaagagctacgattgctttcgttcgttaattctcacac

SEQ ID NO: 44113 - DNA, 212 bp, Homo sapiens
  misc_feature 1..212: note = chr14:101250082-101250294
  misc_feature 1..212: note = hypo
  source 1..212: mol_type = genomic DNA
ggggagctggggtggcgacccatgaattagggtccattgacccggaggtcgaggcttccagagcgggccagccggcagccccaacgtgtgaggctgtgcacctgctggggagggtttttttgatggcgacggcgtgaggtgagcgggtttgctctgggcggtcgaggattagcgccgactgagagggtcaggtgcaccggggctttgttcag

SEQ ID NO: 44114 - DNA, 30 bp, Homo sapiens
  misc_feature 1..30: note = chr14:101532280-101532310
  misc_feature 1..30: note = hypo
  source 1..30: mol_type = genomic DNA
cgcttttattaatgacgaatataacacaga

SEQ ID NO: 44115 - DNA, 30 bp, Homo sapiens
  misc_feature 1..30: note = chr14:101532816-101532846
  misc_feature 1..30: note = hypo
  source 1..30: mol_type = genomic DNA
cacacaagacacgagcggcctctcttcagt

SEQ ID NO: 44116 - DNA, 30 bp, Homo sapiens
  misc_feature 1..30: note = chr14:101591942-101591972
  misc_feature 1..30: note = hypo
  source 1..30: mol_type = genomic DNA
tccagccgtgcagaacgacatgcaattgaa

SEQ ID NO: 44117 - DNA, 30 bp, Homo sapiens
  misc_feature 1..30: note = chr14:101694589-101694619
  misc_feature 1..30: note = hypo
  source 1..30: mol_type = genomic DNA
ccgcggggtctgtgccgcctggtggggagc

SEQ ID NO: 44118 - DNA, 152 bp, Homo sapiens
  misc_feature 1..152: note = chr14:101713576-101713728
  misc_feature 1..152: note = hypo
  source 1..152: mol_type = genomic DNA
ctttcctctccacttcgtcctgtggatccaatcatccctgtggaaggacgatgggaaaatctgcctcttggggcctcagatttccagatctaagttccagctgccaagaggacacaacacagggttctcagagccgccgcaccctaatttca

SEQ ID NO: 44119 - DNA, 32 bp, Homo sapiens
  misc_feature 1..32: note = chr14:102094096-102094128
  misc_feature 1..32: note = hypo
  source 1..32: mol_type = genomic DNA
caggccgccctcctacgcgggcctgctgcaac

SEQ ID NO: 44120 - DNA, 30 bp, Homo sapiens
  misc_feature 1..30: note = chr14:102325042-102325072
  misc_feature 1..30: note = hypo
  source 1..30: mol_type = genomic DNA
tatattaagtttacacgtgtggaagatttt

SEQ ID NO: 44121 - DNA, 51 bp, Homo sapiens; identical to SEQ ID NO: 15865
  misc_feature 1..51: note = chr14:102335848-102335899
  misc_feature 1..51: note = hypo
  source 1..51: mol_type = genomic DNA

SEQ ID NO: 44122 - DNA, 105 bp, Homo sapiens
  misc_feature 1..105: note = chr14:102418526-102418631
  misc_feature 1..105: note = hypo
  source 1..105: mol_type = genomic DNA
ggcccaggagttgctcgcatgagccaccacgcccagtgtattcagattttcttcgtgtttcttttctcttccgggatcccatgcaggacaccacgtcgcatttag

SEQ ID NO: 44123 - DNA, 30 bp, Homo sapiens
  misc_feature 1..30: note = chr14:102474565-102474595
  misc_feature 1..30: note = hypo
  source 1..30: mol_type = genomic DNA
tttgacgagttcaaccgcctggaggagcgg

SEQ ID NO: 44124 - DNA, 38 bp, Homo sapiens
  misc_feature 1..38: note = chr14:102493613-102493651
  misc_feature 1..38: note = hypo
  source 1..38: mol_type = genomic DNA
taccagattaaggtgcgtctggtcggtggcctcttaat

SEQ ID NO: 44125 - DNA, 138 bp, Homo sapiens
  misc_feature 1..138: note = chr14:102521620-102521758
  misc_feature 1..138: note = hypo
  source 1..138: mol_type = genomic DNA
cccacccaacagagccgaccaggctgggaacaccgagaccgagagcgcgtggctgtgtctacaaaggcctcctctttgagggagacacgcgaggcacgggtggggcgatgagacaggatcggccggtccttgacagtc

SEQ ID NO: 44126 - DNA, 28 bp, Homo sapiens
  misc_feature 1..28: note = chr14:102529474-102529502
  misc_feature 1..28: note = hypo
  source 1..28: mol_type = genomic DNA
aatagaatggaaacgttagggagtagca

SEQ ID NO: 44127 - DNA, 37 bp, Homo sapiens
  misc_feature 1..37: note = chr14:102530007-102530044
  misc_feature 1..37: note = hypo
  source 1..37: mol_type = genomic DNA
ccacgcctgggggagcggcggccggtagggccgggcg

SEQ ID NO: 44128 - DNA, 51 bp, Homo sapiens
  misc_feature 1..51: note = chr14:102530479-102530530
  misc_feature 1..51: note = hypo
  source 1..51: mol_type = genomic DNA
gctccttctccccagcgtggttcctaagagccttagcgtgagctgagactc

SEQ ID NO: 44129 - DNA, 61 bp, Homo sapiens
  misc_feature 1..61: note = chr14:102673269-102673330
  misc_feature 1..61: note = hypo
  source 1..61: mol_type = genomic DNA
gctgagaaaattgcacgaaggtctaatggaaatcctgccagagcagcgctgggttttaggt

SEQ ID NO: 44130 - DNA, 162 bp, Homo sapiens
  misc_feature 1..162: note = chr14:102682083-102682245
  misc_feature 1..162: note = hypo
  source 1..162: mol_type = genomic DNA
caccaggcccgtcgtcggtgcagagcgcttcctacacagggcagtgggggacgttccatttgggatgagaagaactcatgatttacattgtcttactatgaaataccatccctcactcttgacagacgacgtagctgatctgagcagcgccctggcacccgc

SEQ ID NO: 44131 - DNA, 30 bp, Homo sapiens
  misc_feature 1..30: note = chr14:102909162-102909192
  misc_feature 1..30: note = hypo
  source 1..30: mol_type = genomic DNA
atacagggttgtaggcgacagttggtctgt

SEQ ID NO: 44132 - DNA, 152 bp, Homo sapiens
  misc_feature 1..152: note = chr14:103007088-103007240
  misc_feature 1..152: note = hypo
  source 1..152: mol_type = genomic DNA
tgcctccgggatgagcgcattgggcaacactgcatgctttgcattgggaacatgtttgtgtgtgtgcgttgggggtgtgtgtgcggtggggggctatgggctgggatgtcccttgaggtgatcagctctctacgttccgcacacacaaacac

SEQ ID NO: 44133 - DNA, 37 bp, Homo sapiens
  misc_feature 1..37: note = chr14:103018826-103018863
  misc_feature 1..37: note = hypo
  source 1..37: mol_type = genomic DNA
tgttttgttttgagacgaagtctcactgtcaccaagg

SEQ ID NO: 44134 - DNA, 30 bp, Homo sapiens
  misc_feature 1..30: note = chr14:103144541-103144571
  misc_feature 1..30: note = hypo
  source 1..30: mol_type = genomic DNA
ggagagagagggagacgagagggagaggga

SEQ ID NO: 44135 - DNA, 66 bp, Homo sapiens
  misc_feature 1..66: note = chr14:103216392-103216458
  misc_feature 1..66: note = hypo
  source 1..66: mol_type = genomic DNA
ctgcagccgcagtggcgcctgcatggagggggccccctaatcatggtgcctcggctgtggaatgtt

SEQ ID NO: 44136 - DNA, 177 bp, Homo sapiens
  misc_feature 1..177: note = chr14:103277520-103277697
  misc_feature 1..177: note = hypo
  source 1..177: mol_type = genomic DNA
tccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggc

SEQ ID NO: 44137 - DNA, 30 bp, Homo sapiens
  misc_feature 1..30: note = chr14:103456678-103456708
  misc_feature 1..30: note = hypo
  source 1..30: mol_type = genomic DNA
aaccgcaaacaaacccggaatgcctgcggg

SEQ ID NO: 44138 - DNA, 30 bp, Homo sapiens
  misc_feature 1..30: note = chr14:103477626-103477656
  misc_feature 1..30: note = hypo
  source 1..30: mol_type = genomic DNA
ctaggcaaagccaaccggacccagagccac

SEQ ID NO: 44139 - DNA, 44 bp, Homo sapiens
  misc_feature 1..44: note = chr14:103699549-103699593
  misc_feature 1..44: note = hypo
  source 1..44: mol_type = genomic DNA
cagccaatgccccagcgcccccagcagcccggcccactctctcc

SEQ ID NO: 44140 - DNA, 89 bp, Homo sapiens; identical to SEQ ID NO: 15869
  misc_feature 1..89: note = chr14:103820833-103820922
  misc_feature 1..89: note = hypo
  source 1..89: mol_type = genomic DNA

SEQ ID NO: 44141 - DNA, 30 bp, Homo sapiens; identical to SEQ ID NO: 15870
  misc_feature 1..30: note = chr14:103996414-103996444
  misc_feature 1..30: note = hypo
  source 1..30: mol_type = genomic DNA

SEQ ID NO: 44142 - DNA, 49 bp, Homo sapiens
  misc_feature 1..49: note = chr14:104048933-104048982
  misc_feature 1..49: note = hypo
  source 1..49: mol_type = genomic DNA
acctgcaggagtgtgcgtgatgaaacccgtcactcgttgtgtatggtag

SEQ ID NO: 44143 - DNA, 30 bp, Homo sapiens; identical to SEQ ID NO: 15871
  misc_feature 1..30: note = chr14:104061854-104061884
  misc_feature 1..30: note = hypo
  source 1..30: mol_type = genomic DNA

SEQ ID NO: 44144 - DNA, 30 bp, Homo sapiens
  misc_feature 1..30: note = chr14:104121128-104121158
  misc_feature 1..30: note = hypo
  source 1..30: mol_type = genomic DNA
ggagatgttggagctcggcctgagtgaggc

SEQ ID NO: 44145 - DNA, 55 bp, Homo sapiens
  misc_feature 1..55: note = chr14:104194695-104194750
  misc_feature 1..55: note = hypo
  source 1..55: mol_type = genomic DNA
ctggaatctgaacaacgagcagcgccttctccccactgtccgtccacctctggcc

SEQ ID NO: 44146 - DNA, 30 bp, Homo sapiens
  misc_feature 1..30: note = chr14:104195285-104195315
  misc_feature 1..30: note = hypo
  source 1..30: mol_type = genomic DNA
gaaactatgacttgtcgtctttccaataac

SEQ ID NO: 44147 - DNA, 136 bp, Homo sapiens
  misc_feature 1..136: note = chr14:104202705-104202841
  misc_feature 1..136: note = hypo
  source 1..136: mol_type = genomic DNA
gatacctcccctgcccggcccagctgctgctcctgctgccggccctttctaagtcctgcaggacagacaggacaaacgagctcctgagccccagggcaagagtgtgctgttcttaaggtgacgcttagcaatcaca

SEQ ID NO: 44148 - DNA, 40 bp, Homo sapiens
  misc_feature 1..40: note = chr14:104355130-104355170
  misc_feature 1..40: note = hypo
  source 1..40: mol_type = genomic DNA
gtgtttgatttgacacgccctccccgtcttcttttttttt

SEQ ID NO: 44149 - DNA, 35 bp, Homo sapiens
  misc_feature 1..35: note = chr14:104387085-104387120
  misc_feature 1..35: note = hypo
  source 1..35: mol_type = genomic DNA
cgtgaaccaccgcgcccggccggcccctttcttga

SEQ ID NO: 44150 - DNA, 44 bp, Homo sapiens
  misc_feature 1..44: note = chr14:104572072-104572116
  misc_feature 1..44: note = hypo
  source 1..44: mol_type = genomic DNA
tgtccagaagaagggcgggtgagtgggggcggtgcttgctctgg

SEQ ID NO: 44151 - DNA, 30 bp, Homo sapiens
  misc_feature 1..30: note = chr14:104600477-104600507
  misc_feature 1..30: note = hypo
  source 1..30: mol_type = genomic DNA
cccaggaaaggtccccgccttcataagcat

SEQ ID NO: 44152 - DNA, 30 bp, Homo sapiens
  misc_feature 1..30: note = chr14:104609469-104609499
  misc_feature 1..30: note = hypo
  source 1..30: mol_type = genomic DNA
ttctcatttagctcccgtgcatctcttgct

SEQ ID NO: 44153 - DNA, 611 bp, Homo sapiens
  misc_feature 1..611: note = chr14:104617674-104618285
  misc_feature 1..611: note = hypo
  source 1..611: mol_type = genomic DNA
cagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctgg

SEQ ID NO: 44154 - DNA, 139 bp, Homo sapiens
  misc_feature 1..139: note = chr14:104618691-104618830
  misc_feature 1..139: note = hypo
  source 1..139: mol_type = genomic DNA
cgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgct

SEQ ID NO: 44155 - DNA, 242 bp, Homo sapiens
  misc_feature 1..242: note = chr14:104619085-104619327
  misc_feature 1..242: note = hypo
  source 1..242: mol_type = genomic DNA
cagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctgg

SEQ ID NO: 44156 - DNA, 193 bp, Homo sapiens
  misc_feature 1..193: note = chr14:104620411-104620604
  misc_feature 1..193: note = hypo
  source 1..193: mol_type = genomic DNA
cctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacgggggtgctgcagc

SEQ ID NO: 44157 - DNA, 314 bp, Homo sapiens
  misc_feature 1..314: note = chr14:104622939-104623253
  misc_feature 1..314: note = hypo
  source 1..314: mol_type = genomic DNA
ttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctggg

SEQ ID NO: 44158 - DNA, 264 bp, Homo sapiens
  misc_feature 1..264: note = chr14:104623478-104623742
  misc_feature 1..264: note = hypo
  source 1..264: mol_type = genomic DNA
tttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtg

SEQ ID NO: 44159 - DNA, 216 bp, Homo sapiens
  misc_feature 1..216: note = chr14:104626773-104626989
  misc_feature 1..216: note = hypo
  source 1..216: mol_type = genomic DNA
cgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtga

SEQ ID NO: 44160 - DNA, 171 bp, Homo sapiens
  misc_feature 1..171: note = chr14:104627664-104627835
  misc_feature 1..171: note = hypo
  source 1..171: mol_type = genomic DNA
tccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctct

SEQ ID NO: 44161 - DNA, 78 bp, Homo sapiens
  misc_feature 1..78: note = chr14:104628609-104628687
  misc_feature 1..78: note = hypo
  source 1..78: mol_type = genomic DNA
ggtggagatgtggggcgaacaaccttccagacttccagggctgatggaaccacagaggacgcccggtcccagcctctg

SEQ ID NO: 44162 - DNA, 140 bp, Homo sapiens
  misc_feature 1..140: note = chr14:104630035-104630175
  misc_feature 1..140: note = hypo
  source 1..140: mol_type = genomic DNA
atgcgcggcacggggcggccatgggccccgacccctgctctgactcacacctgcatcctggggcccaggcccgtgtgcctgagacccctggacctcacccggcatcgccagcatttacccaataccgtgccagctgtggg

SEQ ID NO: 44163 - DNA, 45 bp, Homo sapiens
  misc_feature 1..45: note = chr14:104630962-104631007
  misc_feature 1..45: note = hypo
  source 1..45: mol_type = genomic DNA
gccagggctcagaggcgcggcgggcctgtactctgtgtgtgtgcc

SEQ ID NO: 44164 - DNA, 49 bp, Homo sapiens
  misc_feature 1..49: note = chr14:104637029-104637078
  misc_feature 1..49: note = hypo
  source 1..49: mol_type = genomic DNA
ctgccgggtcagagccgccgcctcctggcatcgacgcaccagacccacc

SEQ ID NO: 44165 - DNA, 33 bp, Homo sapiens
  misc_feature 1..33: note = chr14:104638185-104638218
  misc_feature 1..33: note = hypo
  source 1..33: mol_type = genomic DNA
ggcagcgcaggcccccggcgagccgccactgct

SEQ ID NO: 44166 - DNA, 752 bp, Homo sapiens
  misc_feature 1..752: note = chr14:104639103-104639855
  misc_feature 1..752: note = hypo
  source 1..752: mol_type = genomic DNA
gtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtagg

SEQ ID NO: 44167 - DNA, 30 bp, Homo sapiens
  misc_feature 1..30: note = chr14:104640459-104640489
  misc_feature 1..30: note = hypo
  source 1..30: mol_type = genomic DNA
gcatctgaaccgcctcgacccgcagggacc

SEQ ID NO: 44168 - DNA, 427 bp, Homo sapiens
  misc_feature 1..427: note = chr14:104641348-104641775
  misc_feature 1..427: note = hypo
  source 1..427: mol_type = genomic DNA
tcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctg

SEQ ID NO: 44169 - DNA, 30 bp, Homo sapiens
  misc_feature 1..30: note = chr14:104642691-104642721
  misc_feature 1..30: note = hypo
  source 1..30: mol_type = genomic DNA
cagggagccccaggccgggccctcgcggtg

SEQ ID NO: 44170 - DNA, 390 bp, Homo sapiens
  misc_feature 1..390: note = chr14:104643013-104643403
  misc_feature 1..390: note = hypo
  source 1..390: mol_type = genomic DNA
ccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggta

SEQ ID NO: 44171 - DNA, 489 bp, Homo sapiens
  misc_feature 1..489: note = chr14:104643693-104644182
  misc_feature 1..489: note = hypo
  source 1..489: mol_type = genomic DNA
gggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgc

SEQ ID NO: 44172 - DNA, 382 bp, Homo sapiens
  misc_feature 1..382: note = chr14:104645126-104645508
  misc_feature 1..382: note = hypo
  source 1..382: mol_type = genomic DNA
tggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcag

SEQ ID NO: 44173 - DNA, 400 bp, Homo sapiens
  misc_feature 1..400: note = chr14:104645716-104646116
  misc_feature 1..400: note = hypo
  source 1..400: mol_type = genomic DNA
gagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggagg

SEQ ID NO: 44174 - DNA, 359 bp, Homo sapiens
  misc_feature 1..359: note = chr14:104646327-104646686
  misc_feature 1..359: note = hypo
  source 1..359: mol_type = genomic DNA
aagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggct

SEQ ID NO: 44175 - DNA, 207 bp, Homo sapiens
  misc_feature 1..207: note = chr14:104647208-104647415
  misc_feature 1..207: note = hypo
  source 1..207: mol_type = genomic DNA
gaattaaagatgcatcgatggttcccacggctgccgagttcactgggcgtcggcagactcctcacgccctggtgtgccgccctctgagggtccctggggtgacgggcagtaagcgtgggaaggacacatccacggggacccagggcttcgggtgctgtgccagggcctgccttgcagcccctgtggggcccacggtgccatgagggc

SEQ ID NO: 44176 - DNA, 30 bp, Homo sapiens
  misc_feature 1..30: note = chr14:104647924-104647954
  misc_feature 1..30: note = hypo
  source 1..30: mol_type = genomic DNA
gcctcctggcctcttcggagtcctatctgc

SEQ ID NO: 44177 - DNA, 54 bp, Homo sapiens
  misc_feature 1..54: note = chr14:104648777-104648831
  misc_feature 1..54: note = hypo
  source 1..54: mol_type = genomic DNA
gggcagggttgttcccgagaagccgagggccacgcatgccggctctgtgctggg

SEQ ID NO: 44178 - DNA, 30 bp, Homo sapiens
  misc_feature 1..30: note = chr14:104682616-104682646
  misc_feature 1..30: note = hypo
  source 1..30: mol_type = genomic DNA
acatcgggcatcgggcgggggcactcggct

SEQ ID NO: 44179 - DNA, 160 bp, Homo sapiens
  misc_feature 1..160: note = chr14:104705230-104705390
  misc_feature 1..160: note = hypo
  source 1..160: mol_type = genomic DNA
ggaggagccaggctacgcctgccctcaggcccccgagagtgtggaggcccctggccatgcaccggaggagcctctgatggatgcttcataagagtggtgcccacactgcagccacctccgctgccagggacccctccggtgaacacgttggctcctcctc

SEQ ID NO: 44180 - DNA, 30 bp, Homo sapiens
  misc_feature 1..30: note = chr14:104768222-104768252
  misc_feature 1..30: note = hypo
  source 1..30: mol_type = genomic DNA
cctttccagggcaaccgatgtctcagagtc

SEQ ID NO: 44181 - DNA, 30 bp, Homo sapiens
  misc_feature 1..30: note = chr14:104798505-104798535
  misc_feature 1..30: note = hypo
  source 1..30: mol_type = genomic DNA
gagacacaaggcagccgtgcagcacagaga

SEQ ID NO: 44182 - DNA, 38 bp, Homo sapiens
  misc_feature 1..38: note = chr14:104800605-104800643
  misc_feature 1..38: note = hypo
  source 1..38: mol_type = genomic DNA
gggccggggaggcaccgggtggccgtgcctgtcagggc

SEQ ID NO: 44183 - DNA, 37 bp, Homo sapiens
  misc_feature 1..37: note = chr14:104801369-104801406
  misc_feature 1..37: note = hypo
  source 1..37: mol_type = genomic DNA
gtcaggtggctccctcggccctcggcaccctccctgc

SEQ ID NO: 44184 - DNA, 30 bp, Homo sapiens
  misc_feature 1..30: note = chr14:104820337-104820367
  misc_feature 1..30: note = hypo
  source 1..30: mol_type = genomic DNA
ggaagcgtgcagaggcgcagcagagcctgg

SEQ ID NO: 44185 - DNA, 174 bp, Homo sapiens
  misc_feature 1..174: note = chr14:104842214-104842388
  misc_feature 1..174: note = hypo
  source 1..174: mol_type = genomic DNA
agcagatgcacagcccgtatagatgcccaggacttgcttcatttgtgttaattaccttcttttgattttcctgatcaataaattatcccgacgtaattggattatttgcatggctggcaagaggtcgctgtgatttagcgcctggcatcctggcagctgcgtggggtcccattc

SEQ ID NO: 44186 - DNA, 103 bp, Homo sapiens
  misc_feature 1..103: note = chr14:104897622-104897725
  misc_feature 1..103: note = hypo
  source 1..103: mol_type = genomic DNA
gttcattcatctcactgcggaggcagcaccatatccattcactaattccactgcggtggcagcaccctatccattcatcgtcccactgcgggctcatctgggt

SEQ ID NO: 44187 - DNA, 54 bp, Homo sapiens
  misc_feature 1..54: note = chr14:104899461-104899515
  misc_feature 1..54: note = hypo
  source 1..54: mol_type = genomic DNA
caggcgctgatgcttcggtttccgtggttgccccggccccgttgtttgagggcc

SEQ ID NO: 44188 - DNA, 38 bp, Homo sapiens
  misc_feature 1..38: note = chr14:105026775-105026813
  misc_feature 1..38: note = hypo
  source 1..38: mol_type = genomic DNA
acacacccatatacacgcacatgcgtgcattgcacaca

SEQ ID NO: 44189 - DNA, 119 bp, Homo sapiens
  misc_feature 1..119: note = chr14:105174275-105174394
  misc_feature 1..119: note = hypo
  source 1..119: mol_type = genomic DNA
aacccacccacactgcgcatgaagaagctgaactggcagaagctgccatccaacgtggcacgtggtgagggtccccagacccccaagggaagcttcccctaggacgggggctggtctct

SEQ ID NO: 44190 - DNA, 30 bp, Homo sapiens
  misc_feature 1..30: note = chr14:105194964-105194994
  misc_feature 1..30: note = hypo
  source 1..30: mol_type = genomic DNA
gccgggcacagtcgtcgtacaaactgccat

SEQ ID NO: 44191 - DNA, 18 bp, Homo sapiens
  misc_feature 1..18: note = chr14:105195822-105195840
  misc_feature 1..18: note = hypo
  source 1..18: mol_type = genomic DNA
ggagggaggaggtagcgt

SEQ ID NO: 44192 - DNA, 196 bp, Homo sapiens
  misc_feature 1..196: note = chr14:105196366-105196562
  misc_feature 1..196: note = hypo
  source 1..196: mol_type = genomic DNA
actgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggtgggtgcggtg

SEQ ID NO: 44193 - DNA, 92 bp, Homo sapiens
  misc_feature 1..92: note = chr14:105241003-105241095
  misc_feature 1..92: note = hypo
  source 1..92: mol_type = genomic DNA
ggcctcctggagcctcggcagagtgcaaggaagaccagggccacctgccccacccacctgcccgcacacgggagcagcgagcacagccccta

SEQ ID NO: 44194 - DNA, 30 bp, Homo sapiens
  misc_feature 1..30: note = chr14:105254641-105254671
  misc_feature 1..30: note = hypo
  source 1..30: mol_type = genomic DNA
tgaggggagagtctgcgggctccctccctc

SEQ ID NO: 44195 - DNA, 35 bp, Homo sapiens
  misc_feature 1..35: note = chr14:105268737-105268772
  misc_feature 1..35: note = hypo
  source 1..35: mol_type = genomic DNA
tccggggacctctaccgccacgtccgcaagtttca

SEQ ID NO: 44196 - DNA, 30 bp, Homo sapiens
  misc_feature 1..30: note = chr14:105538919-105538949
  misc_feature 1..30: note = hypo
  source 1..30: mol_type = genomic DNA
ggagcttggcagagccgtgactccaggagg

SEQ ID NO: 44197 - DNA, 30 bp, Homo sapiens
  misc_feature 1..30: note = chr14:105590655-105590685
  misc_feature 1..30: note = hypo
  source 1..30: mol_type = genomic DNA
atgaggccatcaccacgttcgagcccagtc

SEQ ID NO: 44198 - DNA, 62 bp, Homo sapiens; identical to SEQ ID NO: 15887
  misc_feature 1..62: note = chr14:105658349-105658411
  misc_feature 1..62: note = hypo
  source 1..62: mol_type = genomic DNA

SEQ ID NO: 44199 - DNA, 186 bp, Homo sapiens; identical to SEQ ID NO: 35579
  misc_feature 1..186: note = chr14:105714232-105714418
  misc_feature 1..186: note = hypo
  source 1..186: mol_type = genomic DNA

SEQ ID NO: 44200 - DNA, 30 bp, Homo sapiens
  misc_feature 1..30: note = chr14:105739229-105739259
  misc_feature 1..30: note = hypo
  source 1..30: mol_type = genomic DNA
ccctaggacacagcacgaggcagctcttag

SEQ ID NO: 44201 - DNA, 30 bp, Homo sapiens
  misc_feature 1..30: note = chr14:105739632-105739662
  misc_feature 1..30: note = hypo
  source 1..30: mol_type = genomic DNA
accgccttccccaaccgcacagagtctggg

SEQ ID NO: 44202 - DNA, 30 bp, Homo sapiens
  misc_feature 1..30: note = chr14:106334145-106334175
  misc_feature 1..30: note = hypo
  source 1..30: mol_type = genomic DNA
tgccgcaggtctccacgccttccaggccta

SEQ ID NO: 44203 - DNA, 29 bp, Homo sapiens
  misc_feature 1..29: note = chr15:20499470-20499499
  misc_feature 1..29: note = hypo
  source 1..29: mol_type = genomic DNA
ttaggagaaacaggccgagcgcgctgact

SEQ ID NO: 44204 - DNA, 35 bp, Homo sapiens
  misc_feature 1..35: note = chr15:22515501-22515536
  misc_feature 1..35: note = hypo
  source 1..35: mol_type = genomic DNA
gtctggcagcatgggcgtcacgctgcctgccgggc

SEQ ID NO: 44205 - DNA, 30 bp, Homo sapiens
  misc_feature 1..30: note = chr15:22876959-22876989
  misc_feature 1..30: note = hypo
  source 1..30: mol_type = genomic DNA
aggaatttttaaatgcgtccacgcagagat

SEQ ID NO: 44206 - DNA, 128 bp, Homo sapiens
  misc_feature 1..128: note = chr15:22977063-22977191
  misc_feature 1..128: note = hypo
  source 1..128: mol_type = genomic DNA
gggcgtgccctaatacgattatagtcaattggaggaaaggatgcttgttggaaggatgtgcagggcaaagtctgggaggtttccatgtgcaaagctttccctgtcctcagggacgcatcaccctccga

SEQ ID NO: 44207 - DNA, 19 bp, Homo sapiens
  misc_feature 1..19: note = chr15:23087577-23087596
  misc_feature 1..19: note = hypo
  source 1..19: mol_type = genomic DNA
tttgagacagagtctcgct

SEQ ID NO: 44208 - DNA, 30 bp, Homo sapiens
  misc_feature 1..30: note = chr15:23182596-23182626
  misc_feature 1..30: note = hypo
  source 1..30: mol_type = genomic DNA
ccagctcagccctgtcgtcatggaactcat

SEQ ID NO: 44209 - DNA, 107 bp, Homo sapiens
  misc_feature 1..107: note = chr15:23662038-23662145
  misc_feature 1..107: note = hypo
  source 1..107: mol_type = genomic DNA
tgccagtgagagctccgcgaggcctggcccgagatgtggctggcgtgaggggtcccggacctgctgtggtggggacgcacccagttctgtggcgcttggtccagcga

SEQ ID NO: 44210 - DNA, 30 bp, Homo sapiens
  misc_feature 1..30: note = chr15:25449793-25449823
  misc_feature 1..30: note = hypo
  source 1..30: mol_type = genomic DNA
ttgtccctgagtacccgttctcccctgtgt

SEQ ID NO: 44211 - DNA, 30 bp, Homo sapiens
  misc_feature 1..30: note = chr15:26869355-26869385
  misc_feature 1..30: note = hypo
  source 1..30: mol_type = genomic DNA
tttcgctggtgtgggcggtgcgctggaact

SEQ ID NO: 44212 - DNA, 66 bp, Homo sapiens
  misc_feature 1..66: note = chr15:28389827-28389893
  misc_feature 1..66: note = hypo
  source 1..66: mol_type = genomic DNA
gcatgatgggatagacggtgaagcgccagccccagccattcacagacccatcgctgatgaacttcc

SEQ ID NO: 44213 - DNA, 122 bp, Homo sapiens
  misc_feature 1..122: note = chr15:28517076-28517198
  misc_feature 1..122: note = hypo
  source 1..122: mol_type = genomic DNA
accaacaaagcaggccgctattttcgttgttcttttctggtatttatttaaaagtgaatgtttcaagcttggttttgtgctgacaaggaagtcagtgctcactgatccgagtcttctccaca

SEQ ID NO: 44214 - DNA, 30 bp, Homo sapiens
  misc_feature 1..30: note = chr15:29087614-29087644
  misc_feature 1..30: note = hypo
  source 1..30: mol_type = genomic DNA
gcaccgctcctcctgcgtcttctcctgctc

SEQ ID NO: 44215 - DNA, 48 bp, Homo sapiens
  misc_feature 1..48: note = chr15:29112193-29112241
  misc_feature 1..48: note = hypo
  source 1..48: mol_type = genomic DNA
tatgccatcccactccggaatatgctctgtattcgttacctatagctg

SEQ ID NO: 44216 - DNA, 297 bp, Homo sapiens
  misc_feature 1..297: note = chr15:29133536-29133833
  misc_feature 1..297: note = hypo
  source 1..297: mol_type = genomic DNA
tttgtttggattgggcggcggtggctgtggtgagggctgttggagtggggagagtgggggttgagcctggcttcagagaccccctcgaggcctcagctcctctccggcgctcctggctgtcctctgccacgcatacctgccccggtgactcaacaggtgtgggcctcaggtgacaccatggtccgaagtcgtggagaaacctttactgtccaggggaggagaggactggcggtcggtggggatcgagacccagcacacatcactgggtggctcgaatgtcttcggcagagatcacat

SEQ ID NO: 44217 - DNA, 158 bp, Homo sapiens
  misc_feature 1..158: note = chr15:29145324-29145482
  misc_feature 1..158: note = hypo
  source 1..158: mol_type = genomic DNA
cttcccagcctcctccgcctggactcaggcttcttcgggctcatcagacctgaacagcctggcagtgtggctgtgtgggaatgggtgacaggtgctgttctccccagtgcaaatcaccaatgctgggcaccgtgcatcagcgtcgtggtgacggcagc

SEQ ID NO: 44218 - DNA, 30 bp, Homo sapiens
  misc_feature 1..30: note = chr15:29221674-29221704
  misc_feature 1..30: note = hypo
  source 1..30: mol_type = genomic DNA
gggtgtagcacttcccgcctatcactggga

SEQ ID NO: 44219 - DNA, 30 bp, Homo sapiens
  misc_feature 1..30: note = chr15:29397531-29397561
  misc_feature 1..30: note = hypo
  source 1..30: mol_type = genomic DNA
ggggagcctgtgccacgtgcctgtctccag

SEQ ID NO: 44220 - DNA, 34 bp, Homo sapiens
  misc_feature 1..34: note = chr15:29409363-29409397
  misc_feature 1..34: note = hypo
  source 1..34: mol_type = genomic DNA
gacaccgggcagggccgcccgggcccagaggagc

SEQ ID NO: 44221 - DNA, 30 bp, Homo sapiens; identical to SEQ ID NO: 15892
  misc_feature 1..30: note = chr15:29449033-29449063
  misc_feature 1..30: note = hypo
  source 1..30: mol_type = genomic DNA

SEQ ID NO: 44222 - DNA, 153 bp, Homo sapiens
  misc_feature 1..153: note = chr15:29721877-29722030
  misc_feature 1..153: note = hypo
  source 1..153: mol_type = genomic DNA
tagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctcc

SEQ ID NO: 44223 - DNA, 30 bp, Homo sapiens
  misc_feature 1..30: note = chr15:31083776-31083806
  misc_feature 1..30: note = hypo
  source 1..30: mol_type = genomic DNA
atagcagaagaaactcgacagagcaaattg

SEQ ID NO: 44224 - DNA, 30 bp, Homo sapiens
  misc_feature 1..30: note = chr15:31121996-31122026
  misc_feature 1..30: note = hypo
  source 1..30: mol_type = genomic DNA
tctcagtgatgttctcggttagaagtaatg

SEQ ID NO: 44225 - DNA, 30 bp, Homo sapiens
  misc_feature 1..30: note = chr15:31221190-31221220
  misc_feature 1..30: note = hypo
  source 1..30: mol_type = genomic DNA
gtccacccagctaagcgaaaagctgttttt

SEQ ID NO: 44226 - DNA, 167 bp, Homo sapiens
  misc_feature 1..167: note = chr15:31377678-31377845
  misc_feature 1..167: note = hypo
  source 1..167: mol_type = genomic DNA
ttttgtcaacattgtcggggctttactgtgaaaatgtgagcacacgcccaattgtttttagagttgtcattgcagttgtcattacatgatttatagtccaatcgcatgtgttgatgtcctaattcaaggtggtgctggtcagataccaggaacgcttgtcgcttttg

SEQ ID NO: 44227 - DNA, 30 bp, Homo sapiens
  misc_feature 1..30: note = chr15:31509535-31509565
  misc_feature 1..30: note = hypo
  source 1..30: mol_type = genomic DNA
tcataaggttaacaacgaggcctcccactt

SEQ ID NO: 44228 - DNA, 30 bp, Homo sapiens
  misc_feature 1..30: note = chr15:31539632-31539662
  misc_feature 1..30: note = hypo
  source 1..30: mol_type = genomic DNA
agcaaatgctgccttcgtatctaccctctg

SEQ ID NO: 44229 - DNA, 56 bp, Homo sapiens
  misc_feature 1..56: note = chr15:31603992-31604048
  misc_feature 1..56: note = hypo
  source 1..56: mol_type = genomic DNA
ccatgagaggcaggacgatgctccccactttaggatgagggcgccaggcatttggg

SEQ ID NO: 44230 - DNA, 30 bp, Homo sapiens
  misc_feature 1..30: note = chr15:31813319-31813349
  misc_feature 1..30: note = hypo
  source 1..30: mol_type = genomic DNA
gaagctatgacaggccggagggttcgcggg

SEQ ID NO: 44231 - DNA, 30 bp, Homo sapiens
  misc_feature 1..30: note = chr15:33438087-33438117
  misc_feature 1..30: note = hypo
  source 1..30: mol_type = genomic DNA
aactaaagacttgaacgttttagaaaaaat

SEQ ID NO: 44232 - DNA, 27 bp, Homo sapiens
  misc_feature 1..27: note = chr15:33541634-33541661
  misc_feature 1..27: note = hypo
  source 1..27: mol_type = genomic DNA
gcctcagcctcccgtaaaggtttttaa

SEQ ID NO: 44233 - DNA, 43 bp, Homo sapiens; identical to SEQ ID NO: 15893
  misc_feature 1..43: note = chr15:33632093-33632136
  misc_feature 1..43: note = hypo
  source 1..43: mol_type = genomic DNA

SEQ ID NO: 44234 - DNA, 17 bp, Homo sapiens
  misc_feature 1..17: note = chr15:33633532-33633549
  misc_feature 1..17: note = hypo
  source 1..17: mol_type = genomic DNA
cccggtctgattcagtg

SEQ ID NO: 44235 - DNA, 30 bp, Homo sapiens
  misc_feature 1..30: note = chr15:33727786-33727816
  misc_feature 1..30: note = hypo
  source 1..30: mol_type = genomic DNA
ctccatattgtgtctcgcatttattccttc

SEQ ID NO: 44236 - DNA, 30 bp, Homo sapiens
  misc_feature 1..30: note = chr15:33746640-33746670
  misc_feature 1..30: note = hypo
  source 1..30: mol_type = genomic DNA
aagaccctggccaagcgaaactccatccat

SEQ ID NO: 44237 - DNA, 155 bp, Homo sapiens
  misc_feature 1..155: note = chr15:33954397-33954552
  misc_feature 1..155: note = hypo
  source 1..155: mol_type = genomic DNA
ggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctat

SEQ ID NO: 44238 - DNA, 36 bp, Homo sapiens
  misc_feature 1..36: note = chr15:34879893-34879929
  misc_feature 1..36: note = hypo
  source 1..36: mol_type = genomic DNA
ggcatgagccaccgcatccggcgtgagtgcattctt

SEQ ID NO: 44239 - DNA, 163 bp, Homo sapiens
  misc_feature 1..163: note = chr15:38218484-38218647
  misc_feature 1..163: note = hypo
  source 1..163: mol_type = genomic DNA
ggaacttaaacaacacgctcctaaacaaacaataggtcgcagaacaaataaaaaatgaaatcaatattaccttgagacaaactaaactggaaacacaacataccaaaacatttgagatggagcaaaagcatttctaagagagaaatttatggtgataaacatc

SEQ ID NO: 44240 - DNA, 30 bp, Homo sapiens; identical to SEQ ID NO: 15894
  misc_feature 1..30: note = chr15:40228636-40228666
  misc_feature 1..30: note = hypo
  source 1..30: mol_type = genomic DNA

SEQ ID NO: 44241 - DNA, 39 bp, Homo sapiens
  misc_feature 1..39: note = chr15:40368182-40368221
  misc_feature 1..39: note = hypo
  source 1..39: mol_type = genomic DNA
tcagcctcagagctgcggtcagtgcgtggagccggctac

SEQ ID NO: 44242 - DNA, 92 bp, Homo sapiens
  misc_feature 1..92: note = chr15:40423336-40423428
  misc_feature 1..92: note = hypo
  source 1..92: mol_type = genomic DNA
ccaggcggggagaagacgatattaatcccaatattgcagaaggtgtagacctcccctgatattcaggggaaagagcacgatattgctcccaa

SEQ ID NO: 44243 - DNA, 75 bp, Homo sapiens
  misc_feature 1..75: note = chr15:40532146-40532221
  misc_feature 1..75: note = hypo
  source 1..75: mol_type = genomic DNA
ctgatgctgggtgggcgcaggccctgagatgggcgtcagggagaggggacgccagacacacggcctgagcagggt

SEQ ID NO: 44244 - DNA, 30 bp, Homo sapiens
  misc_feature 1..30: note = chr15:40532791-40532821
  misc_feature 1..30: note = hypo
  source 1..30: mol_type = genomic DNA
gcctgaagggagtgccgcttcctgggctag

SEQ ID NO: 44245 - DNA, 56 bp, Homo sapiens
  misc_feature 1..56: note = chr15:40545776-40545832
  misc_feature 1..56: note = hypo
  source 1..56: mol_type = genomic DNA
gggtgagggtgtcaccgcggcagagtgcagggaattcatgccggggaagaggttcc

SEQ ID NO: 44246 - DNA, 30 bp, Homo sapiens
  misc_feature 1..30: note = chr15:40546043-40546073
  misc_feature 1..30: note = hypo
  source 1..30: mol_type = genomic DNA
ccagggtgtaggttgcgttttctgtatctt

SEQ ID NO: 44247 - DNA, 300 bp, Homo sapiens; identical to SEQ ID NO: 15895
  misc_feature 1..300: note = chr15:41165245-41165545
  misc_feature 1..300: note = hypo
  source 1..300: mol_type = genomic DNA

SEQ ID NO: 44248 - DNA, 30 bp, Homo sapiens
  misc_feature 1..30: note = chr15:41291830-41291860
  misc_feature 1..30: note = hypo
  source 1..30: mol_type = genomic DNA
atttaattcataaaacgccatctttatgat

SEQ ID NO: 44249 - DNA, 141 bp, Homo sapiens
  misc_feature 1..141: note = chr15:41835678-41835819
  misc_feature 1..141: note = hypo
  source 1..141: mol_type = genomic DNA
gggattacaggcgtgagccaccgtgcgcggcctctatgctgtcttaagtcccatttccacaactgtaaaatgtgagtaacaggtcctatataataggaaatgtgtgaggatttaaatgactatacacgcaaaacgcctagc

SEQ ID NO: 44250 - DNA, 30 bp, Homo sapiens
  misc_feature 1..30: note = chr15:41878349-41878379
  misc_feature 1..30: note = hypo
  source 1..30: mol_type = genomic DNA
tataacaacatataacgtggatgaaaacaa

SEQ ID NO: 44251 - DNA, 30 bp, Homo sapiens
  misc_feature 1..30: note = chr15:42448030-42448060
  misc_feature 1..30: note = hypo
  source 1..30: mol_type = genomic DNA
taacgatggctgtcacgcaccacacacctg

SEQ ID NO: 44252 - DNA, 104 bp, Homo sapiens
  misc_feature 1..104: note = chr15:42562548-42562652
  misc_feature 1..104: note = hypo
  source 1..104: mol_type = genomic DNA
cacagcaaaactccgtctcaaaaaacaacaacaaaaaataaagtgcctcaaatcctccaaaaacaatgaaatataaacacttcaaaatacgcagttagggctgg

SEQ ID NO: 44253 - DNA, 248 bp, Homo sapiens
  misc_feature 1..248: note = chr15:42684673-42684921
  misc_feature 1..248: note = hypo
  source 1..248: mol_type = genomic DNA
gggccactgaaggtccgttcgtggtcgtgaggcacactttcagggagcagagtggtctgtgtcttcacagagcccggaaaatgaactagtatgaactttgcctccaagcagcagaacttctgttcccccgcccctaatgggttctctggttactgctctacagacaatcattccggttcagtatgagacaagaatggcctgcgggctggtcagaggtcacgcctactctgtcacggggctggatgagg

SEQ ID NO: 44254 - DNA, 40 bp, Homo sapiens
  misc_feature 1..40: note = chr15:42784374-42784414
  misc_feature 1..40: note = hypo
  source 1..40: mol_type = genomic DNA
ctggtattacaggtgtgagccaccgcgcccggccgcctat

SEQ ID NO: 44255 - DNA, 141 bp, Homo sapiens
  misc_feature 1..141: note = chr15:43020219-43020360
  misc_feature 1..141: note = hypo
  source 1..141: mol_type = genomic DNA
actgctcagaacctgcgaaacagaactacagagtcaggggctaggggagggctgggtgcaacaaaggatgccagagtcgagcactgaccccgcccccacacaccctcccgcagcctcagactactccgtgcacctccccac

SEQ ID NO: 44256 - DNA, 20 bp, Homo sapiens
  misc_feature 1..20: note = chr15:43511855-43511875
  misc_feature 1..20: note = hypo
  source 1..20: mol_type = genomic DNA
aacgatttggccaggcgcag

SEQ ID NO: 44257 - DNA, 51 bp, Homo sapiens
  misc_feature 1..51: note = chr15:43661941-43661992
  misc_feature 1..51: note = hypo
  source 1..51: mol_type = genomic DNA
atctgctccttggtgcgcacctccggccttagccaccgacagcaaagttcc

SEQ ID NO: 44258 - DNA, 160 bp, Homo sapiens
  misc_feature 1..160: note = chr15:44037474-44037634
  misc_feature 1..160: note = hypo
  source 1..160: mol_type = genomic DNA
atgtacccacatctacgaactaggagcagttgggcagaacaaacattctactaagactcagggttttttgaaacaaaaggggctaagagtggtaaagacattgagcagtcgaccaagtggccaggcatcttcactttgtgacggcactaccaattaaaag

SEQ ID NO: 44259 - DNA, 221 bp, Homo sapiens
  misc_feature 1..221: note = chr15:44092138-44092359
  misc_feature 1..221: note = hypo
  source 1..221: mol_type = genomic DNA
ggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatg

SEQ ID NO: 44260 - DNA, 17 bp, Homo sapiens
  misc_feature 1..17: note = chr15:44116023-44116040
  misc_feature 1..17: note = hypo
  source 1..17: mol_type = genomic DNA
tgttgagactagatacg

SEQ ID NO: 44261 - DNA, 30 bp, Homo sapiens
  misc_feature 1..30: note = chr15:45471850-45471880
  misc_feature 1..30: note = hypo
  source 1..30: mol_type = genomic DNA
ggcagagactgagcccggttcacccagggc

SEQ ID NO: 44262 - DNA, 23 bp, Homo sapiens
  misc_feature 1..23: note = chr15:45544201-45544224
  misc_feature 1..23: note = hypo
  source 1..23: mol_type = genomic DNA
cggcctcccgaagtgctgggatt

SEQ ID NO: 44263 - DNA, 20 bp, Homo sapiens
  misc_feature 1..20: note = chr15:48906097-48906117
  misc_feature 1..20: note = hypo
  source 1..20: mol_type = genomic DNA
ctgggcgacagagtgagact

SEQ ID NO: 44264 - DNA, 204 bp, Homo sapiens
  misc_feature 1..204: note = chr15:49182759-49182963
  misc_feature 1..204: note = hypo
  source 1..204: mol_type = genomic DNA
cagtgtcaggcaactcggaaagatttgagggacaagagcagttttgagtgcagctctgatatcacgccacctaataaaggccaggctggaccttggtcatatggtgggatgaacgaacagcgattttcatactatctttgccataattagggaaacataaacaagaaaaccacatcatcatttacctttcgctttttaatggct

SEQ ID NO: 44265 - DNA, 22 bp, Homo sapiens
  misc_feature 1..22: note = chr15:51202484-51202506
  misc_feature 1..22: note = hypo
  source 1..22: mol_type = genomic DNA
aggcgctcgatggttgcacgga

SEQ ID NO: 44266 - DNA, 29 bp, Homo sapiens
  misc_feature 1..29: note = chr15:52967811-52967840
  misc_feature 1..29: note = hypo
  source 1..29: mol_type = genomic DNA
aacttagtgttaggccgggcgcggtggct

SEQ ID NO: 44267 - DNA, 145 bp, Homo sapiens; identical to SEQ ID NO: 15900
  misc_feature 1..145: note = chr15:53976280-53976425
  misc_feature 1..145: note = hypo
  source 1..145: mol_type = genomic DNA

SEQ ID NO: 44268 - DNA, 22 bp, Homo sapiens
  misc_feature 1..22: note = chr15:55452971-55452993
  misc_feature 1..22: note = hypo
  source 1..22: mol_type = genomic DNA
gagccaccgcacccagccaaca

SEQ ID NO: 44269 - DNA, 43 bp, Homo sapiens
  misc_feature 1..43: note = chr15:55689108-55689151
  misc_feature 1..43: note = hypo
  source 1..43: mol_type = genomic DNA
aaacacaagataagccgggcgcggtggctcacgcctgtaatcc

SEQ ID NO: 44270 - DNA, 80 bp, Homo sapiens
  misc_feature 1..80: note = chr15:55699080-55699160
  misc_feature 1..80: note = hypo
  source 1..80: mol_type = genomic DNA
ttttgactgaaattccgccctcagcgtaaaaggttaaaaattatgaattaacgcccgcgcggtgggtcacgcctgtaatc

SEQ ID NO: 44271 - DNA, 92 bp, Homo sapiens
  misc_feature 1..92: note = chr15:55806620-55806712
  misc_feature 1..92: note = hypo
  source 1..92: mol_type = genomic DNA
gcacaagggttacttcgtaggccttttcggttcgtgttggggaagactccgcccacccagagtaagtacacacaagaaccagcaaatacttg

SEQ ID NO: 44272 - DNA, 77 bp, Homo sapiens
  misc_feature 1..77: note = chr15:59158460-59158537
  misc_feature 1..77: note = hypo
  source 1..77: mol_type = genomic DNA
gcccggccccaggtttggattctttcacacagcaggtatgggccgactcactgtctggggcccgcccagcccagccc

SEQ ID NO: 44273 - DNA, 30 bp, Homo sapiens
  misc_feature 1..30: note = chr15:59243729-59243759
  misc_feature 1..30: note = hypo
  source 1..30: mol_type = genomic DNA
catttaaagctggagcgaggcaagtgaggc

SEQ ID NO: 44274 - DNA, 30 bp, Homo sapiens
  misc_feature 1..30: note = chr15:59453484-59453514
  misc_feature 1..30: note = hypo
  source 1..30: mol_type = genomic DNA
tcagagatcccgccacggagttctgctgct

SEQ ID NO: 44275 - DNA, 30 bp, Homo sapiens
  misc_feature 1..30: note = chr15:60915264-60915294
  misc_feature 1..30: note = hypo
  source 1..30: mol_type = genomic DNA
aaccctgaggaatgccgtgtcttccctgtg

SEQ ID NO: 44276 - DNA, 30 bp, Homo sapiens
  misc_feature 1..30: note = chr15:61305596-61305626
  misc_feature 1..30: note = hypo
  source 1..30: mol_type = genomic DNA
tgctgacttctgctccggatgactgctgtg

SEQ ID NO: 44277 - DNA, 30 bp, Homo sapiens
  misc_feature 1..30: note = chr15:62361320-62361350
  misc_feature 1..30: note = hypo
  source 1..30: mol_type = genomic DNA
ttttgtttaagaccccggataagaaaatga

SEQ ID NO: 44278 - DNA, 44 bp, Homo sapiens
  misc_feature 1..44: note = chr15:62367703-62367747
  misc_feature 1..44: note = hypo
  source 1..44: mol_type = genomic DNA
ccaatacagataggccgggcacggtgcctcacgtcggtaatcct

SEQ ID NO: 44279 - DNA, 223 bp, Homo sapiens
  misc_feature 1..223: note = chr15:63753342-63753565
  misc_feature 1..223: note = hypo
  source 1..223: mol_type = genomic DNA
aaaagaatgttactgcggggcctccctaaaagacaagggaggaatcaagagaattccaagaaaggcgtccgagcaggaggtaagacagtagatttgaaagcaggactgagggagcaggaatgggaagaggggcccagccccagcgggtcaggggccggactaggctagcgaggcccaagtgcggtggccccatgcagagatcctggctcggtgcaaaggagat

SEQ ID NO: 44280 - DNA, 30 bp, Homo sapiens
  misc_feature 1..30: note = chr15:64440388-64440418
  misc_feature 1..30: note = hypo
  source 1..30: mol_type = genomic DNA
atatagagtctggaacgtggtgttcatatg

SEQ ID NO: 44281 - DNA, 30 bp, Homo sapiens
  misc_feature 1..30: note = chr15:64443222-64443252
  misc_feature 1..30: note = hypo
  source 1..30: mol_type = genomic DNA
tgcctgaaggagccacgttatccctatttt

SEQ ID NO: 44282 - DNA, 152 bp, Homo sapiens
  misc_feature 1..152: note = chr15:65043526-65043678
  misc_feature 1..152: note = hypo
  source 1..152: mol_type = genomic DNA
tctcgaggaaaaaaaaaaaaagattcttactgtctccatttaactggcgaggaaacagaggctcagaaggcagcatgtgaattcgcagaaccaggacacgggctggacctgcccccacagcttctgccacgccttcccgcatcatcctgctg

SEQ ID NO: 44283 - DNA, 45 bp, Homo sapiens
  misc_feature 1..45: note = chr15:65127716-65127761
  misc_feature 1..45: note = hypo
  source 1..45: mol_type = genomic DNA
gctaggattacgggcgtgagccaccgcgcccggcctggatttatg

SEQ ID NO: 44284 - DNA, 44 bp, Homo sapiens
  misc_feature 1..44: note = chr15:65622974-65623018
  misc_feature 1..44: note = hypo
  source 1..44: mol_type = genomic DNA
gcttgaagccgccctcgtgctgggccagccggggccaaggctcc

SEQ ID NO: 44285 - DNA, 103 bp, Homo sapiens
  misc_feature 1..103: note = chr15:65862091-65862194
  misc_feature 1..103: note = hypo
  source 1..103: mol_type = genomic DNA
tttataggggtcccacgtttgtagtgctctatttcttaacttgggttatataaactcaaatgtttatttggcagtattctttagactgcgtttgaacatgtgt

SEQ ID NO: 44286 - DNA, 33 bp, Homo sapiens
  misc_feature 1..33: note = chr15:66147762-66147795
  misc_feature 1..33: note = hypo
  source 1..33: mol_type = genomic DNA
gcattccactcccacccccgccaaaaaaaaaag

SEQ ID NO: 44287 - DNA, 192 bp, Homo sapiens
  misc_feature 1..192: note = chr15:66598802-66598994
  misc_feature 1..192: note = hypo
  source 1..192: mol_type = genomic DNA
ctctctgcttgcctccgtgcactcaggctttgaagaaggggctaggcagggcaaggtggtataattacataataaaatggctggaagtctctgaaggggaaaggagagggaaggagtttaattgatctgcaaactaattaactaggccctgcccaagcaccttctagcaggcaaaatcgagaaacaatagca

SEQ ID NO: 44288 - DNA, 30 bp, Homo sapiens
  misc_feature 1..30: note = chr15:66788210-66788240
  misc_feature 1..30: note = hypo
  source 1..30: mol_type = genomic DNA
tacttgtaagggtaccgtggcaatatagaa

SEQ ID NO: 44289 - DNA, 34 bp, Homo sapiens
  misc_feature 1..34: note = chr15:66789324-66789358
  misc_feature 1..34: note = hypo
  source 1..34: mol_type = genomic DNA
tctcaattttttgtagagacgaggtctcactata

SEQ ID NO: 44290 - DNA, 131 bp, Homo sapiens
  misc_feature 1..131: note = chr15:66963229-66963360
  misc_feature 1..131: note = hypo
  source 1..131: mol_type = genomic DNA
ttagtaagtgctggacgtgtttgctccttctaggtctacatttttagcagagggaatagcaagggcaaaggccctgaggtgggaaacacgttccaggaatgggaagaaggttaggacgacacaaggggagt

SEQ ID NO: 44291 - DNA, 35 bp, Homo sapiens
  misc_feature 1..35: note = chr15:66963682-66963717
  misc_feature 1..35: note = hypo
  source 1..35: mol_type = genomic DNA
gtgcccgcctcccaccgcaccgcctgctgtgatca

SEQ ID NO: 44292 - DNA, 72 bp, Homo sapiens
  misc_feature 1..72: note = chr15:66964011-66964083
  misc_feature 1..72: note = hypo
  source 1..72: mol_type = genomic DNA
gagcacattggtgtccgagcctttttaatgctaagcacactgttcctcagagagaaacggtgtgtgaggctg

SEQ ID NO: 44293 - DNA, 39 bp, Homo sapiens
  misc_feature 1..39: note = chr15:67457364-67457403
  misc_feature 1..39: note = hypo
  source 1..39: mol_type = genomic DNA
caatatgaagaaggacgaggtctgcgtgaatccctacca

SEQ ID NO: 44294 - DNA, 81 bp, Homo sapiens; identical to SEQ ID NO: 15907
  misc_feature 1..81: note = chr15:67545405-67545486
  misc_feature 1..81: note = hypo
  source 1..81: mol_type = genomic DNA

SEQ ID NO: 44295 - DNA, 23 bp, Homo sapiens
  misc_feature 1..23: note = chr15:69324757-69324780
  misc_feature 1..23: note = hypo
  source 1..23: mol_type = genomic DNA
tttttttttctgagacggagtct

SEQ ID NO: 44296 - DNA, 30 bp, Homo sapiens
  misc_feature 1..30: note = chr15:69754387-69754417
  misc_feature 1..30: note = hypo
  source 1..30: mol_type = genomic DNA
ggaaccagatgaggacgaaggcggagatgc

SEQ ID NO: 44297 - DNA, 30 bp, Homo sapiens; identical to SEQ ID NO: 15908
  misc_feature 1..30: note = chr15:70075720-70075750
  misc_feature 1..30: note = hypo
  source 1..30: mol_type = genomic DNA

SEQ ID NO: 44298 - DNA, 18 bp, Homo sapiens
  misc_feature 1..18: note = chr15:71117912-71117930
  misc_feature 1..18: note = hypo
  source 1..18: mol_type = genomic DNA
tttttttttttgagacgg

SEQ ID NO: 44299 - DNA, 176 bp, Homo sapiens; identical to SEQ ID NO: 15909
  misc_feature 1..176: note = chr15:72102772-72102948
  misc_feature 1..176: note = hypo
  source 1..176: mol_type = genomic DNA

SEQ ID NO: 44300 - DNA, 17 bp, Homo sapiens
  misc_feature 1..17: note = chr15:72411795-72411812
  misc_feature 1..17: note = hypo
  source 1..17: mol_type = genomic DNA
tggaggtcatttagccg

SEQ ID NO: 44301 - DNA, 197 bp, Homo sapiens
  misc_feature 1..197: note = chr15:72412112-72412309
  misc_feature 1..197: note = hypo
  source 1..197: mol_type = genomic DNA
gtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtc

SEQ ID NO: 44302 - DNA, 30 bp, Homo sapiens
  misc_feature 1..30: note = chr15:72462639-72462669
  misc_feature 1..30: note = hypo
  source 1..30: mol_type = genomic DNA
gagactcgcttatgccgagaacaaaagtgt

SEQ ID NO: 44303 - DNA, 319 bp, Homo sapiens
  misc_feature 1..319: note = chr15:72581481-72581800
  misc_feature 1..319: note = hypo
  source 1..319: mol_type = genomic DNA
gataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctag

SEQ ID NO: 44304 - DNA, 30 bp, Homo sapiens
  misc_feature 1..30: note = chr15:72743660-72743690
  misc_feature 1..30: note = hypo
  source 1..30: mol_type = genomic DNA
gcgactccaaggcagcggagctgaccgcca

SEQ ID NO: 44305 - DNA, 36 bp, Homo sapiens
  misc_feature 1..36: note = chr15:72768976-72769012
  misc_feature 1..36: note = hypo
  source 1..36: mol_type = genomic DNA
acaggcgtcagccaccgtgcccggcctgtagaagat

SEQ ID NO: 44306 - DNA, 30 bp, Homo sapiens
  misc_feature 1..30: note = chr15:73919229-73919259
  misc_feature 1..30: note = hypo
  source 1..30: mol_type = genomic DNA
taatacctgggtgaccgatgatttttaata

SEQ ID NO: 44307 - DNA, 96 bp, Homo sapiens
  misc_feature 1..96: note = chr15:74790274-74790370
  misc_feature 1..96: note = hypo
  source 1..96: mol_type = genomic DNA
gcctacagaggagagcgagtacttatctttttagtactttttattctggtgagcctctcaccagcaaattctttctttttttttttgagtcagagt

SEQ ID NO: 44308 - DNA, 17 bp, Homo sapiens
  misc_feature 1..17: note = chr15:74818772-74818789
  misc_feature 1..17: note = hypo
  source 1..17: mol_type = genomic DNA
taataactcctttgccg

SEQ ID NO: 44309 - DNA, 30 bp, Homo sapiens
  misc_feature 1..30: note = chr15:74903896-74903926
  misc_feature 1..30: note = hypo
  source 1..30: mol_type = genomic DNA
aggtccttctctgcccgcctccagtcccgc

SEQ ID NO: 44310 - DNA, 30 bp, Homo sapiens
  misc_feature 1..30: note = chr15:74911603-74911633
  misc_feature 1..30: note = hypo
  source 1..30: mol_type = genomic DNA
aggaggtcctacagtcgggaacatgaaggg

SEQ ID NO: 44311 - DNA, 101 bp, Homo sapiens
  misc_feature 1..101: note = chr15:75143124-75143225
  misc_feature 1..101: note = hypo
  source 1..101: mol_type = genomic DNA
tgaaacagaggagcccgctctgtacctaggcagggatagttcccatatcctggttttctgggacctcaaaaccagggatcaaactacgttcctgagaggtg

SEQ ID NO: 44312 - DNA, 22 bp, Homo sapiens
  misc_feature 1..22: note = chr15:75205459-75205481
  misc_feature 1..22: note = hypo
  source 1..22: mol_type = genomic DNA
gagatgccgtctcaaacaaaac

SEQ ID NO: 44313 - DNA, 76 bp, Homo sapiens
  misc_feature 1..76: note = chr15:76197445-76197521
  misc_feature 1..76: note = hypo
  source 1..76: mol_type = genomic DNA
gagccaccgcgcccggcatgttgggccttttaagtatccacattttcactattaacaacaacgctgtgcagaacct

SEQ ID NO: 44314 - DNA, 30 bp, Homo sapiens; identical to SEQ ID NO: 15913
  misc_feature 1..30: note = chr15:76510088-76510118
  misc_feature 1..30: note = hypo
  source 1..30: mol_type = genomic DNA

SEQ ID NO: 44315 - DNA, 81 bp, Homo sapiens
  misc_feature 1..81: note = chr15:77852830-77852911
  misc_feature 1..81: note = hypo
  source 1..81: mol_type = genomic DNA
tccagggaggcagatggtggtattaatcctcatatcgcggggggtgtacaacctcctgttatggttcgtaacatttagggt

SEQ ID NO: 44316 - DNA, 51 bp, Homo sapiens
  misc_feature 1..51: note = chr15:77906947-77906998
  misc_feature 1..51: note = hypo
  source 1..51: mol_type = genomic DNA
acctgctgggccttgcggtcccggatgcgggcgcggcggcaggtgaagtag

SEQ ID NO: 44317 - DNA, 30 bp, Homo sapiens
  misc_feature 1..30: note = chr15:78252931-78252961
  misc_feature 1..30: note = hypo
  source 1..30: mol_type = genomic DNA
acaagtcccattaagcgcaattcttatgtt

SEQ ID NO: 44318 - DNA, 30 bp, Homo sapiens
  misc_feature 1..30: note = chr15:78277490-78277520
  misc_feature 1..30: note = hypo
  source 1..30: mol_type = genomic DNA
gggggcctctcctgccgggccatgctctgc

SEQ ID NO: 44319 - DNA, 151 bp, Homo sapiens
  misc_feature 1..151: note = chr15:78501791-78501942
  misc_feature 1..151: note = hypo
  source 1..151: mol_type = genomic DNA
cgtgtgcttccggggcgaggcctcctgtgccgggcagacagaggcgtgtgaatgctgcagaactcgtcctactgactttggatccttggttacagctctctgggatagccaggtagaagctgcctccactttgggccgcaatgttaccaaa

SEQ ID NO: 44320 - DNA, 30 bp, Homo sapiens
  misc_feature 1..30: note = chr15:78503615-78503645
  misc_feature 1..30: note = hypo
  source 1..30: mol_type = genomic DNA
tgagcacgccgaaggcgattaacatattat

SEQ ID NO: 44321 - DNA, 157 bp, Homo sapiens
  misc_feature 1..157: note = chr15:78596061-78596218
  misc_feature 1..157: note = hypo
  source 1..157: mol_type = genomic DNA
ccgcgcccggccactgtttacactattgttgcagtagctgctgccatcaccgggctgcggcagggaggcacagctggggctgcatgctggtggatgcctcccccttctgagttggggagagctccccaggtgctgctgcagccgcccaaacagcagt

SEQ ID NO: 44322 - DNA, 139 bp, Homo sapiens; identical to SEQ ID NO: 15917
  misc_feature 1..139: note = chr15:78609750-78609889
  misc_feature 1..139: note = hypo
  source 1..139: mol_type = genomic DNA

SEQ ID NO: 44323 - DNA, 68 bp, Homo sapiens
  misc_feature 1..68: note = chr15:79055979-79056047
  misc_feature 1..68: note = hypo
  source 1..68: mol_type = genomic DNA
ccaagactgaccaggcgccaccaagcacttgctccctgctcctccccgcagcccggctcacctggccc

SEQ ID NO: 44324 - DNA, 30 bp, Homo sapiens
  misc_feature 1..30: note = chr15:79057117-79057147
  misc_feature 1..30: note = hypo
  source 1..30: mol_type = genomic DNA
acccacctaggctagcgagacctcagcaag

SEQ ID NO: 44325 - DNA, 66 bp, Homo sapiens
  misc_feature 1..66: note = chr15:80624497-80624563
  misc_feature 1..66: note = hypo
  source 1..66: mol_type = genomic DNA
tccccaaccagttcccgcggggaccaacaggacagaagaagctggcagctgcggggggcaaggctg

SEQ ID NO: 44326 - DNA, 48 bp, Homo sapiens
  misc_feature 1..48: note = chr15:82042541-82042589
  misc_feature 1..48: note = hypo
  source 1..48: mol_type = genomic DNA
catccctgagccagccggcctctgagcatcttgcgctggcagtgccgg

SEQ ID NO: 44327 - DNA, 162 bp, Homo sapiens
  misc_feature 1..162: note = chr15:82205642-82205804
  misc_feature 1..162: note = hypo
  source 1..162: mol_type = genomic DNA
gctgtctgactccagcgttcatgcttggaacactaactaccctctactagttcattagaggcaactgggtaaaagtggaactaggtgtgcccgtgataaagcctgtgattaagtagttaaaatgaggatggattccggtaagccaaacgtacacataaggtt

SEQ ID NO: 44328 - DNA, 21 bp, Homo sapiens
  misc_feature 1..21: note = chr15:83572455-83572476
  misc_feature 1..21: note = hypo
  source 1..21: mol_type = genomic DNA
ctgaacaagactgggcgcagt

SEQ ID NO: 44329 - DNA, 95 bp, Homo sapiens; identical to SEQ ID NO: 15918
  misc_feature 1..95: note = chr15:83655934-83656029
  misc_feature 1..95: note = hypo
  source 1..95: mol_type = genomic DNA

SEQ ID NO: 44330 - DNA, 29 bp, Homo sapiens
  misc_feature 1..29: note = chr15:83665114-83665143
  misc_feature 1..29: note = hypo
  source 1..29: mol_type = genomic DNA
tggcgcggtggctcacgcctgtaatccca

SEQ ID NO: 44331 - DNA, 37 bp, Homo sapiens
  misc_feature 1..37: note = chr15:84582058-84582095
  misc_feature 1..37: note = hypo
  source 1..37: mol_type = genomic DNA
ctgaggacagtgagacgacttacgactgggagtacgc

SEQ ID NO: 44332 - DNA, 30 bp, Homo sapiens
  misc_feature 1..30: note = chr15:84950141-84950171
  misc_feature 1..30: note = hypo
  source 1..30: mol_type = genomic DNA
aacctgcaggagctgcggggcaggtgttgc

SEQ ID NO: 44333 - DNA, 159 bp, Homo sapiens
  misc_feature 1..159: note = chr15:85143074-85143233
  misc_feature 1..159: note = hypo
  source 1..159: mol_type = genomic DNA
tgcaggtgcctccagtaattgctcagtgcaaacatacataactattctatcacagaccattaagggtgtctctctccatttttagattttccgcttgagtttccaggtagtttctcacctgttttcaagcagggttggggcagccgtttcttcaacagc

SEQ ID NO: 44334 - DNA, 47 bp, Homo sapiens
  misc_feature 1..47: note = chr15:85728800-85728847
  misc_feature 1..47: note = hypo
  source 1..47: mol_type = genomic DNA
ttttctggttttccacggtgttcatggatttccgtgacttgaaccta

SEQ ID NO: 44335 - DNA, 27 bp, Homo sapiens
  misc_feature 1..27: note = chr15:85886665-85886692
  misc_feature 1..27: note = hypo
  source 1..27: mol_type = genomic DNA
gattttaacttgcgttagtgaactaat

SEQ ID NO: 44336 - DNA, 38 bp, Homo sapiens
  misc_feature 1..38: note = chr15:89142361-89142399
  misc_feature 1..38: note = hypo
  source 1..38: mol_type = genomic DNA
tctaactttaaaggccgggcgcggtggctcacgcctgt

SEQ ID NO: 44337 - DNA, 30 bp, Homo sapiens
  misc_feature 1..30: note = chr15:89145873-89145903
  misc_feature 1..30: note = hypo
  source 1..30: mol_type = genomic DNA
taccccacttctggccgtgcgcagtggctc

SEQ ID NO: 44338 - DNA, 20 bp, Homo sapiens
  misc_feature 1..20: note = chr15:89448511-89448531
  misc_feature 1..20: note = hypo
  source 1..20: mol_type = genomic DNA
taataaatcattcatcgggg

SEQ ID NO: 44339 - DNA, 214 bp, Homo sapiens
  misc_feature 1..214: note = chr15:89876593-89876807
  misc_feature 1..214: note = hypo
  source 1..214: mol_type = genomic DNA
tagaggggcggcaggcgcagctccacgtcgggcaagggcacggctggctgcccccagagcccgtgcttctgcaggtgctcgacgctgcggcgcaccgcggcctcgccaggcatctcccctccttgcccgaagatttgctcgtgcagccctctcgagagcatctggatgtccaatgggttgtgccgcagctgcccgccctccgaggatagcactt

SEQ ID NO: 44340 - DNA, 214 bp, Homo sapiens
  misc_feature 1..214: note = chr15:89876867-89877081
  misc_feature 1..214: note = hypo
  source 1..214: mol_type = genomic DNA
gctgcccgtcgctggggtcggacgcggggacggagctggagacccagcgccccggagctggaaccggccctggcccgacggtggcgccggccaccttcctccagagcaggcggctcatggttggtgcagggacccccacgctgggagtcagaacacctggctttgggctccagcttggcttcttttactggctggaagacgtggagagagacac

SEQ ID NO: 44341 - DNA, 199 bp, Homo sapiens
  misc_feature 1..199: note = chr15:90109400-90109599
  misc_feature 1..199: note = hypo
  source 1..199: mol_type = genomic DNA
atcactgatgtaaaccgaaggtatgagagccataacccaggttcgatttttgcttttttacaaatatgcttttcaggggtagaaattccatgctattaggctgttcttaaacttttccattagaaaaatgccataggaatgcagaaaagggtgtggtaattccgcctggggaattcaggaagagcgagagagaagctac

SEQ ID NO: 44342 - DNA, 30 bp, Homo sapiens
  misc_feature 1..30: note = chr15:90501049-90501079
  misc_feature 1..30: note = hypo
  source 1..30: mol_type = genomic DNA
aaatttaacaaaaaccgtggcctgcctata

SEQ ID NO: 44343 - DNA, 30 bp, Homo sapiens
  misc_feature 1..30: note = chr15:90501399-90501429
  misc_feature 1..30: note = hypo
  source 1..30: mol_type = genomic DNA
aacatacctcatgcccgatgctccctaggc

SEQ ID NO: 44344 - DNA, 30 bp, Homo sapiens; identical to SEQ ID NO: 15919
  misc_feature 1..30: note = chr15:90630578-90630608
  misc_feature 1..30: note = hypo
  source 1..30: mol_type = genomic DNA

SEQ ID NO: 44345 - DNA, 43 bp, Homo sapiens
  misc_feature 1..43: note = chr15:90667422-90667465
  misc_feature 1..43: note = hypo
  source 1..43: mol_type = genomic DNA
cctttttttttgagacggagtttcactcttgttgcccaggctg

SEQ ID NO: 44346 - DNA, 82 bp, Homo sapiens; identical to SEQ ID NO: 15920
  misc_feature 1..82: note = chr15:90703242-90703324
  misc_feature 1..82: note = hypo
  source 1..82: mol_type = genomic DNA

SEQ ID NO: 44347 - DNA, 20 bp, Homo sapiens
  misc_feature 1..20: note = chr15:90741434-90741454
  misc_feature 1..20: note = hypo
  source 1..20: mol_type = genomic DNA
caccgcgcctggctggtaaa

SEQ ID NO: 44348 - DNA, 30 bp, Homo sapiens
  misc_feature 1..30: note = chr15:90755834-90755864
  misc_feature 1..30: note = hypo
  source 1..30: mol_type = genomic DNA
gagtgagtgcgcaagcgtggacaagccctg

SEQ ID NO: 44349 - DNA, 55 bp, Homo sapiens
  misc_feature 1..55: note = chr15:90866273-90866328
  misc_feature 1..55: note = hypo
  source 1..55: mol_type = genomic DNA
taaggaaaagaccaccgcagtggctcagtgctcttgctgacgtgccccactgcac

SEQ ID NO: 44350 - DNA, 35 bp, Homo sapiens
  misc_feature 1..35: note = chr15:90896205-90896240
  misc_feature 1..35: note = hypo
  source 1..35: mol_type = genomic DNA
ttttttttttttagacggaatttcgctcttgttgc

SEQ ID NO: 44351 - DNA, 116 bp, Homo sapiens; identical to SEQ ID NO: 15922
  misc_feature 1..116: note = chr15:91189343-91189459
  misc_feature 1..116: note = hypo
  source 1..116: mol_type = genomic DNA

SEQ ID NO: 44352 - DNA, 22 bp, Homo sapiens
  misc_feature 1..22: note = chr15:91313693-91313715
  misc_feature 1..22: note = hypo
  source 1..22: mol_type = genomic DNA
ccgtgcccggccaatccccaca

SEQ ID NO: 44353 - DNA, 30 bp, Homo sapiens; identical to SEQ ID NO: 15924
  misc_feature 1..30: note = chr15:91409404-91409434
  misc_feature 1..30: note = hypo
  source 1..30: mol_type = genomic DNA

SEQ ID NO: 44354 - DNA, 30 bp, Homo sapiens
  misc_feature 1..30: note = chr15:91500770-91500800
  misc_feature 1..30: note = hypo
  source 1..30: mol_type = genomic DNA
gagaagcaagcggagcgggaccccttaatg

SEQ ID NO: 44355 - DNA, 46 bp, Homo sapiens
  misc_feature 1..46: note = chr15:92459343-92459389
  misc_feature 1..46: note = hypo
  source 1..46: mol_type = genomic DNA
cacgcgggcaccggccgcgcctgatcggctgcggcggcatcgtcat

SEQ ID NO: 44356 - DNA, 98 bp, Homo sapiens
  misc_feature 1..98: note = chr15:92459593-92459691
  misc_feature 1..98: note = hypo
  source 1..98: mol_type = genomic DNA
ggtgctcctgggcatcggtgctacccctgtgcagcccctgggcgtctcctacatcgacgaccacgtgcggaggaaggactcctcgctctatataggta

SEQ ID NO: 44357 - DNA, 30 bp, Homo sapiens
  misc_feature 1..30: note = chr15:92701704-92701734
  misc_feature 1..30: note = hypo
  source 1..30: mol_type = genomic DNA
tggttatggaggggacgcataatggatgtg

SEQ ID NO: 44358 - DNA, 18 bp, Homo sapiens
  misc_feature 1..18: note = chr15:93364650-93364668
  misc_feature 1..18: note = hypo
  source 1..18: mol_type = genomic DNA
tctcgggggaaaaaaaaa

SEQ ID NO: 44359 - DNA, 121 bp, Homo sapiens
  misc_feature 1..121: note = chr15:93594841-93594962
  misc_feature 1..121: note = hypo
  source 1..121: mol_type = genomic DNA
tgaaaaccagcagcccgcagtggcctcgtggggccgctcagaatatgccaggttctggagtcacccgggcctggggcaaattctagctcagcattccagctgactacgcacttggggtggg

SEQ ID NO: 44360 - DNA, 45 bp, Homo sapiens
  misc_feature 1..45: note = chr15:93609520-93609565
  misc_feature 1..45: note = hypo
  source 1..45: mol_type = genomic DNA
tcctgtggatgaatccgtaaccattccggacgttgaaccatttga

SEQ ID NO: 44361 - DNA, 63 bp, Homo sapiens
  misc_feature 1..63: note = chr15:93609815-93609878
  misc_feature 1..63: note = hypo
  source 1..63: mol_type = genomic DNA
taccaccccgggcatcgtcgccgtggggactgccgtcaccaccgccgccgcctccacctcgct

SEQ ID NO: 44362 - DNA, 33 bp, Homo sapiens
  misc_feature 1..33: note = chr15:93902389-93902422
  misc_feature 1..33: note = hypo
  source 1..33: mol_type = genomic DNA
caaatgttatataaacgccgggcaaagggatga

SEQ ID NO: 44363 - DNA, 30 bp, Homo sapiens; identical to SEQ ID NO: 15927
  misc_feature 1..30: note = chr15:94347602-94347632
  misc_feature 1..30: note = hypo
  source 1..30: mol_type = genomic DNA

SEQ ID NO: 44364 - DNA, 40 bp, Homo sapiens
  misc_feature 1..40: note = chr15:94478454-94478494
  misc_feature 1..40: note = hypo
  source 1..40: mol_type = genomic DNA
aaagaaggaggaggccgggcgccgtggctcacgcctgtaa

SEQ ID NO: 44365 - DNA, 30 bp, Homo sapiens
  misc_feature 1..30: note = chr15:94925846-94925876
  misc_feature 1..30: note = hypo
  source 1..30: mol_type = genomic DNA
tgctgtacctcagagcgcctggttattaag

SEQ ID NO: 44366 - DNA, 180 bp, Homo sapiens
  misc_feature 1..180: note = chr15:97006353-97006533
  misc_feature 1..180: note = hypo
  source 1..180: mol_type = genomic DNA
catgtctgtgacatccgtgagcgctgatggtgcacgcttccagtcattttcctggtaagtgtattcagtgatggcatcaaattcagcggttggaagtcttgcctcaggccttggagctaaatacactgaagtcacttgaatatgaaattccttaaagtcgtttaacgtactcattaattt

SEQ ID NO: 44367 - DNA, 30 bp, Homo sapiens
  misc_feature 1..30: note = chr15:98417575-98417605
  misc_feature 1..30: note = hypo
  source 1..30: mol_type = genomic DNA
tcctggggggtgtgtcgggcccctcactgg

SEQ ID NO: 44368 - DNA, 31 bp, Homo sapiens; identical to SEQ ID NO: 15930
  misc_feature 1..31: note = chr15:98454964-98454995
  misc_feature 1..31: note = hypo
  source 1..31: mol_type = genomic DNA

SEQ ID NO: 44369 - DNA, 38 bp, Homo sapiens
  misc_feature 1..38: note = chr15:98776801-98776839
  misc_feature 1..38: note = hypo
  source 1..38: mol_type = genomic DNA
ctgggattacaggcgtgagccaccgtgcccggcccagc

SEQ ID NO: 44370 - DNA, 26 bp, Homo sapiens
  misc_feature 1..26: note = chr15:99168900-99168926
  misc_feature 1..26: note = hypo
  source 1..26: mol_type = genomic DNA
acctcagagtcctcacgtataaaatg

SEQ ID NO: 44371 - DNA, 90 bp, Homo sapiens
  misc_feature 1..90: note = chr15:99183400-99183490
  misc_feature 1..90: note = hypo
  source 1..90: mol_type = genomic DNA
actgtgtctctgaaaacaaaaaaaatcatcataataacgatgtcttaatattggttcattagttatgacaaatgtcgcatagcagtatgt

SEQ ID NO: 44372 - DNA, 42 bp, Homo sapiens
  misc_feature 1..42: note = chr15:99254581-99254623
  misc_feature 1..42: note = hypo
  source 1..42: mol_type = genomic DNA
cctactcgattttgtcgtgctgttgcgcggttttcacttggc

SEQ ID NO: 44373 - DNA, 41 bp, Homo sapiens
  misc_feature 1..41: note = chr15:99295597-99295638
  misc_feature 1..41: note = hypo
  source 1..41: mol_type = genomic DNA
tagagtgtttattaacgaaaatatgtgagccttggctgggc

SEQ ID NO: 44374 - DNA, 30 bp, Homo sapiens
  misc_feature 1..30: note = chr15:99454637-99454667
  misc_feature 1..30: note = hypo
  source 1..30: mol_type = genomic DNA
tctcatcagcttcaccgtttactacaagga

SEQ ID NO: 44375 - DNA, 33 bp, Homo sapiens
  misc_feature 1..33: note = chr15:99456398-99456431
  misc_feature 1..33: note = hypo
  source 1..33: mol_type = genomic DNA
gccctggactcagtacgccgtttacgtcaaggc

SEQ ID NO: 44376 - DNA, 48 bp, Homo sapiens
  misc_feature 1..48: note = chr15:99460220-99460268
  misc_feature 1..48: note = hypo
  source 1..48: mol_type = genomic DNA
ccactgagacggagccgaaaaagatgacaggttcggtgaagtgagtcc

SEQ ID NO: 44377 - DNA, 38 bp, Homo sapiens
  misc_feature 1..38: note = chr15:99484067-99484105
  misc_feature 1..38: note = hypo
  source 1..38: mol_type = genomic DNA
tccctaggtttggcacgttgagacgtcctcacgtttgg

SEQ ID NO: 44378 - DNA, 132 bp, Homo sapiens; identical to SEQ ID NO: 15933
  misc_feature 1..132: note = chr15:99484456-99484588
  misc_feature 1..132: note = hypo
  source 1..132: mol_type = genomic DNA

SEQ ID NO: 44379 - DNA, 30 bp, Homo sapiens
  misc_feature 1..30: note = chr15:99506147-99506177
  misc_feature 1..30: note = hypo
  source 1..30: mol_type = genomic DNA
tctgcgagaacataacgatcactcattttt

SEQ ID NO: 44380 - DNA, 30 bp, Homo sapiens
  misc_feature 1..30: note = chr15:99974913-99974943
  misc_feature 1..30: note = hypo
  source 1..30: mol_type = genomic DNA
ccctgggctagaagccggtgcacctccctt

SEQ ID NO: 44381 - DNA, 30 bp, Homo sapiens
  misc_feature 1..30: note = chr15:99981097-99981127
  misc_feature 1..30: note = hypo
  source 1..30: mol_type = genomic DNA
tggataactataaagcgactaggcaatttg

SEQ ID NO: 44382 - DNA, 30 bp, Homo sapiens
  misc_feature 1..30: note = chr15:100378951-100378981
  misc_feature 1..30: note = hypo
  source 1..30: mol_type = genomic DNA
gcaatgctgccagagcggcagctacaactc

SEQ ID NO: 44383 - DNA, 30 bp, Homo sapiens
  misc_feature 1..30: note = chr15:100888957-100888987
  misc_feature 1..30: note = hypo
  source 1..30: mol_type = genomic DNA
tgactcatcctgtgacgaagaatgcctaac

SEQ ID NO: 44384 - DNA, 326 bp, Homo sapiens
  misc_feature 1..326: note = chr15:102043003-102043329
  misc_feature 1..326: note = hypo
  source 1..326: mol_type = genomic DNA
ccgtgacctgagagccgcaccactccacctcctgggcctcactccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagccgacaggtagagctgtttccacctgcgtgtgctgcctgtg

SEQ ID NO: 44385 - DNA, 22 bp, Homo sapiens
  misc_feature 1..22: note = chr15:102193729-102193751
  misc_feature 1..22: note = hypo
  source 1..22: mol_type = genomic DNA
gagactccgtctcaaaaaataa

SEQ ID NO: 44386 - DNA, 30 bp, Homo sapiens
  misc_feature 1..30: note = chr15:102276370-102276400
  misc_feature 1..30: note = hypo
  source 1..30: mol_type = genomic DNA
catcatgggaaaatacggtaaatgcttttt

SEQ ID NO: 44387 - DNA, 57 bp, Homo sapiens; identical to SEQ ID NO: 15935
  misc_feature 1..57: note = chr16:142626-142683
  misc_feature 1..57: note = hypo
  source 1..57: mol_type = genomic DNA

SEQ ID NO: 44388 - DNA, 120 bp, Homo sapiens
  misc_feature 1..120: note = chr16:189557-189677
  misc_feature 1..120: note = hypo
  source 1..120: mol_type = genomic DNA
agatctttgagaccttgggcgaggcagtgacactaaaggcaggagcgactacagaagaataaattaaacttcatcagattaaaaactttactgcggccgggcgcggtggctcacgcctga

SEQ ID NO: 44389 - DNA, 23 bp, Homo sapiens
  misc_feature 1..23: note = chr16:208745-208768
  misc_feature 1..23: note = hypo
  source 1..23: mol_type = genomic DNA
ttttcttttttgagacggaatct

SEQ ID NO: 44390 - DNA, 30 bp, Homo sapiens
  misc_feature 1..30: note = chr16:318060-318090
  misc_feature 1..30: note = hypo
  source 1..30: mol_type = genomic DNA
atcacacatgctatgcgtacacacacttgt

SEQ ID NO: 44391 - DNA, 38 bp, Homo sapiens
  misc_feature 1..38: note = chr16:319924-319962
  misc_feature 1..38: note = hypo
  source 1..38: mol_type = genomic DNA
aaacaaggtaggccacgcatggtggctcacgcctgtga

SEQ ID NO: 44392 - DNA, 158 bp, Homo sapiens
  misc_feature 1..158: note = chr16:323428-323586
  misc_feature 1..158: note = hypo
  source 1..158: mol_type = genomic DNA
ccctgcgctggccagcgacccccaccctcaccgcaggtgggctcaccgggggcctgttcaccagccagtaggtctgctcctggcacgcaatgaccagcctgtcccccttgctgcgctgcttggctgccctgggaggaggaggccgagttgagggcacg

SEQ ID NO: 44393 - DNA, 92 bp, Homo sapiens
  misc_feature 1..92: note = chr16:332635-332727
  misc_feature 1..92: note = hypo
  source 1..92: mol_type = genomic DNA
tgggcagctatggcccgagcgcccaggagtatgagtttgtgactccggtggaggaagcgccgaggggtgcgctggtgcggggcccctatctg

SEQ ID NO: 44394 - DNA, 218 bp, Homo sapiens
  misc_feature 1..218: note = chr16:337560-337778
  misc_feature 1..218: note = hypo
  source 1..218: mol_type = genomic DNA
atgtacatatttacacgggccctcagaaaggaggacccaggactgcacagccggcggctggaggcaggtgcagtgctccgtcgccgattcacacagtggcaggcaagagacaagctgtgttgaaggcactcggtggcgcgtacaattgacagaggccctgcaggcctctgcatccgggcctgggccccacccagacctgggtacgtgggcaaatccca

SEQ ID NO: 44395 - DNA, 456 bp, Homo sapiens
  misc_feature 1..456: note = chr16:410258-410714
  misc_feature 1..456: note = hypo
  source 1..456: mol_type = genomic DNA
taggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtgga

SEQ ID NO: 44396 - DNA, 461 bp, Homo sapiens
  misc_feature 1..461: note = chr16:411043-411504
  misc_feature 1..461: note = hypo
  source 1..461: mol_type = genomic DNA
aaaatgctgcttaaacggcaccgacttgacatggcttgtctcctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagcc

SEQ ID NO: 44397 - DNA, 309 bp, Homo sapiens
  misc_feature 1..309: note = chr16:412764-413073
  misc_feature 1..309: note = hypo
  source 1..309: mol_type = genomic DNA
ccaccttcaagagagcgacttcggggccagtcccagggaaccgggcttggcatgggcctgggcgccgggggtctcgggccgcggctgctcccccaggactctgggcgccgggggtctcgggccgcggctgctcccccaggactctgggcgccgggggtctcgggccgcggctgctcccccaggactctgggcgccgggggtctcgggccgcggctgctcccccaggactctgggtccggatccaagcttcttcgcactggcctggttgtgagccgcctgtcccaggatggaacccggccttgaagccct

SEQ ID NO: 44398 - DNA, 30 bp, Homo sapiens
  misc_feature 1..30: note = chr16:501353-501383
  misc_feature 1..30: note = hypo
  source 1..30: mol_type = genomic DNA
cctccccacgcttcccgtatcagggagctt

SEQ ID NO: 44399 - DNA, 49 bp, Homo sapiens
  misc_feature 1..49: note = chr16:611950-611999
  misc_feature 1..49: note = hypo
  source 1..49: mol_type = genomic DNA
gtgcagccagggccccgcacttggtggcagactccgttctgagcttagg

SEQ ID NO: 44400 - DNA, 117 bp, Homo sapiens
  misc_feature 1..117: note = chr16:612203-612320
  misc_feature 1..117: note = hypo
  source 1..117: mol_type = genomic DNA
ttggctgagtgtggccgctgcaggctcggccgctgacctgcccgaagccacccagatggagctgggctgagcaggtggctgagccgtggggccatgctgggacgtccactccccaca

SEQ ID NO: 44401 - DNA, 168 bp, Homo sapiens
  misc_feature 1..168: note = chr16:612869-613037
  misc_feature 1..168: note = hypo
  source 1..168: mol_type = genomic DNA
gtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggactt

SEQ ID NO: 44402 - DNA, 72 bp, Homo sapiens
  misc_feature 1..72: note = chr16:613552-613624
  misc_feature 1..72: note = hypo
  source 1..72: mol_type = genomic DNA
gcacccaccccagaccgccctggggagtccgaccccggcaggcaaccccagggagcacggcccacaggtgct

SEQ ID NO: 44403 - DNA, 134 bp, Homo sapiens
  misc_feature 1..134: note = chr16:613908-614042
  misc_feature 1..134: note = hypo
  source 1..134: mol_type = genomic DNA
cctgtctctgctgggcgtcaactacccgctcagccccggcctcttctcctacttggggccctcactggccgctgcagcccatgtgcccttcctggcctcggccagccccctgctgcccccggccacggccttcc

SEQ ID NO: 44404 - DNA, 30 bp, Homo sapiens
  misc_feature 1..30: note = chr16:614353-614383
  misc_feature 1..30: note = hypo
  source 1..30: mol_type = genomic DNA
acaaggttctgttcccggagcaggtgggcg

SEQ ID NO: 44405 - DNA, 480 bp, Homo sapiens
  misc_feature 1..480: note = chr16:614777-615257
  misc_feature 1..480: note = hypo
  source 1..480: mol_type = genomic DNA
cagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccaga

SEQ ID NO: 44406 - DNA, 30 bp, Homo sapiens
  misc_feature 1..30: note = chr16:623234-623264
  misc_feature 1..30: note = hypo
  source 1..30: mol_type = genomic DNA
gtttctccacacctccgggacctgtaagcc

SEQ ID NO: 44407 - DNA, 84 bp, Homo sapiens
  misc_feature 1..84: note = chr16:643882-643966
  misc_feature 1..84: note = hypo
  source 1..84: mol_type = genomic DNA
cctgggtgatggtggcgagttacccggcaggaattatgcttcatccaggagtgtgggtggtgcacgcggcggggaggagaaagc

SEQ ID NO: 44408 - DNA, 117 bp, Homo sapiens
  misc_feature 1..117: note = chr16:666790-666907
  misc_feature 1..117: note = hypo
  source 1..117: mol_type = genomic DNA
ccctttctccaggcacgctggagtccacgccctgcctttgcccaatgccctctgagggagaggccctgtgccttgcacccagcgcgggccacaggcggaggccccattccaggcaag

SEQ ID NO: 44409 - DNA, 65 bp, Homo sapiens; identical to SEQ ID NO: 15945
  misc_feature 1..65: note = chr16:667484-667549
  misc_feature 1..65: note = hypo
  source 1..65: mol_type = genomic DNA

SEQ ID NO: 44410 - DNA, 61 bp, Homo sapiens
  misc_feature 1..61: note = chr16:677848-677909
  misc_feature 1..61: note = hypo
  source 1..61: mol_type = genomic DNA
tggtcggaaacaagccgggcctccccagctgcctgggcttgaccggcggggagcctggttg

SEQ ID NO: 44411 - DNA, 205 bp, Homo sapiens
  misc_feature 1..205: note = chr16:700124-700329
  misc_feature 1..205: note = hypo
  source 1..205: mol_type = genomic DNA
gcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagtttaagtctacggccacgtggctccagtttc

SEQ ID NO: 44412 - DNA, 64 bp, Homo sapiens
  misc_feature 1..64: note = chr16:700572-700636
  misc_feature 1..64: note = hypo
  source 1..64: mol_type = genomic DNA
gacctgcctgcagctcgatctgcaggacgttctcctggtctacctgaaccggtgctacggccat

SEQ ID NO: 44413 - DNA, 30 bp, Homo sapiens
  misc_feature 1..30: note = chr16:721696-721726
  misc_feature 1..30: note = hypo
  source 1..30: mol_type = genomic DNA
gatccacgtgccccccggctgcagcacgga

SEQ ID NO: 44414 - DNA, 421 bp, Homo sapiens
  misc_feature 1..421: note = chr16:726626-727047
  misc_feature 1..421: note = hypo
  source 1..421: mol_type = genomic DNA
tgccatggggaggtccgtggcccacactcaggcccctgcccccagatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgggtgctgcagacctaccaccccgagtacatgaagag

SEQ ID NO: 44415 - DNA, 257 bp, Homo sapiens
  misc_feature 1..257: note = chr16:731353-731610
  misc_feature 1..257: note = hypo
  source 1..257: mol_type = genomic DNA
ggctgacaagctgcccggttgtggggcctctggggccaggcgggtggactggccagagagtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggac

SEQ ID NO: 44416 - DNA, 1210 bp, Homo sapiens
  misc_feature 1..1210: note = chr16:734741-735951
  misc_feature 1..1210: note = hypo
  source 1..1210: mol_type = genomic DNA
actcgcagaggtggccgcagcctgcgggacagtgggagctgccttccagccacttcatgatgtgctgcaggtggccgccgtggctgcagccctggcaccacacgaagagacccttgactacgtggtggcagacggcacacatgctggcgcagcggtggcacctgggggcgggcgggagggagggtgcctcagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcaggatctgggtgccaggggcggcgctgcaggggggaggccccgcccaccacacacctgggtctgctcgtcgatgtccttgcgcacccgttcacccaggacgatgagcacagacacagccatctgcacgtcgccctgctcagcgtagaagtgcagcatgtcgcgcaccagcacgccgaagaagtcgggcggcaggcggctgtcgtagagcgcgtgtgagacagacaggagcgagaaggaggagtccacgggggccagggaggccacatccgcctcgctgccgctcacgtgcggggagtcggccttgtcctgcaggtgctcgggcccgggaggcgtgtccacgatctcgtggcgcagcggaaaggcctcctgcggcagcacgcactcagggtcctcggctggaaggcagggaccagcggaggctctgagtctgtcctccatccgcctctgaaccccaccctgcccggacccccactcacggtgcgcgtgttccggatccagcaggtacagctcgtcctcctcaccttccacgtcacccagcaggtagtcggcaggtacgtcgctgccctcggtttcctcgttatctgcccgacaatggggcgggcattcagggtcgtctgggacacccccacccctctcccatcagcacccctacccaccccagcctaccctcattggtgatgagtgtggccgaggagtcgagcagaactgtgtcgctccgtgcatctcctttgctgcggtccagccgcgtc

SEQ ID NO: 44417 - DNA, 145 bp, Homo sapiens; identical to SEQ ID NO: 15952
  misc_feature 1..145: note = chr16:741376-741521
  misc_feature 1..145: note = hypo
  source 1..145: mol_type = genomic DNA

SEQ ID NO: 44418 - DNA, 30 bp, Homo sapiens
  misc_feature 1..30: note = chr16:760916-760946
  misc_feature 1..30: note = hypo
  source 1..30: mol_type = genomic DNA
gtgtcctccacgggccggaacctgtgtctg

SEQ ID NO: 44419 - DNA, 244 bp, Homo sapiens
  misc_feature 1..244: note = chr16:775524-775768
  misc_feature 1..244: note = hypo
  source 1..244: mol_type = genomic DNA
ctggtgccatctcctcgcagctccagctccagtacccggctctccagccgaaggatctgtgggacaactggcatgagcaggtgcacctgcccgcgggccacctggggtaggtgaacattcacccggtgcacgctcaggggcgcgcagcactcagaggcaggctgagacccacagatgccatgtgcgtgtgcatgcccatgcagggcacgtgtcctgggcctgcaccccccgtcccccatgcact

SEQ ID NO: 44420 - DNA, 126 bp, Homo sapiens
  misc_feature 1..126: note = chr16:798233-798359
  misc_feature 1..126: note = hypo
  source 1..126: mol_type = genomic DNA
catgggaaaggctgccgggccccgggctcgccggtgggtggccccgtgcagcctgttattcataaaacttggagagaaagtgcctttttgtaggaaagtgtggggtgctggcggccatttccacct

SEQ ID NO: 44421 - DNA, 30 bp, Homo sapiens; identical to SEQ ID NO: 15953
  misc_feature 1..30: note = chr16:809500-809530
  misc_feature 1..30: note = hypo
  source 1..30: mol_type = genomic DNA

SEQ ID NO: 44422 - DNA, 267 bp, Homo sapiens
  misc_feature 1..267: note = chr16:809787-810054
  misc_feature 1..267: note = hypo
  source 1..267: mol_type = genomic DNA
ttcagttgttctctgcggaagggagtttttaaaaggcccttaatcccttcttgacatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccgtactggggataagagctcacgacatgctgggagg

SEQ ID NO: 44423 - DNA, 193 bp, Homo sapiens
  misc_feature 1..193: note = chr16:816004-816197
  misc_feature 1..193: note = hypo
  source 1..193: mol_type = genomic DNA
gaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcac

SEQ ID NO: 44424 - DNA, 19 bp, Homo sapiens
  misc_feature 1..19: note = chr16:822477-822496
  misc_feature 1..19: note = hypo
  source 1..19: mol_type = genomic DNA
actccgtctcaaaaaatga

SEQ ID NO: 44425 - DNA, 30 bp, Homo sapiens
  misc_feature 1..30: note = chr16:822951-822981
  misc_feature 1..30: note = hypo
  source 1..30: mol_type = genomic DNA
tgatgctccactggccgatctcggtgcggg

SEQ ID NO: 44426 - DNA, 289 bp, Homo sapiens
  misc_feature 1..289: note = chr16:824923-825212
  misc_feature 1..289: note = hypo
  source 1..289: mol_type = genomic DNA
gcatgtgggggtctgcggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctca

SEQ ID NO: 44427 - DNA, 250 bp, Homo sapiens
  misc_feature 1..250: note = chr16:837308-837558
  misc_feature 1..250: note = hypo
  source 1..250: mol_type = genomic DNA
aatcctgagtccccacgccccaccccaggactgaccaggtcttaccaatgccaggtaagccttggtcacgcgccgctccttgaagcacctgtacgcgctgccggcggctgccttgtttagggccacgcacagcgccccgctggtggagaaatccagctggtggcagaacctggagtgggacagagtccagagtctgagccactttcctccacagacgccaccgtggggctccggccgccccccctacctg

SEQ ID NO: 44428 - DNA, 537 bp, Homo sapiens
  misc_feature 1..537: note = chr16:845955-846492
  misc_feature 1..537: note = hypo
  source 1..537: mol_type = genomic DNA
cagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcgg

SEQ ID NO: 44429 - DNA, 66 bp, Homo sapiens
  misc_feature 1..66: note = chr16:847020-847086
  misc_feature 1..66: note = hypo
  source 1..66: mol_type = genomic DNA
caccgacctgccccacgcaaccatgagcagcggctggagcacatcatgaggcgagcggcccgggag

SEQ ID NO: 44430 - DNA, 53 bp, Homo sapiens; identical to SEQ ID NO: 15959
  misc_feature 1..53: note = chr16:858748-858801
  misc_feature 1..53: note = hypo
  source 1..53: mol_type = genomic DNA

SEQ ID NO: 44431 - DNA, 185 bp, Homo sapiens
  misc_feature 1..185: note = chr16:870944-871129
  misc_feature 1..185: note = hypo
  source 1..185: mol_type = genomic DNA
tcttttgttcgctgccgcgtgcttgtcaatcaagtttttcatcctatggatccgtcttttgtcagtttaatttgcaggccccagtcgcagaatttaagaggacagaagaatggtcttttgttcccaacagcctccttcaccaccacaaccccactggctgcctcaccttacgtgtgacacgctcg

SEQ ID NO: 44432 - DNA, 79 bp, Homo sapiens
  misc_feature 1..79: note = chr16:882403-882482
  misc_feature 1..79: note = hypo
  source 1..79: mol_type = genomic DNA
ggtgtagggtgaaggcgtgagccacagtgcccggcctctctcttttttttagagctgggtctcactctgctgtccaggc

SEQ ID NO: 44433 - DNA, 139 bp, Homo sapiens
  misc_feature 1..139: note = chr16:882542-882681
  misc_feature 1..139: note = hypo
  source 1..139: mol_type = genomic DNA
aaagtgctgggacaacaggtgtgagccactgcgcccccctccaggtttagctgtgggatgtttgggctttgaaaggagctgatctgacggagccaggagggctggctgcaggacagagacaggacggctgtcacagcag

SEQ ID NO: 44434 - DNA, 30 bp, Homo sapiens
  misc_feature 1..30: note = chr16:883678-883708
  misc_feature 1..30: note = hypo
  source 1..30: mol_type = genomic DNA
agccagagccttggccgggtctaggggagg

SEQ ID NO: 44435 - DNA, 131 bp, Homo sapiens
  misc_feature 1..131: note = chr16:888838-888969
  misc_feature 1..131: note = hypo
  source 1..131: mol_type = genomic DNA
tgagtcttgactgagcgtctgaggggcagctgggccccgaggctgatgggaagagccagacgaggcctgggaagatggatccgtcccagtgtggccgcgcggctgtcaggagggcacggggactgggcgcg

SEQ ID NO: 44436 - DNA, 30 bp, Homo sapiens
  misc_feature 1..30: note = chr16:891770-891800
  misc_feature 1..30: note = hypo
  source 1..30: mol_type = genomic DNA
cctgctattgcatttcgggagactggtgcc

SEQ ID NO: 44437 - DNA, 233 bp, Homo sapiens
  misc_feature 1..233: note = chr16:894890-895123
  misc_feature 1..233: note = hypo
  source 1..233: mol_type = genomic DNA
cagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacgtttctgtgctcatttcattttacaaatcaactccccaaggtgaggtgggctcgtgccagcaggtgg

SEQ ID NO: 44438 - DNA, 285 bp, Homo sapiens
  misc_feature 1..285: note = chr16:924548-924833
  misc_feature 1..285: note = hypo
  source 1..285: mol_type = genomic DNA
tctccaggcaggcagcggccccagggccccgcggaaccctccggaacagctgtgtaaactgcgtgggaggagggaggctgctcatgccgcaactccccaacggaaggatcacgggaaccaggacaggctccgggggacggtgctcagatgggaacacacggaaccaggacgggatccggggaggcggcgctcagatgggaacacacggaaccaggacaggctccaggcaggcggcgctcagaagtctcagggcactcggctgtcacagcgcggcacaggggagta

SEQ ID NO: 44439 - DNA, 154 bp, Homo sapiens
  misc_feature 1..154: note = chr16:943459-943613
  misc_feature 1..154: note = hypo
  source 1..154: mol_type = genomic DNA
ggatgagcccaaagtcggagggagcacccagtgcacacgcgtctcagccccgccccctgcggcacaaagggagccgaggcgcaggccccgtgtgtctcccacacactgcagctcgcctgctgtgaggactcctggggcacgggacaggcttcca

SEQ ID NO: 44440 - DNA, 132 bp, Homo sapiens
  misc_feature 1..132: note = chr16:963266-963398
  misc_feature 1..132: note = hypo
  source 1..132: mol_type = genomic DNA
ctgtgaggagcctgacgcgttctgcctgggtaacggggcagtagctcttgtggggaacattcacttccacggccgctgctctccttcctgcgacacagacagcgttggcccaatcagcggagaagctgcatg

SEQ ID NO: 44441 - DNA, 76 bp, Homo sapiens
  misc_feature 1..76: note = chr16:965804-965880
  misc_feature 1..76: note = hypo
  source 1..76: mol_type = genomic DNA
gatgagcaccatcaccgggggccggagcaggtgagatgcaggggccggagcacgtgggacgcgggggccggagcag

SEQ ID NO: 44442 - DNA, 30 bp, Homo sapiens
  misc_feature 1..30: note = chr16:968262-968292
  misc_feature 1..30: note = hypo
  source 1..30: mol_type = genomic DNA
gccgcgcggcttgttcgtacttggttgccg

SEQ ID NO: 44443 - DNA, 45 bp, Homo sapiens
  misc_feature 1..45: note = chr16:968601-968646
  misc_feature 1..45: note = hypo
  source 1..45: mol_type = genomic DNA
aaaagtgctggccatcgtgggctgcggggacgttgtgcccacgga

SEQ ID NO: 44444 - DNA, 77 bp, Homo sapiens
  misc_feature 1..77: note = chr16:981729-981806
  misc_feature 1..77: note = hypo
  source 1..77: mol_type = genomic DNA
ctgccgaagctactacgagtcttctgaatttctgcgcgacagtccaaagtgacgtgctgagccgctgcagggtcaga

SEQ ID NO: 44445 - DNA, 30 bp, Homo sapiens
  misc_feature 1..30: note = chr16:1022784-1022814
  misc_feature 1..30: note = hypo
  source 1..30: mol_type = genomic DNA
cagcgctccgggctccggctctgcatttgc

SEQ ID NO: 44446 - DNA, 131 bp, Homo sapiens
  misc_feature 1..131: note = chr16:1040337-1040468
  misc_feature 1..131: note = hypo
  source 1..131: mol_type = genomic DNA
tcaaagtgaaactggcgaagaaagggccggcctcacgagaccccggggactcagacccagtgagcgcacctcttgctgcctcctgctgtgtctggggcatccacaccgccaccccgcgggaaggcaggacg

SEQ ID NO: 44447 - DNA, 155 bp, Homo sapiens
  misc_feature 1..155: note = chr16:1052472-1052627
  misc_feature 1..155: note = hypo
  source 1..155: mol_type = genomic DNA
cacatgtgcacctgccgcagccccgatgtccctccccgggtgaaggaacccacggacgtggctcatccataccgcggaacgtgagccatgaaaaggggcagcctcggctcagccaccgcagggaaggactcgacacacgccgagcagaagaggcc

SEQ ID NO: 44448 - DNA, 30 bp, Homo sapiens
  misc_feature 1..30: note = chr16:1061426-1061456
  misc_feature 1..30: note = hypo
  source 1..30: mol_type = genomic DNA
gcggcagggcagagacgcagggcaaagcgg

SEQ ID NO: 44449 - DNA, 32 bp, Homo sapiens
  misc_feature 1..32: note = chr16:1062412-1062444
  misc_feature 1..32: note = hypo
  source 1..32: mol_type = genomic DNA
caggcaggcagggtccgcgggatggggagtct

SEQ ID NO: 44450 - DNA, 30 bp, Homo sapiens
  misc_feature 1..30: note = chr16:1072992-1073022
  misc_feature 1..30: note = hypo
  source 1..30: mol_type = genomic DNA
cccttcccgctcctccgagtcccagcacct

SEQ ID NO: 44451 - DNA, 42 bp, Homo sapiens
  misc_feature 1..42: note = chr16:1073516-1073558
  misc_feature 1..42: note = hypo
  source 1..42: mol_type = genomic DNA
gcatgtttaggctggcgctgccaggcacgttctccacccacg

SEQ ID NO: 44452 - DNA, 51 bp, Homo sapiens
  misc_feature 1..51: note = chr16:1076434-1076485
  misc_feature 1..51: note = hypo
  source 1..51: mol_type = genomic DNA
ctatttcaccttcttcgctgtggacaccagaacgttcgcagttgcacatgt

SEQ ID NO: 44453 - DNA, 78 bp, Homo sapiens
  misc_feature 1..78: note = chr16:1077581-1077659
  misc_feature 1..78: note = hypo
  source 1..78: mol_type = genomic DNA
gggaacagttgttcccgtgctattttttacccccgtgggctgcgagttctggaacgttccaaacgacagtgacaacgg

SEQ ID NO: 44454 - DNA, 217 bp, Homo sapiens; identical to SEQ ID NO: 15968
  misc_feature 1..217: note = chr16:1081773-1081990
  misc_feature 1..217: note = hypo
  source 1..217: mol_type = genomic DNA

SEQ ID NO: 44455 - DNA, 30 bp, Homo sapiens
  misc_feature 1..30: note = chr16:1089739-1089769
  misc_feature 1..30: note = hypo
  source 1..30: mol_type = genomic DNA
aactgaggcaggggccgagtgatgtccccc

SEQ ID NO: 44456 - DNA, 30 bp, Homo sapiens
  misc_feature 1..30: note = chr16:1092742-1092772
  misc_feature 1..30: note = hypo
  source 1..30: mol_type = genomic DNA
cttcaaggggtggggcgggtggcgtggaca

SEQ ID NO: 44457 - DNA, 69 bp, Homo sapiens
  misc_feature 1..69: note = chr16:1101038-1101107
  misc_feature 1..69: note = hypo
  source 1..69: mol_type = genomic DNA
agccacttagcacttcgcaggggccccgaagcccggtgtcggcaaggtgtccgtcgctggagcaggggt

SEQ ID NO: 44458 - DNA, 30 bp, Homo sapiens
  misc_feature 1..30: note = chr16:1103161-1103191
  misc_feature 1..30: note = hypo
  source 1..30: mol_type = genomic DNA
acagctgctcttggtcggggctgcagtgag

SEQ ID NO: 44459 - DNA, 134 bp, Homo sapiens
  misc_feature 1..134: note = chr16:1128967-1129101
  misc_feature 1..134: note = hypo
  source 1..134: mol_type = genomic DNA
ccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatcta

SEQ ID NO: 44460 - DNA, 85 bp, Homo sapiens
  misc_feature 1..85: note = chr16:1155111-1155196
  misc_feature 1..85: note = hypo
  source 1..85: mol_type = genomic DNA
ggggccagcagcaggcgggtctcagcggcggtgctaccacctcccactcaggctccaacttccagccgcgcgtgtcctacggctg

SEQ ID NO: 44461 - DNA, 206 bp, Homo sapiens
  misc_feature 1..206: note = chr16:1166561-1166767
  misc_feature 1..206: note = hypo
  source 1..206: mol_type = genomic DNA
agtgcatcggagggacgccaggtctgcgggcggcaggcagatagcctggccaggccctcacatgcccaccgccagcaccagcctggaaatggacctggaggggccgggctccacccggcacttagaccaaagagccctgaaaatagacgcagagaaaatcagccacggctcccaggccccagaggtcctcccgggagcaggacgtg

SEQ ID NO: 44462 - DNA, 67 bp, Homo sapiens
  misc_feature 1..67: note = chr16:1171222-1171289
  misc_feature 1..67: note = hypo
  source 1..67: mol_type = genomic DNA
ggcgacacccctccacgcacccgtagtggccaagcccacctccgggggttcccgggccccagagtgg

SEQ ID NO: 44463 - DNA, 143 bp, Homo sapiens
  misc_feature 1..143: note = chr16:1173250-1173393
  misc_feature 1..143: note = hypo
  source 1..143: mol_type = genomic DNA
gttctgagcagcccccggcacctggggccgatctacaggtgcattttgtacatagaatctgacccacaggttgtttgttggataaggggaaaatcccggaatccaggaggcccgtgcgccttcacctccggcctcccgcgcgc

SEQ ID NO: 44464 - DNA, 33 bp, Homo sapiens
  misc_feature 1..33: note = chr16:1188925-1188958
  misc_feature 1..33: note = hypo
  source 1..33: mol_type = genomic DNA
caagagctccgcttcccacgtcctcaccaacgc

SEQ ID NO: 44465 - DNA, 152 bp, Homo sapiens
  misc_feature 1..152: note = chr16:1195670-1195822
  misc_feature 1..152: note = hypo
  source 1..152: mol_type = genomic DNA
tgaccccggcccctccgcacaggcccccgccccgggtctggctcagctggttcctcagatgtccctgggcggcctggcaccttctctgaggagcccccgggtgaaattcccccaaaaacacacactctaggcccacgcgtggtcatctgtgg

SEQ ID NO: 44466 - DNA, 308 bp, Homo sapiens
  misc_feature 1..308: note = chr16:1217195-1217503
  misc_feature 1..308: note = hypo
  source 1..308: mol_type = genomic DNA
cccgtggggatgaaacgggctctttgcggggggcctgtggggtatgggcctcctgtcagcagcccgtcccggtgggtggggcttgccggccgcccgcgaatgtcaggaaccttggattcctgacacacgggtgcgggggcgatatcggcgcggagcgggcggggtggcgcccgggccgcgggtgggagaatctggcgtgtgtgtttgcacggcatccatccctccatccgtcctctggagaatttcaacacccacacttggaataaaaaaaaaaattattaatgagcttggtgcggttgccatgggaa

SEQ ID NO: 44467 - DNA, 156 bp, Homo sapiens
  misc_feature 1..156: note = chr16:1217908-1218064
  misc_feature 1..156: note = hypo
  source 1..156: mol_type = genomic DNA
ccagtgcgtggagcacgtggggcctcaggagccaggcctgttccccggggctgcctggaggcggccgcttgtccccaaggcctggtgaccgcacctctgtctgccctaggccttcgagttgggggacattttgtaaggagccgctgtgcctaggcc

SEQ ID NO: 44468 - DNA, 30 bp, Homo sapiens
  misc_feature 1..30: note = chr16:1220508-1220538
  misc_feature 1..30: note = hypo
  source 1..30: mol_type = genomic DNA
cccgacaccggcctgcggacccccacaagc

SEQ ID NO: 44469 - DNA, 30 bp, Homo sapiens
  misc_feature 1..30: note = chr16:1222610-1222640
  misc_feature 1..30: note = hypo
  source 1..30: mol_type = genomic DNA
gcttctgtaattaaacgatttattattaaa

SEQ ID NO: 44470 - DNA, 151 bp, Homo sapiens; identical to SEQ ID NO: 15975
  misc_feature 1..151: note = chr16:1228780-1228931
  misc_feature 1..151: note = hypo
  source 1..151: mol_type = genomic DNA

SEQ ID NO: 44471 - DNA, 283 bp, Homo sapiens
  misc_feature 1..283: note = chr16:1230013-1230296
  misc_feature 1..283: note = hypo
  source 1..283: mol_type = genomic DNA
cgtgagccaccatgcccggcccggccttgttttttaatatacatctggttgccgggtgatactgagggggccgggctctgcaggcacagggctgaggggcgtcgtgtggatggacggccagcccgttgggtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcata

SEQ ID NO: 44472 - DNA, 205 bp, Homo sapiens
  misc_feature 1..205: note = chr16:1236691-1236896
  misc_feature 1..205: note = hypo
  source 1..205: mol_type = genomic DNA
tgcccgtggcaccaccgcctcctcaacgggtggccacgtaatgcttcctggccggtgaatgtgccacggcagtggagatattctgcccttctagctcttctgtatacaagcagtgcgccctggttctcagggccgtgaccaccaccatgaccggcagacttcagggcggtccgtcccactcccgtggcctcgagggtcctttgga

SEQ ID NO: 44473 - DNA, 30 bp, Homo sapiens
  misc_feature 1..30: note = chr16:1245806-1245836
  misc_feature 1..30: note = hypo
  source 1..30: mol_type = genomic DNA
aggtcctccgggtgccgggctggccggttc

SEQ ID NO: 44474 - DNA, 424 bp, Homo sapiens
  misc_feature 1..424: note = chr16:1248466-1248890
  misc_feature 1..424: note = hypo
  source 1..424: mol_type = genomic DNA
caccagggggtggcccgagtcagtgtgcagtgggcgtggacacccactgtgaacagtggacggggctcgggggtcccgggaggggctgcagccccgaggacactcctgcagggcttagcagtgccaatcctggccctgctgcccacaggcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgc

SEQ ID NO: 44475 - DNA, 79 bp, Homo sapiens
  misc_feature 1..79: note = chr16:1250278-1250357
  misc_feature 1..79: note = hypo
  source 1..79: mol_type = genomic DNA
ggccgtactaccagacggaggagggcgaggagaacccgttcatctgctcctcacgccgagacaacggcatgcagaagtg

SEQ ID NO: 44476 - DNA, 100 bp, Homo sapiens
  misc_feature 1..100: note = chr16:1251693-1251793
  misc_feature 1..100: note = hypo
  source 1..100: mol_type = genomic DNA
tggtggtgattgccacgcagttctcggagacgaagcagcgggagagtcagctgatgcgggagcagcgggcacgccacctgtccaacgacagcacgctggc

SEQ ID NO: 44477 - DNA, 51 bp, Homo sapiens
  misc_feature 1..51: note = chr16:1253065-1253116
  misc_feature 1..51: note = hypo
  source 1..51: mol_type = genomic DNA
cgggggtgtgtcccccgtggtggggagaggtgcgagcgagggtgccgaggg

SEQ ID NO: 44478 - DNA, 32 bp, Homo sapiens
  misc_feature 1..32: note = chr16:1259204-1259236
  misc_feature 1..32: note = hypo
  source 1..32: mol_type = genomic DNA
tgaggacggcagggccgcgcccgggccccgtg

SEQ ID NO: 44479 - DNA, 38 bp, Homo sapiens
  misc_feature 1..38: note = chr16:1261601-1261639
  misc_feature 1..38: note = hypo
  source 1..38: mol_type = genomic DNA
gccaggtgggctgggcggccgggcgggagctgggggtc

SEQ ID NO: 44480 - DNA, 133 bp, Homo sapiens
  misc_feature 1..133: note = chr16:1262013-1262146
  misc_feature 1..133: note = hypo
  source 1..133: mol_type = genomic DNA
cgtgctcaacatgttcgtgggcgtcgtggtcgagaacttccacaagtgccggcagcaccaggaggcggaggaggcgcggcggcgagaggagaagcggctgcggcgcctagagaggaggcgcaggagtaaggcg

SEQ ID NO: 44481 - DNA, 47 bp, Homo sapiens
  misc_feature 1..47: note = chr16:1262447-1262494
  misc_feature 1..47: note = hypo
  source 1..47: mol_type = genomic DNA
ggagggctccaggcccgagtgcgccacgccctcggccctcagaccat

SEQ ID NO: 44482 - DNA, 52 bp, Homo sapiens
  misc_feature 1..52: note = chr16:1265614-1265666
  misc_feature 1..52: note = hypo
  source 1..52: mol_type = genomic DNA
ctcagcgcaggcccccggaagacggggttgcagggagcgcctcgccgtcccc

SEQ ID NO: 44483 - DNA, 30 bp, Homo sapiens
  misc_feature 1..30: note = chr16:1267184-1267214
  misc_feature 1..30: note = hypo
  source 1..30: mol_type = genomic DNA
cgagtctcgtgttgacgcagaggcatgtgc

SEQ ID NO: 44484 - DNA, 577 bp, Homo sapiens
  misc_feature 1..577: note = chr16:1267961-1268538
  misc_feature 1..577: note = hypo
  source 1..577: mol_type = genomic DNA
caccttcagcaacttcggcatggccttcctcacgctgttccgcgtgtccacgggggacaactggaacgggatcatgaaggtacccgccgcggccatgcctctggcacctggcagccccagcggtttttcaggctctcccaggaacgggtcggatccgtccttgcagggcagggggaaggggacggcactgccagggtggcacccgcgggtgggtgtggaccccggcccacagctgtcccccaccgcaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgct

SEQ ID NO: 44485 - DNA, 150 bp, Homo sapiens
  misc_feature 1..150: note = chr16:1270207-1270357
  misc_feature 1..150: note = hypo
  source 1..150: mol_type = genomic DNA
ggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcaggg

SEQ ID NO: 44486 - DNA, 30 bp, Homo sapiens
  misc_feature 1..30: note = chr16:1271505-1271535
  misc_feature 1..30: note = hypo
  source 1..30: mol_type = genomic DNA
gggccttcccagaagcgtcctgtgactctg

SEQ ID NO: 44487 - DNA, 38 bp, Homo sapiens
  misc_feature 1..38: note = chr16:1272194-1272232
  misc_feature 1..38: note = hypo
  source 1..38: mol_type = genomic DNA
cctggcaggcatccccggggccccgggcacacagcatg

SEQ ID NO: 44488 - DNA, 30 bp, Homo sapiens
  misc_feature 1..30: note = chr16:1288468-1288498
  misc_feature 1..30: note = hypo
  source 1..30: mol_type = genomic DNA
agtaacacccaagagcgatgggcaatccct

SEQ ID NO: 44489 - DNA, 39 bp, Homo sapiens
  misc_feature 1..39: note = chr16:1307000-1307039
  misc_feature 1..39: note = hypo
  source 1..39: mol_type = genomic DNA
cggagaccttccccccggggatgccgtgctgggtcactg

SEQ ID NO: 44490 - DNA, 267 bp, Homo sapiens
  misc_feature 1..267: note = chr16:1312443-1312710
  misc_feature 1..267: note = hypo
  source 1..267: mol_type = genomic DNA
cccgaacatcctgatcgctccccagccagtcacccagcactggtccttcggggtgagctccagcgagaccggggagagcttgaccgtcctgacattagcggctcagatcatggggctcaccagctggagcagggccacatccgcacccagccccgcagtgacatagttggggtggacgatgatccggctgacgttcagcagcccccggcccccgtagagatacacgtccccagcgtggatccggtagatggacgggtcggtgtcctt

SEQ ID NO: 44491 - DNA, 133 bp, Homo sapiens
  misc_feature 1..133: note = chr16:1315371-1315504
  misc_feature 1..133: note = hypo
  source 1..133: mol_type = genomic DNA
gagggagtgggtccccgaggctgggcctgcagctgtgaaatcctctgcagccagacttccacctgcatgcccagccctgcacctccctgcatggggaggagagaagccccaggctgcccgagatggactccca

SEQ ID NO: 44492 - DNA, 44 bp, Homo sapiens
  misc_feature 1..44: note = chr16:1323678-1323722
  misc_feature 1..44: note = hypo
  source 1..44: mol_type = genomic DNA
ggactcacgtgtagacgccaatgctgggccgatcactgtaaaat

SEQ ID NO: 44493 - DNA, 127 bp, Homo sapiens
  misc_feature 1..127: note = chr16:1323976-1324103
  misc_feature 1..127: note = hypo
  source 1..127: mol_type = genomic DNA
caccaggaaaagcatcgtaggtctgccgctcacagtctgcattgctcagtgtgaggaccttcacctgctgcgggcggtaaggaggcggcagcatatctgcagagacaagccacgggtggcgggagca

SEQ ID NO: 44494 - DNA, 30 bp, Homo sapiens
  misc_feature 1..30: note = chr16:1329677-1329707
  misc_feature 1..30: note = hypo
  source 1..30: mol_type = genomic DNA
gacagctagctcatccgtgggctctgggaa

SEQ ID NO: 44495 - DNA, 191 bp, Homo sapiens
  misc_feature 1..191: note = chr16:1391751-1391942
  misc_feature 1..191: note = hypo
  source 1..191: mol_type = genomic DNA
tggactccctgaccccggcctgggcagagcctcgccggggaccctcatgggcatctctgttctccttgtagcgagattgaggatgtgagcacggaccagctgcacctggacatctggtacaggcccctgcgccatgcagggcggcggggatgcacaccttttgcgggggagcaggacggactcagggcccg

SEQ ID NO: 44496 - DNA, 30 bp, Homo sapiens
  misc_feature 1..30: note = chr16:1397121-1397151
  misc_feature 1..30: note = hypo
  source 1..30: mol_type = genomic DNA
gatggcctttccccacgcttcctgggagct

SEQ ID NO: 44497 - DNA, 311 bp, Homo sapiens
  misc_feature 1..311: note = chr16:1397548-1397859
  misc_feature 1..311: note = hypo
  source 1..311: mol_type = genomic DNA
ctgaaggaggagctgcggctgcacaaatgttccacccgcgagtgcatcgagcagttctacctggacaagctcaaacaggtagggaggcgccagggacagggtgctgcctccgaggctcccagagcccagctgcgctcacccgcctttccgcagaggaccctggagcagaaccggtttggacgcctgagcgtccgttgccattacgaggcggctgagcagcggctggccgtggaggtgctgcacgccgcggacctgctccccctggacgccaacggtgagttgcagcggggacgggtcgggtggtggtggga

SEQ ID NO: 44498 - DNA, 83 bp, Homo sapiens
  misc_feature 1..83: note = chr16:1407453-1407536
  misc_feature 1..83: note = hypo
  source 1..83: mol_type = genomic DNA
agtcacccagcacctcgtgtgtatttcgactttattattattattattattattattagagccgagtgtcgctgtgtcgccca

SEQ ID NO: 44499 - DNA, 142 bp, Homo sapiens
  misc_feature 1..142: note = chr16:1407776-1407918
  misc_feature 1..142: note = hypo
  source 1..142: mol_type = genomic DNA
gtgctgggatgacagtcatgagccaccgcgcctggcctcgactttattattaatacggtaaaactacagagagtttgaaacatcagtctggggcgtcctcctctaaccagtgcacttgctgctgcagcgcaggcccttcagg

SEQ ID NO: 44500 - DNA, 282 bp, Homo sapiens
  misc_feature 1..282: note = chr16:1417076-1417358
  misc_feature 1..282: note = hypo
  source 1..282: mol_type = genomic DNA
ccagagcaggactcacgccgtccaccgcctccaggtccaggcgcagctgactctgcagcgagtgcagcttcggcaggggaatggtgccgatgtccccacagccccgcagccccggcagtgtggaggctacgcccaggccctccagctcctcctgcagctgcttcacctgtgcctccacctcctccttcttctgcagcgccagctgccggtcgctatcggccacacgggcacgctccttggcctcctgcgcctctcgctgccaggcatcgcagacctgaaacc

SEQ ID NO: 44501 - DNA, 411 bp, Homo sapiens
  misc_feature 1..411: note = chr16:1417675-1418086
  misc_feature 1..411: note = hypo
  source 1..411: mol_type = genomic DNA
gactcctcccactgccggatcttcctcttggcctcgtccagctgccgcctgacccgggccagctcagctccgtttggacttgcactcgaagaggatggggggccggcactcaggatgggggaggggctgggggagaagctgccggaaacaaagtcccagatgctcccggggacaccgttcaaacctgagtgtgaaacggtcgatgacggcccagccctgctgtgctcgcggcctggtgggattggtgggtgctatgccccaggccccaccgctacgtgggcaccctctggggctcacctgccctggcagcaggggtgcagccacgcctgccccttgccccactcctggaccccaccaggctcaggaagaggcgctgacagtgacacctgccccggccggtctccccaccag

SEQ ID NO: 44502 - DNA, 200 bp, Homo sapiens
  misc_feature 1..200: note = chr16:1425484-1425684
  misc_feature 1..200: note = hypo
  source 1..200: mol_type = genomic DNA
tgtccttccccatcccgtcacagaggcagcagggcccagggcagagaacctgaacccctggggcgtccgggacggcacacggcgcatgcgggagtggcctccactcccacggagacaccgttccaatgaagcttttagggactttcgaaggtcttatccagaaactagagtaacaggttgggggtcggggcagccaggcc

SEQ ID NO: 44503 - DNA, 794 bp, Homo sapiens
  misc_feature 1..794: note = chr16:1428113-1428907
  misc_feature 1..794: note = hypo
  source 1..794: mol_type = genomic DNA
ccccagaaagctgctcggcctccaagccctgcatggaatgccccccactacatccttgcaggtgtcagcctgaaccatgtcagggccctggacagactcactgaggacaggcaccgaccccccaacccgcaggcctgcccacagccccctcatgctcccatacgggggcttgatgacgggcagggccaagcggtttgcccatagtcaggtcagccaggctcgggaacctggacctgccctctgcacccaagtcccaggatcaggatatggcagccccttcagagctcaccgcccctcacacctggcagagatccagaaactcctcatgaaaatcaaagacgcaaagaagttgggggacaggaacggaggcgccttttctccccttggagtggggtgatcccaccaggctccgtgctaagtcggcagaagcttcacccaccagctgcagagtgcgcagcatgtggaggggctaagctgccttcaatgctcacccgacaaactacggctcgcactcaactcagagggcgtcagccaccacctacctcagccaagtcacctgtgctgaagcccgggaagctgcctggagaggggacgttcagggagcgtgtgggtgcccccgagagactccggccccgcttcaaagccaagtgcccctcatccaaagagagcaccggagagggtcctggaggctccaccacccctagggtgctatctagggctcactcccagaaatcaaggggggagacggctgctgcaccgtcctggcccactttctcacccgcagcttctccccc

SEQ ID NO: 44504 - DNA, 48 bp, Homo sapiens
  misc_feature 1..48: note = chr16:1430200-1430248
  misc_feature 1..48: note = hypo
  source 1..48: mol_type = genomic DNA
cttaaatacagaatccgctcatttcttctattccgtgctccagtcaca

SEQ ID NO: 44505 - DNA, 30 bp, Homo sapiens; identical to SEQ ID NO: 15991
  misc_feature 1..30: note = chr16:1486627-1486657
  misc_feature 1..30: note = hypo
  source 1..30: mol_type = genomic DNA

SEQ ID NO: 44506 - DNA, 30 bp, Homo sapiens
  misc_feature 1..30: note = chr16:1488680-1488710
  misc_feature 1..30: note = hypo
  source 1..30: mol_type = genomic DNA
tggtcagctgggccacggcagcatccaggc

SEQ ID NO: 44507 - DNA, 82 bp, Homo sapiens
  misc_feature 1..82: note = chr16:1491115-1491197
  misc_feature 1..82: note = hypo
  source 1..82: mol_type = genomic DNA
tctcaaaacaaaaaacgagtgtcggcctggctttgctgcctctggccctagagagcactcagacacccggactcagggaaag

SEQ ID NO: 44508 - DNA, 30 bp, Homo sapiens
  misc_feature 1..30: note = chr16:1491482-1491512
  misc_feature 1..30: note = hypo
  source 1..30: mol_type = genomic DNA
cctccccacccacagcggaggcccctgctg

SEQ ID NO: 44509 - DNA, 101 bp, Homo sapiens
  misc_feature 1..101: note = chr16:1493574-1493675
  misc_feature 1..101: note = hypo
  source 1..101: mol_type = genomic DNA
agccctgcagctgcacgcgggcccgcacctggagcagctcccgcagcaggctccgcgtggcgcgctcacagcgctgcttgtgctcccgcaggcaggccacc

SEQ ID NO: 44510 - DNA, 120 bp, Homo sapiens
  misc_feature 1..120: note = chr16:1729690-1729810
  misc_feature 1..120: note = hypo
  source 1..120: mol_type = genomic DNA
ccgtctcaaaaaaaaaaaaaaccctttagatttgagggagttaggtcagtattcagtaatacttgtaaccaaataattacccgtggcagggtgcagtgactcaacggctgtaatcccggc

SEQ ID NO: 44511 - DNA, 455 bp, Homo sapiens
  misc_feature 1..455: note = chr16:1730306-1730761
  misc_feature 1..455: note = hypo
  source 1..455: mol_type = genomic DNA
tattatcaccctgagcgacgccgatgtttttatattgactttcacgctccagaagttagctgcacagggccgcactaaagtcatactcacactaccctgggggactggtttctggacaaggtgttgagaaagggagaaaactcttccttttaggatggtgaggaaggaaagccggtctgaactggatgatgaggtatcactggaagcttctgcttggggtccaccagacgctgcacatttgccactcatctgaacggggtcgagtcgcagggcgggcgccttgtaagcgtcacatttagttttgctgtgaagcgagtcaggtggtggctgtaagattacctagccaggttttcctctcctgagacctcacatctctcctttccttgctgagggattgtcttgtgttaaaggggtttcgtaaaagcgttatgctttagccgcgattaacctgaggt

SEQ ID NO: 44512 - DNA, 30 bp, Homo sapiens
  misc_feature 1..30: note = chr16:1734955-1734985
  misc_feature 1..30: note = hypo
  source 1..30: mol_type = genomic DNA
gcagaagtagtctggcgtctgtaaactagt

SEQ ID NO: 44513 - DNA, 353 bp, Homo sapiens
  misc_feature 1..353: note = chr16:1741726-1742079
  misc_feature 1..353: note = hypo
  source 1..353: mol_type = genomic DNA
ctcagggctggcactcggggttcctatgagaggaggtctccaaagcactgcgggggtggggtggggtggggtccggtggacgtctggttgctcagtgttctgtgatcgtttctgcagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagg

SEQ ID NO: 44514 - DNA, 262 bp, Homo sapiens
  misc_feature 1..262: note = chr16:1813482-1813744
  misc_feature 1..262: note = hypo
  source 1..262: mol_type = genomic DNA
ctgggcacccagtgccgggaaagccacccttcccagctgggcacccggtggccgggaaaaggcgaggatgggcccaggcgggcctccctgccgtgacctcccccaggacaagcctggggcactgtgggggccgctcaccctggacagagacatcacccatcattcttccactcagcgactgcacgtcctccgcccgtcgagagcagaagcgcgagcagtaccgccaggtgcgtgagcacgtgcgtaacgacgacggccgtct

SEQ ID NO: 44515 - DNA, 55 bp, Homo sapiens
  misc_feature 1..55: note = chr16:1813946-1814001
  misc_feature 1..55: note = hypo
  source 1..55: mol_type = genomic DNA
aggggtctggagggtcggagaaggagccccgcggctcccacgcccccacctgcct

SEQ ID NO: 44516 - DNA, 48 bp, Homo sapiens
  misc_feature 1..48: note = chr16:1814297-1814345
  misc_feature 1..48: note = hypo
  source 1..48: mol_type = genomic DNA
gcagctgtggtgtgccgcgggcgtcaacctgagcgggtggaggcccaa

SEQ ID NO: 44517 - DNA, 30 bp, Homo sapiens
  misc_feature 1..30: note = chr16:1831357-1831387
  misc_feature 1..30: note = hypo
  source 1..30: mol_type = genomic DNA
cctgcccatcagagtcgtagccccagttag

SEQ ID NO: 44518 - DNA, 39 bp, Homo sapiens
  misc_feature 1..39: note = chr16:1833960-1833999
  misc_feature 1..39: note = hypo
  source 1..39: mol_type = genomic DNA
tgggattacaggcgtgagccacggcgcctggcccagtgc

SEQ ID NO: 44519 - DNA, 30 bp, Homo sapiens
  misc_feature 1..30: note = chr16:1946973-1947003
  misc_feature 1..30: note = hypo
  source 1..30: mol_type = genomic DNA
gttataattggctcccgccagccctgtctc

SEQ ID NO: 44520 - DNA, 30 bp, Homo sapiens
  misc_feature 1..30: note = chr16:1962525-1962555
  misc_feature 1..30: note = hypo
  source 1..30: mol_type = genomic DNA
ctgtgcaatccctgccgtcctcgcttccag

SEQ ID NO: 44521 - DNA, 96 bp, Homo sapiens
  misc_feature 1..96: note = chr16:2028658-2028754
  misc_feature 1..96: note = hypo
  source 1..96: mol_type = genomic DNA
ggaaacccataaaggcgcactgccctagccggtccggcctctctccagtccatcctgaacccctggaaaacccataaaggccgctctcctggccgg

SEQ ID NO: 44522 - DNA, 225 bp, Homo sapiens
  misc_feature 1..225: note = chr16:2028972-2029197
  misc_feature 1..225: note = hypo
  source 1..225: mol_type = genomic DNA
ctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtg

SEQ ID NO: 44523 - DNA, 200 bp, Homo sapiens
  misc_feature 1..200: note = chr16:2105061-2105261
  misc_feature 1..200: note = hypo
  source 1..200: mol_type = genomic DNA
gctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtg

SEQ ID NO: 44524 - DNA, 119 bp, Homo sapiens
  misc_feature 1..119: note = chr16:2129118-2129237
  misc_feature 1..119: note = hypo
  source 1..119: mol_type = genomic DNA
tccacctggagctcacggaaacctgtctggacatgatggctcgatacgtcttctccaacttcacggctgtcccgaagaggtccaggcggcactacagggctgggcgggcctgcgggagc

SEQ ID NO: 44525 - DNA, 102 bp, Homo sapiens
  misc_feature 1..102: note = chr16:2145625-2145727
  misc_feature 1..102: note = hypo
  source 1..102: mol_type = genomic DNA
aaaggagccacgggacgcgctggaggctgcagtgaggaaggacgcagaggggtccaggacaaacccaagcctccgacctggtcagcccgaagcactgtccga

SEQ ID NO: 44526 - DNA, 30 bp, Homo sapiens
  misc_feature 1..30: note = chr16:2146363-2146393
  misc_feature 1..30: note = hypo
  source 1..30: mol_type = genomic DNA
gggcatggcagagcccggggtcacacgcgt

SEQ ID NO: 44527 - DNA, 23 bp, Homo sapiens
  misc_feature 1..23: note = chr16:2151275-2151298
  misc_feature 1..23: note = hypo
  source 1..23: mol_type = genomic DNA
cgcccggccgacagtttttaaaa

SEQ ID NO: 44528 - DNA, 112 bp, Homo sapiens
  misc_feature 1..112: note = chr16:2193270-2193382
  misc_feature 1..112: note = hypo
  source 1..112: mol_type = genomic DNA
gatccctgcacctgccgtgaggccatgtgtgtcactctgaggctgccgggagagcctgcagccaggagccctgatgctgcctcctccaatggctaagcggacaccctcactc

SEQ ID NO: 44529 - DNA, 142 bp, Homo sapiens
  misc_feature 1..142: note = chr16:2212716-2212858
  misc_feature 1..142: note = hypo
  source 1..142: mol_type = genomic DNA
cctcatggggtgctgcgcatgggcctcgaggtggacagtgcaggtgggcccggggcaggagtcctgggcacgtggccttcctccccacagggagctcagcttcaagccggggctcggctgcgctatccgctgccagcaggag

SEQ ID NO: 44530 - DNA, 52 bp, Homo sapiens
  misc_feature 1..52: note = chr16:2213671-2213723
  misc_feature 1..52: note = hypo
  source 1..52: mol_type = genomic DNA
agccgcctgcctgcccgggcctctgcatacctgggatcggggtgaaggacct

SEQ ID NO: 44531 - DNA, 30 bp, Homo sapiens
  misc_feature 1..30: note = chr16:2229690-2229720
  misc_feature 1..30: note = hypo
  source 1..30: mol_type = genomic DNA
gacaggcggcttggccggcttccgggcttc

SEQ ID NO: 44532 - DNA, 231 bp, Homo sapiens
  misc_feature 1..231: note = chr16:2229967-2230198
  misc_feature 1..231: note = hypo
  source 1..231: mol_type = genomic DNA
tggttctgcttggcccggatgcgcctcttgagtgtggcgctggcttccaccttggccaagggcgggccttcgacacccgcctcgcccttggagggaccccgaggccgctgccggccagtgccatcctccacaaaggggcctgggtctgccgactccccaggcccccggcgggcagtggccagaagtccggtgactggcccgctgagcgtgcggcgccggttcaccacctcc

SEQ ID NO: 44533 - DNA, 605 bp, Homo sapiens
  misc_feature 1..605: note = chr16:2230512-2231117
  misc_feature 1..605: note = hypo
  source 1..605: mol_type = genomic DNA
gcgcttgggtgggggcggcgggggccccttctttcggggccgcacggcaaaggactggctgcggttgacgttcttgtcggcacctgcgggcgccctcactgagtggctgcggcccacgcgccgctggaccgtggcataggggccggcagccgcaggcaccagcagctcgtcccgctccggctcgctgtcggacgccgcatagcgattcaggctgtgggcccgcttcttgggccgccccggctccgcgtcggcctcagggggcaggcacagtgtgggcacagccgtcggcacgggtgggggcgcaggccccggggcagccggccccacctcgccctccacgggctggggcagcacgtaggcaaagccgcggtgcgtcggtgactgaggcagggagcggggtgacatggggcgctctgtcggcggcagcagctgcggggtgggcttcaccttggccgtagctggggctggaccatgaggtcccccaagggcctggggagagcctggtcgggttttggtgggcgtctgggggggcgtgaagtggctagtgcctggtgggaggacctgccgtggcttgccaggcacggggggcacgctggccctcttga

SEQ ID NO: 44534 - DNA, 81 bp, Homo sapiens
  misc_feature 1..81: note = chr16:2232745-2232826
  misc_feature 1..81: note = hypo
  source 1..81: mol_type = genomic DNA
caccttcttcaggcccggaacccatcccactgcacaggcacctccctgttgttttgctttgtttgagacggagcctcgctc

SEQ ID NO: 44535 - DNA, 141 bp, Homo sapiens
  misc_feature 1..141: note = chr16:2233066-2233207
  misc_feature 1..141: note = hypo
  source 1..141: mol_type = genomic DNA
cgtgagccaccgcgcccggccgcacctccgtgttaatgacgattggccatggcgtgtgcaggtatcgctgagaatgggggtgtcagctattggtgagggccacacgtgcggtggagcatgtgtgcacgcacacaagctggt

SEQ ID NO: 44536 - DNA, 725 bp, Homo sapiens
  misc_feature 1..725: note = chr16:2234314-2235039
  misc_feature 1..725: note = hypo
  source 1..725: mol_type = genomic DNA
ggcctcgggctggaccggaaggtgggctctgtgcccacaggcaggggcaccttgcctcctccaccgtgcaggactcagccagcagcttacagctctccggcacacgagtgcactcacacaccatacgccgtgcccatgcacacgctgcaccatctcatacccatccccttccacctgtacacagacacgcgtgcccagctcgcagtcccaccatcacacacacacacgcacacacagaggcacaggttggcccacacgcacagcctgcacaatgacgacacccgtacacacaggcagacacacacacaacacacagactgacagacagaggagagggtctggcctggcaatgcccccgaccccgccgctgccaggccaggcaggccgtgtaagcacccatcagcccatcggccttacagcctctccccggagcccacgctgagaacacccccaagccctgtaccttgccctccgatgctggctccagcttcttgggcggctgctccccatagacctgcccggcgtgggccactggaggctgggaccgggccacacctgaggacgagagtgggtgggggacaagggctgtcgggctgctttcctccatcgggctgcgtggcagcacccttgctcttacctgcagagccttccggaggcttggcggggctgtcccccgggccggactcagagacggacttctgggaaagcaccgttgccaggagctg

SEQ ID NO: 44537 - DNA, 51 bp, Homo sapiens
  misc_feature 1..51: note = chr16:2237472-2237523
  misc_feature 1..51: note = hypo
  source 1..51: mol_type = genomic DNA
ggcaaggtggacaggcggggccttccagcaggaggccggccccagcacccc

SEQ ID NO: 44538 - DNA, 387 bp, Homo sapiens
  misc_feature 1..387: note = chr16:2278383-2278770
  misc_feature 1..387: note = hypo
  source 1..387: mol_type = genomic DNA
gtgcacagatgcggccgctgccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggc

SEQ ID NO: 44539 - DNA, 30 bp, Homo sapiens
  misc_feature 1..30: note = chr16:2281284-2281314
  misc_feature 1..30: note = hypo
  source 1..30: mol_type = genomic DNA
cgtctcctctggcctcgcagcagccatgtt

SEQ ID NO: 44540 - DNA, 33 bp, Homo sapiens
  misc_feature 1..33: note = chr16:2294623-2294656
  misc_feature 1..33: note = hypo
  source 1..33: mol_type = genomic DNA
gggagcccaggtgcacgacgcacagcagggcca

SEQ ID NO: 44541 - DNA, 30 bp, Homo sapiens
  misc_feature 1..30: note = chr16:2324195-2324225
  misc_feature 1..30: note = hypo
  source 1..30: mol_type = genomic DNA
cagcctcctgagctgcggatcattttccta

SEQ ID NO: 44542 - DNA, 30 bp, Homo sapiens
  misc_feature 1..30: note = chr16:2436229-2436259
  misc_feature 1..30: note = hypo
  source 1..30: mol_type = genomic DNA
cggcatcgccctcatcgcaggctccaaggt

SEQ ID NO: 44543 - DNA, 34 bp, Homo sapiens; identical to SEQ ID NO: 16004
  misc_feature 1..34: note = chr16:2466336-2466370
  misc_feature 1..34: note = hypo
  source 1..34: mol_type = genomic DNA

SEQ ID NO: 44544 - DNA, 56 bp, Homo sapiens
  misc_feature 1..56: note = chr16:2474253-2474309
  misc_feature 1..56: note = hypo
  source 1..56: mol_type = genomic DNA
gaccccgtggcccggcgcctgttctggaatgctgtggcacacgcccacgagtctgg

SEQ ID NO: 44545 - DNA, 174 bp, Homo sapiens
  misc_feature 1..174: note = chr16:2497879-2498053
  misc_feature 1..174: note = hypo
  source 1..174: mol_type = genomic DNA
cgtctgcagcccccacgctggcaggtgtagtccctgcgcctcttgtcctcttggtcaagtgaatgacgcatgcaacctgcagagtccccaggacagagcagccaagggacttggcctcagtccaaggggaaggtgccttgcggggggccgctggagcagcgtgttccctgatag

SEQ ID NO: 44546 - DNA, 16 bp, Homo sapiens
  misc_feature 1..16: note = chr16:2508540-2508556
  misc_feature 1..16: note = hypo
  source 1..16: mol_type = genomic DNA
gcgcctggcccccaaa

SEQ ID NO: 44547 - DNA, 59 bp, Homo sapiens
  misc_feature 1..59: note = chr16:2531804-2531863
  misc_feature 1..59: note = hypo
  source 1..59: mol_type = genomic DNA
agccacagttaggcacgtttgcacttccaaccatcacaggcaggcgggccaaccggccc

SEQ ID NO: 44548 - DNA, 37 bp, Homo sapiens; identical to SEQ ID NO: 16006
  misc_feature 1..37: note = chr16:2540828-2540865
  misc_feature 1..37: note = hypo
  source 1..37: mol_type = genomic DNA

SEQ ID NO: 44549 - DNA, 48 bp, Homo sapiens
  misc_feature 1..48: note = chr16:2546458-2546506
  misc_feature 1..48: note = hypo
  source 1..48: mol_type = genomic DNA
tactgcctgaatgcacgcggcgagggggccgtgcgcaagatcctcctg

SEQ ID NO: 44550 - DNA, 76 bp, Homo sapiens
  misc_feature 1..76: note = chr16:2589044-2589120
  misc_feature 1..76: note = hypo
  source 1..76: mol_type = genomic DNA
aaatttaattgatcccgtgtcttccaggatgcggcttttttttttttttttttttgatggagtctccctctcgacg

SEQ ID NO: 44551 - DNA, 120 bp, Homo sapiens
  misc_feature 1..120: note = chr16:2731629-2731749
  misc_feature 1..120: note = hypo
  source 1..120: mol_type = genomic DNA
tatttgtattgaattcatgttcggggccacgttgttatatgtattgatatacagccttgaatgtgaataattactatatattttacaacttttttctggctttattacaaaaactttctt

SEQ ID NO: 44552 - DNA, 82 bp, Homo sapiens
  misc_feature 1..82: note = chr16:2762758-2762840
  misc_feature 1..82: note = hypo
  source 1..82: mol_type = genomic DNA
ccccgcctgcagccacgactgacccacgaggcacaccagggggccgcccgagtcgccctgcgggggacgcagagtcaccgtc

SEQ ID NO: 44553 - DNA, 598 bp, Homo sapiens
  misc_feature 1..598: note = chr16:2764111-2764709
  misc_feature 1..598: note = hypo
  source 1..598: mol_type = genomic DNA
cgtctcaaagatcaccgaggggtcaggcaggcacacggggaggatgtaattggtgaagggcactggtgcctccagctccaccagggccacgtcagcgctggaggccgtgccctggtacagggggttgctctccacctgcctcacccgggcatacatagcgtgtggtcccggctgcactagctgccttgcccccagcaggacctggtacagggacgtctcagaggtgctggcgggagaaacagagaggcggcgtgaggcggcccctcgtgtggggacaggcccgggaggggctggggctcctctggccaccaccgtgccccacacctctctctgcacaatgtcttcgagagtcatctctaggacagccaggtgcagcggtgatgcgtgttgacattgaagccagaccgcccgactcagatttccacctccacccctggccgctgtgtggccttgggcaagtcacttaacaagttctctgtgatgcagctttctcacctgtgctgtggggacagtcacagtgcctacctgaaaggctggctcggagagaaccaccctccaggtgcagcagggccagccccacctgcgggcctctggcagg

SEQ ID NO: 44554 - DNA, 399 bp, Homo sapiens
  misc_feature 1..399: note = chr16:2770122-2770521
  misc_feature 1..399: note = hypo
  source 1..399: mol_type = genomic DNA
cagcagcagcaggagcggcaccgccgccggccgcctcatgtcctcaggcctggctggggcgcagggccgtggtcggcggtggcagaagcgttggagcacgagcgaggtgcaggctccatgaagtggagttttatgctggagatgagcacaggcccggctatgcggcccaacccgtcggcccggcctgcccagctcctctcctcaggaaggaagcgcccagagccgactcctccgtgacctagccctgaaccccgagaccccagggcagacccctcaccccagcgcagcacggggtgccgttggcctcggttcctggaccctgagctgacccagaccccccagcagaccccgagctgaccgcggtgcacgcgaagtccgtccagcttcattcattattat

SEQ ID NO: 44555 - DNA, 133 bp, Homo sapiens
  misc_feature 1..133: note = chr16:2806261-2806394
  misc_feature 1..133: note = hypo
  source 1..133: mol_type = genomic DNA
gacttgggtgtggggcggtaagtggttagtttggggccaggggcctgacccgtgtctccccgctccccctcaggagcggtggtgccccccccgggcacggggccatgtacaacgggatcgggctgccgacgcc

SEQ ID NO: 44556 - DNA, 30 bp, Homo sapiens
  misc_feature 1..30: note = chr16:2849391-2849421
  misc_feature 1..30: note = hypo
  source 1..30: mol_type = genomic DNA
cattgtgaaccctgacgcacttggggtttt

SEQ ID NO: 44557 - DNA, 30 bp, Homo sapiens; identical to SEQ ID NO: 16011
  misc_feature 1..30: note = chr16:2877506-2877536
  misc_feature 1..30: note = hypo
  source 1..30: mol_type = genomic DNA

SEQ ID NO: 44558 - DNA, 138 bp, Homo sapiens
  misc_feature 1..138: note = chr16:2975835-2975973
  misc_feature 1..138: note = hypo
  source 1..138: mol_type = genomic DNA
cgttgtctccggagccgaccaggccttcgggagtggaatgtggggccccaggccagggaactttggatcaaagtgggagaccagtgggaactggagctgcagcatgtgaggtgggggtgaggacgctgaaaatgtcag

SEQ ID NO: 44559 - DNA, 34 bp, Homo sapiens
  misc_feature 1..34: note = chr16:3021547-3021581
  misc_feature 1..34: note = hypo
  source 1..34: mol_type = genomic DNA
tgcaggccctggctgcgcccggctgccctggtgg

SEQ ID NO: 44560 - DNA, 30 bp, Homo sapiens
  misc_feature 1..30: note = chr16:3139240-3139270
  misc_feature 1..30: note = hypo
  source 1..30: mol_type = genomic DNA
tcttcccgcactccacgcactcctgcgggg

SEQ ID NO: 44561 - DNA, 30 bp, Homo sapiens
  misc_feature 1..30: note = chr16:3142599-3142629
  misc_feature 1..30: note = hypo
  source 1..30: mol_type = genomic DNA
ctccccatccctgagcggctgcccctgcag

SEQ ID NO: 44562 - DNA, 30 bp, Homo sapiens
  misc_feature 1..30: note = chr16:3151067-3151097
  misc_feature 1..30: note = hypo
  source 1..30: mol_type = genomic DNA
tcagggactggcctccgtgtagagctgctc

SEQ ID NO: 44563 - DNA, 37 bp, Homo sapiens
  misc_feature 1..37: note = chr16:3211673-3211710
  misc_feature 1..37: note = hypo
  source 1..37: mol_type = genomic DNA
acctccctcagctcccgtggtgcgcccgggggaaatg

SEQ ID NO: 44564 - DNA, 120 bp, Homo sapiens
  misc_feature 1..120: note = chr16:3211830-3211950
  misc_feature 1..120: note = hypo
  source 1..120: mol_type = genomic DNA
aaaccccacctctgcaaaacaattttaaaagttagcagggcgtggtggtgcgcgcctgtgatccaagctactcctgtgtctgaggcaggaggatcgcttgagcctgtctcaaataaacaa

SEQ ID NO: 44565 - DNA, 30 bp, Homo sapiens
  misc_feature 1..30: note = chr16:3286293-3286323
  misc_feature 1..30: note = hypo
  source 1..30: mol_type = genomic DNA
gcactgatcagggttcggacaacttgtggg

SEQ ID NO: 44566 - DNA, 86 bp, Homo sapiens
  misc_feature 1..86: note = chr16:3492669-3492755
  misc_feature 1..86: note = hypo
  source 1..86: mol_type = genomic DNA
gtatcaaaaaaaaaaaaaaaagaacttttaaaagtagccagacactgtggtatgcgcgcctctcagatactcgagaggctgaggcg

SEQ ID NO: 44567 - DNA, 33 bp, Homo sapiens; identical to SEQ ID NO: 16015
  misc_feature 1..33: note = chr16:3598920-3598953
  misc_feature 1..33: note = hypo
  source 1..33: mol_type = genomic DNA

SEQ ID NO: 44568 - DNA, 108 bp, Homo sapiens
  misc_feature 1..108: note = chr16:3696694-3696802
  misc_feature 1..108: note = hypo
  source 1..108: mol_type = genomic DNA
ctaattacacatttgcgagatgttctgagagctgtggggacggctgggacatgtacctggaagcagggcagccaaagggagaggcagtgatgacgggtggtatggagg

SEQ ID NO: 44569 - DNA, 30 bp, Homo sapiens
  misc_feature 1..30: note = chr16:3925449-3925479
  misc_feature 1..30: note = hypo
  source 1..30: mol_type = genomic DNA
agcccacacacgtcacgctgaggataacac

SEQ ID NO: 44570 - DNA, 37 bp, Homo sapiens; identical to SEQ ID NO: 16016
  misc_feature 1..37: note = chr16:3957870-3957907
  misc_feature 1..37: note = hypo
  source 1..37: mol_type = genomic DNA

SEQ ID NO: 44571 - DNA, 76 bp, Homo sapiens
  misc_feature 1..76: note = chr16:4203919-4203995
  misc_feature 1..76: note = hypo
  source 1..76: mol_type = genomic DNA
tctcaaaaaaaaaaaaaaaaaaagaactgatcaatgagccgccagatgccgagcaccacaccggcaagggctgcgg

SEQ ID NO: 44572 - DNA, 30 bp, Homo sapiens
  misc_feature 1..30: note = chr16:4264664-4264694
  misc_feature 1..30: note = hypo
  source 1..30: mol_type = genomic DNA
cgtggaccgggcaaacgtgggccagcagcc

SEQ ID NO: 44573 - DNA, 30 bp, Homo sapiens
  misc_feature 1..30: note = chr16:4308074-4308104
  misc_feature 1..30: note = hypo
  source 1..30: mol_type = genomic DNA
cccgacggctcctcccggctctggtccatg

SEQ ID NO: 44574 - DNA, 34 bp, Homo sapiens
  misc_feature 1..34: note = chr16:4385394-4385428
  misc_feature 1..34: note = hypo
  source 1..34: mol_type = genomic DNA
gtaagaggccggggccgggcggcttggcccatga

SEQ ID NO: 44575 - DNA, 66 bp, Homo sapiens
  misc_feature 1..66: note = chr16:4410920-4410986
  misc_feature 1..66: note = hypo
  source 1..66: mol_type = genomic DNA
ccccacctctgcagccgtcctacctggtcttggtggccctgcagcttcagccgatcagctccagcc

SEQ ID NO: 44576 - DNA, 30 bp, Homo sapiens
  misc_feature 1..30: note = chr16:4474675-4474705
  misc_feature 1..30: note = hypo
  source 1..30: mol_type = genomic DNA
tgacacacttttcatcgatgttcagtttga

SEQ ID NO: 44577 - DNA, 30 bp, Homo sapiens
  misc_feature 1..30: note = chr16:4655417-4655447
  misc_feature 1..30: note = hypo
  source 1..30: mol_type = genomic DNA
tgtaagatgcccctgcgaccaagggctcca

SEQ ID NO: 44578 - DNA, 30 bp, Homo sapiens; identical to SEQ ID NO: 16018
  misc_feature 1..30: note = chr16:4840446-4840476
  misc_feature 1..30: note = hypo
  source 1..30: mol_type = genomic DNA

SEQ ID NO: 44579 - DNA, 84 bp, Homo sapiens
  misc_feature 1..84: note = chr16:4841600-4841684
  misc_feature 1..84: note = hypo
  source 1..84: mol_type = genomic DNA
agaagtctgactcaccggaaccactccctgccacagcctcctcctcctgttactgtcctgcctgggactgggcggggctctgtg

SEQ ID NO: 44580 - DNA, 223 bp, Homo sapiens
  misc_feature 1..223: note = chr16:4846233-4846456
  misc_feature 1..223: note = hypo
  source 1..223: mol_type = genomic DNA
cctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcac

SEQ ID NO: 44581 - DNA, 44 bp, Homo sapiens
  misc_feature 1..44: note = chr16:4846780-4846824
  misc_feature 1..44: note = hypo
  source 1..44: mol_type = genomic DNA
ggcttcttggcagcccgagggtcccctctcgacagtaggttctg

SEQ ID NO: 44582 - DNA, 30 bp, Homo sapiens
  misc_feature 1..30: note = chr16:5090604-5090634
  misc_feature 1..30: note = hypo
  source 1..30: mol_type = genomic DNA
ccttgagccgggagccggaaggaatgcact

SEQ ID NO: 44583 - DNA, 30 bp, Homo sapiens
  misc_feature 1..30: note = chr16:5115567-5115597
  misc_feature 1..30: note = hypo
  source 1..30: mol_type = genomic DNA
ctctctccttatagccgaggcaggctatac

SEQ ID NO: 44584 - DNA, 30 bp, Homo sapiens
  misc_feature 1..30: note = chr16:5130557-5130587
  misc_feature 1..30: note = hypo
  source 1..30: mol_type = genomic DNA
gagtggtttggaacccgcgccatatgctct

SEQ ID NO: 44585 - DNA, 41 bp, Homo sapiens
  misc_feature 1..41: note = chr16:5412627-5412668
  misc_feature 1..41: note = hypo
  source 1..41: mol_type = genomic DNA
gctgggattgcaggcgtgagccaccgcgccaggccacatca

SEQ ID NO: 44586 - DNA, 30 bp, Homo sapiens; identical to SEQ ID NO: 16020
  misc_feature 1..30: note = chr16:5439313-5439343
  misc_feature 1..30: note = hypo
  source 1..30: mol_type = genomic DNA

SEQ ID NO: 44587 - DNA, 141 bp, Homo sapiens
  misc_feature 1..141: note = chr16:5541176-5541317
  misc_feature 1..141: note = hypo
  source 1..141: mol_type = genomic DNA
caaaaaagcaatcaacgcaagagtacagctggatgaattgtcacagtgtgaacacatctaggacgccagcacccacttgaagaactggaatattaccagccaccccgagccacccacctagcgactcggcagccaccctcc

SEQ ID NO: 44588 - DNA, 152 bp, Homo sapiens
  misc_feature 1..152: note = chr16:5559744-5559896
  misc_feature 1..152: note = hypo
  source 1..152: mol_type = genomic DNA
taaggccaagatgggcgcatacacaggggagtggatggacccaggaggtactcttggaggcaaagttgacagggcttagtgatgggtatataagtaagggagtgcggggtgtcccagatggtgcccaagaaccttggcgcagacgagtggag

SEQ ID NO: 44589 - DNA, 30 bp, Homo sapiens
  misc_feature 1..30: note = chr16:6186354-6186384
  misc_feature 1..30: note = hypo
  source 1..30: mol_type = genomic DNA
gccgtattccagatacgtgtgagccatatg

SEQ ID NO: 44590 - DNA, 30 bp, Homo sapiens
  misc_feature 1..30: note = chr16:6314961-6314991
  misc_feature 1..30: note = hypo
  source 1..30: mol_type = genomic DNA
tctgataagagcaaacgcttgacacccaac

SEQ ID NO: 44591 - DNA, 161 bp, Homo sapiens
  misc_feature 1..161: note = chr16:7489023-7489184
  misc_feature 1..161: note = hypo
  source 1..161: mol_type = genomic DNA
ttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttc

SEQ ID NO: 44592 - DNA, 34 bp, Homo sapiens
  misc_feature 1..34: note = chr16:8222706-8222740
  misc_feature 1..34: note = hypo
  source 1..34: mol_type = genomic DNA
aagtggctaggctcacggccgccttccaacttta

SEQ ID NO: 44593 - DNA, 147 bp, Homo sapiens
  misc_feature 1..147: note = chr16:8781004-8781151
  misc_feature 1..147: note = hypo
  source 1..147: mol_type = genomic DNA
ggacgcacatctggacggaaagtgtttgccgagagcacttggccgcctgccctcccacggagcaggtgctagtcttgggtcccgctcttccgggttcttcagaagctgagctccggtctgtaatcccagcactttgggaggctgagg

SEQ ID NO: 44594 - DNA, 30 bp, Homo sapiens; identical to SEQ ID NO: 16022
  misc_feature 1..30: note = chr16:8870353-8870383
  misc_feature 1..30: note = hypo
  source 1..30: mol_type = genomic DNA

SEQ ID NO: 44595 - DNA, 29 bp, Homo sapiens
  misc_feature 1..29: note = chr16:8963909-8963938
  misc_feature 1..29: note = hypo
  source 1..29: mol_type = genomic DNA
gggtgcggtggctcacgcctgtaattcca

SEQ ID NO: 44596 - DNA, 76 bp, Homo sapiens; identical to SEQ ID NO: 16023
  misc_feature 1..76: note = chr16:9005728-9005804
  misc_feature 1..76: note = hypo
  source 1..76: mol_type = genomic DNA

SEQ ID NO: 44597 - DNA, 30 bp, Homo sapiens; identical to SEQ ID NO: 16024
  misc_feature 1..30: note = chr16:9010029-9010059
  misc_feature 1..30: note = hypo
  source 1..30: mol_type = genomic DNA

SEQ ID NO: 44598 - DNA, 208 bp, Homo sapiens
  misc_feature 1..208: note = chr16:9888740-9888948
  misc_feature 1..208: note = hypo
  source 1..208: mol_type = genomic DNA
tactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaac

SEQ ID NO: 44599 - DNA, 47 bp, Homo sapiens
  misc_feature 1..47: note = chr16:10721519-10721566
  misc_feature 1..47: note = hypo
  source 1..47: mol_type = genomic DNA
tgttggccttgatggcgagctcgtgctccagccggcacttggtcatg

SEQ ID NO: 44600 - DNA, 30 bp, Homo sapiens; identical to SEQ ID NO: 16025
  misc_feature 1..30: note = chr16:10804588-10804618
  misc_feature 1..30: note = hypo
  source 1..30: mol_type = genomic DNA

SEQ ID NO: 44601 - DNA, 30 bp, Homo sapiens
  misc_feature 1..30: note = chr16:11712101-11712131
  misc_feature 1..30: note = hypo
  source 1..30: mol_type = genomic DNA
ttggaagagacattccgttctgccactgtg

SEQ ID NO: 44602 - DNA, 20 bp, Homo sapiens
  misc_feature 1..20: note = chr16:11808484-11808504
  misc_feature 1..20: note = hypo
  source 1..20: mol_type = genomic DNA
gactccgtctcaaaaaaaaa

SEQ ID NO: 44603 - DNA, 42 bp, Homo sapiens
  misc_feature 1..42: note = chr16:11853669-11853711
  misc_feature 1..42: note = hypo
  source 1..42: mol_type = genomic DNA
taagaaaaaaggtcccgggccgggcacggtggctcacgcctg

SEQ ID NO: 44604 - DNA, 33 bp, Homo sapiens
  misc_feature 1..33: note = chr16:12012098-12012131
  misc_feature 1..33: note = hypo
  source 1..33: mol_type = genomic DNA
ggtgtgagccaccacacccggcagagtttgcct

SEQ ID NO: 44605 - DNA, 27 bp, Homo sapiens
  misc_feature 1..27: note = chr16:13064659-13064686
  misc_feature 1..27: note = hypo
  source 1..27: mol_type = genomic DNA
tgtgagccaccgcgcctggccggggca

SEQ ID NO: 44606 - DNA, 147 bp, Homo sapiens
  misc_feature 1..147: note = chr16:13676585-13676732
  misc_feature 1..147: note = hypo
  source 1..147: mol_type = genomic DNA
atttgtttatattctaactacagccccagaaagatagtcatcattaatccctactttacagaggaggaacccggggcttagagaagggaattgaactgcccaggctcatattgctaggagttagccaagctgcgtatgaaacgacta

SEQ ID NO: 44607 - DNA, 32 bp, Homo sapiens
  misc_feature 1..32: note = chr16:14464204-14464236
  misc_feature 1..32: note = hypo
  source 1..32: mol_type = genomic DNA
ccaggctgggcgtggcgcgccaagcagcaggc

SEQ ID NO: 44608 - DNA, 21 bp, Homo sapiens
  misc_feature 1..21: note = chr16:14724506-14724527
  misc_feature 1..21: note = hypo
  source 1..21: mol_type = genomic DNA
aatgggatccgggtgcggtgg

SEQ ID NO: 44609 - DNA, 85 bp, Homo sapiens
  misc_feature 1..85: note = chr16:14725771-14725856
  misc_feature 1..85: note = hypo
  source 1..85: mol_type = genomic DNA
tgaactgggaagcagcgtattaataaatctgtataaataactgtttaatgggggcctggcgccatgactcacacctgtaatccca

SEQ ID NO: 44610 - DNA, 30 bp, Homo sapiens
  misc_feature 1..30: note = chr16:14728494-14728524
  misc_feature 1..30: note = hypo
  source 1..30: mol_type = genomic DNA
ggcaacatagggagacgctgtctcttaaaa

SEQ ID NO: 44611 - DNA, 48 bp, Homo sapiens
  misc_feature 1..48: note = chr16:14761842-14761890
  misc_feature 1..48: note = hypo
  source 1..48: mol_type = genomic DNA
agcctgtgggtggcacgagcaaggactgacatccgcacagggaggatt

SEQ ID NO: 44612 - DNA, 30 bp, Homo sapiens
  misc_feature 1..30: note = chr16:15052961-15052991
  misc_feature 1..30: note = hypo
  source 1..30: mol_type = genomic DNA
taaattacttcattacgttgatgcttcatc

SEQ ID NO: 44613 - DNA, 106 bp, Homo sapiens
  misc_feature 1..106: note = chr16:15241283-15241389
  misc_feature 1..106: note = hypo
  source 1..106: mol_type = genomic DNA
gcaaccctgcagtgccgtgatgagctatggagagacaagaacacagagggctcagcgcagggcccggcgtggccaccgcggggagagggtgcggactcttcctaga

SEQ ID NO: 44614 - DNA, 30 bp, Homo sapiens
  misc_feature 1..30: note = chr16:15555102-15555132
  misc_feature 1..30: note = hypo
  source 1..30: mol_type = genomic DNA
cactcctggcaggagcgacccccgggctca

SEQ ID NO: 44615 - DNA, 80 bp, Homo sapiens
  misc_feature 1..80: note = chr16:15595921-15596001
  misc_feature 1..80: note = hypo
  source 1..80: mol_type = genomic DNA
ggttagggcatttgccgaggtcggccgttagaaagatgccggaccatctactcatgtctgcttgacgccaatgcctgcgt

SEQ ID NO: 44616 - DNA, 42 bp, Homo sapiens
  misc_feature 1..42: note = chr16:15604294-15604336
  misc_feature 1..42: note = hypo
  source 1..42: mol_type = genomic DNA
tgggcagagcaggtgcggcggtcataacgagggcaattgcaa

SEQ ID NO: 44617 - DNA, 47 bp, Homo sapiens
  misc_feature 1..47: note = chr16:15692124-15692171
  misc_feature 1..47: note = hypo
  source 1..47: mol_type = genomic DNA
gctgcctttattccacggctctcacctggagccgtggtaagagttaa

SEQ ID NO: 44618 - DNA, 22 bp, Homo sapiens
  misc_feature 1..22: note = chr16:15708051-15708073
  misc_feature 1..22: note = hypo
  source 1..22: mol_type = genomic DNA
agtttcggccaggtgcggtggc

SEQ ID NO: 44619 - DNA, 42 bp, Homo sapiens
  misc_feature 1..42: note = chr16:15762689-15762731
  misc_feature 1..42: note = hypo
  source 1..42: mol_type = genomic DNA
gttgacattggagcccggatcatcctccgttgggagggactg

SEQ ID NO: 44620 - DNA, 92 bp, Homo sapiens
  misc_feature 1..92: note = chr16:15820825-15820917
  misc_feature 1..92: note = hypo
  source 1..92: mol_type = genomic DNA
gcctggcccaggacccgcagctccccggccaggtctgcgttctctttctccagcgtctgcttattcttgtctaggttcgccttggcctggcg

SEQ ID NO: 44621 - DNA, 16 bp, Homo sapiens
  misc_feature 1..16: note = chr16:17049595-17049611
  misc_feature 1..16: note = hypo
  source 1..16: mol_type = genomic DNA
ccggccacaacagatt

SEQ ID NO: 44622 - DNA, 30 bp, Homo sapiens
  misc_feature 1..30: note = chr16:17341523-17341553
  misc_feature 1..30: note = hypo
  source 1..30: mol_type = genomic DNA
aagtggcagaggggccgcaagtcttttgag

SEQ ID NO: 44623 - DNA, 100 bp, Homo sapiens
  misc_feature 1..100: note = chr16:17866410-17866510
  misc_feature 1..100: note = hypo
  source 1..100: mol_type = genomic DNA
agagaattagtgcagcgtaggaaattagccttcttcctgactcctcatacactcttcatgtctaaagttgacttcttctattgctgcttttttttttttt

SEQ ID NO: 44624 - DNA, 146 bp, Homo sapiens
  misc_feature 1..146: note = chr16:18802485-18802631
  misc_feature 1..146: note = hypo
  source 1..146: mol_type = genomic DNA
ttaattaaaaagttaagttcagacaaaagtcacccaacagttgtttactgagcacccatgtaccagacgctagcaaggccctggggtacgaggtgcccacacaggcaccatttagccagttctgtccctgccggttcttccagctt

SEQ ID NO: 44625 - DNA, 37 bp, Homo sapiens
  misc_feature 1..37: note = chr16:18804505-18804542
  misc_feature 1..37: note = hypo
  source 1..37: mol_type = genomic DNA
atagtacagcagaaacggttcccggggcaatgggtgc

SEQ ID NO: 44626 - DNA, 30 bp, Homo sapiens
  misc_feature 1..30: note = chr16:18950653-18950683
  misc_feature 1..30: note = hypo
  source 1..30: mol_type = genomic DNA
ttacatgctgcaccccgcactttaaatgac

SEQ ID NO: 44627 - DNA, 37 bp, Homo sapiens
  misc_feature 1..37: note = chr16:18950981-18951018
  misc_feature 1..37: note = hypo
  source 1..37: mol_type = genomic DNA
tacaggcgtgagtcaccgtgcccggccctcctgcaac

SEQ ID NO: 44628 - DNA, 31 bp, Homo sapiens
  misc_feature 1..31: note = chr16:19534839-19534870
  misc_feature 1..31: note = hypo
  source 1..31: mol_type = genomic DNA
cgtaagccatcacgcccggtgggttcagcaa

SEQ ID NO: 44629 - DNA, 30 bp, Homo sapiens
  misc_feature 1..30: note = chr16:19708504-19708534
  misc_feature 1..30: note = hypo
  source 1..30: mol_type = genomic DNA
gattgggctctttgccgtcggctctgctgc

SEQ ID NO: 44630 - DNA, 30 bp, Homo sapiens
  misc_feature 1..30: note = chr16:19929817-19929847
  misc_feature 1..30: note = hypo
  source 1..30: mol_type = genomic DNA
gtgagccaccgatcccggtcggaaatttat

SEQ ID NO: 44631 - DNA, 194 bp, Homo sapiens
  misc_feature 1..194: note = chr16:20327311-20327505
  misc_feature 1..194: note = hypo
  source 1..194: mol_type = genomic DNA
ggctaggtcgatggccggtacttcactgcggacttgacttcttgagcaagactgtagggatgatgaacttttattatatcaaaatttaaatgcctggattctatctagactgctcctacaatgggcagctctggaccaagaactgtgtccagaactggttcacgctatggccctaattccgatgctgtggttat

SEQ ID NO: 44632 - DNA, 35 bp, Homo sapiens
  misc_feature 1..35: note = chr16:21539162-21539197
  misc_feature 1..35: note = hypo
  source 1..35: mol_type = genomic DNA
tccccagaccaatggcgctgcgagcttctggggcg

SEQ ID NO: 44633 - DNA, 18 bp, Homo sapiens
  misc_feature 1..18: note = chr16:21541457-21541475
  misc_feature 1..18: note = hypo
  source 1..18: mol_type = genomic DNA
agcttgatccagacccga

SEQ ID NO: 44634 - DNA, 38 bp, Homo sapiens
  misc_feature 1..38: note = chr16:21566671-21566709
  misc_feature 1..38: note = hypo
  source 1..38: mol_type = genomic DNA
agtggggtctggagtcggacgcacgttcagaggctggg

SEQ ID NO: 44635 - DNA, 33 bp, Homo sapiens
  misc_feature 1..33: note = chr16:21719131-21719164
  misc_feature 1..33: note = hypo
  source 1..33: mol_type = genomic DNA
ttcttgatggagtgtcgctctgttgccaggctg

SEQ ID NO: 44636 - DNA, 30 bp, Homo sapiens
  misc_feature 1..30: note = chr16:23093885-23093915
  misc_feature 1..30: note = hypo
  source 1..30: mol_type = genomic DNA
cagaagcatgactcccgttaagtgccactt

SEQ ID NO: 44637 - DNA, 30 bp, Homo sapiens; identical to SEQ ID NO: 16032
  misc_feature 1..30: note = chr16:23303315-23303345
  misc_feature 1..30: note = hypo
  source 1..30: mol_type = genomic DNA

SEQ ID NO: 44638 - DNA, 30 bp, Homo sapiens
  misc_feature 1..30: note = chr16:23444796-23444826
  misc_feature 1..30: note = hypo
  source 1..30: mol_type = genomic DNA
cccgaggcagtcacccgttcccttgtcacc

SEQ ID NO: 44639 - DNA, 29 bp, Homo sapiens
  misc_feature 1..29: note = chr16:23606614-23606643
  misc_feature 1..29: note = hypo
  source 1..29: mol_type = genomic DNA
tcactgcctcccggcgtttcagcctcacg

SEQ ID NO: 44640 - DNA, 91 bp, Homo sapiens
  misc_feature 1..91: note = chr16:23716327-23716418
  misc_feature 1..91: note = hypo
  source 1..91: mol_type = genomic DNA
gcagctggcgcaggccgtcctggtgccaggtgtagacgcccatcacaggcacgcccaggtcctgtgtccacagcaccgtcccgcttcctgg

SEQ ID NO: 44641 - DNA, 151 bp, Homo sapiens
  misc_feature 1..151: note = chr16:23990960-23991111
  misc_feature 1..151: note = hypo
  source 1..151: mol_type = genomic DNA
cgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaaca

SEQ ID NO: 44642 - DNA, 33 bp, Homo sapiens
  misc_feature 1..33: note = chr16:24013932-24013965
  misc_feature 1..33: note = hypo
  source 1..33: mol_type = genomic DNA
tacaggtgtgagccactgcgcctggccagcata

SEQ ID NO: 44643 - DNA, 30 bp, Homo sapiens
  misc_feature 1..30: note = chr16:25077168-25077198
  misc_feature 1..30: note = hypo
  source 1..30: mol_type = genomic DNA
gtgagccaccgtgcccggcctaagtagctg

SEQ ID NO: 44644 - DNA, 28 bp, Homo sapiens
  misc_feature 1..28: note = chr16:25692519-25692547
  misc_feature 1..28: note = hypo
  source 1..28: mol_type = genomic DNA
ttaagatatgtaggccgggtgcggtggc

SEQ ID NO: 44645 - DNA, 16 bp, Homo sapiens
  misc_feature 1..16: note = chr16:26388437-26388453
  misc_feature 1..16: note = hypo
  source 1..16: mol_type = genomic DNA
ccgtctcaaaaaaaaa

SEQ ID NO: 44646 - DNA, 42 bp, Homo sapiens
  misc_feature 1..42: note = chr16:26664733-26664775
  misc_feature 1..42: note = hypo
  source 1..42: mol_type = genomic DNA
gggattacaggtgtgagccaccgcacccggcccttttgtcca

SEQ ID NO: 44647 - DNA, 30 bp, Homo sapiens
  misc_feature 1..30: note = chr16:26732577-26732607
  misc_feature 1..30: note = hypo
  source 1..30: mol_type = genomic DNA
cacagcaaaactgagcgctgttcatctttc

SEQ ID NO: 44648 - DNA, 32 bp, Homo sapiens
  misc_feature 1..32: note = chr16:27038943-27038975
  misc_feature 1..32: note = hypo
  source 1..32: mol_type = genomic DNA
tgtgtctttatcagcagcgtgaaaaaggacta

SEQ ID NO: 44649 - DNA, 36 bp, Homo sapiens
  misc_feature 1..36: note = chr16:27279055-27279091
  misc_feature 1..36: note = hypo
  source 1..36: mol_type = genomic DNA
tttttttttttgagacggagtttcgctcttgttgcc

SEQ ID NO: 44650 - DNA, 40 bp, Homo sapiens
  misc_feature 1..40: note = chr16:27853439-27853479
  misc_feature 1..40: note = hypo
  source 1..40: mol_type = genomic DNA
ttcacatcagtagcacgatgtcgcgcgtgccgaatttcac

SEQ ID NO: 44651 - DNA, 103 bp, Homo sapiens
  misc_feature 1..103: note = chr16:28560175-28560278
  misc_feature 1..103: note = hypo
  source 1..103: mol_type = genomic DNA
ccatgtagaatgaagcgagcccagacatcattgtcgccctccgcaacggtgcatctgtgctcccatttttgcaagaaaaattattttctttttctttttcttt

SEQ ID NO: 44652 - DNA, 78 bp, Homo sapiens; identical to SEQ ID NO: 16035
  misc_feature 1..78: note = chr16:28878714-28878792
  misc_feature 1..78: note = hypo
  source 1..78: mol_type = genomic DNA

SEQ ID NO: 44653 - DNA, 26 bp, Homo sapiens
  misc_feature 1..26: note = chr16:28947344-28947370
  misc_feature 1..26: note = hypo
  source 1..26: mol_type = genomic DNA
cccgtccgcctcgcaatttgaactcc

SEQ ID NO: 44654 - DNA, 91 bp, Homo sapiens
  misc_feature 1..91: note = chr16:29009366-29009457
  misc_feature 1..91: note = hypo
  source 1..91: mol_type = genomic DNA
agcagggactacaggcgtgcaacatcatgcccacttaattgtttgtattttctgtacaaacagttttctgtgacaccccgtctctactaaa

SEQ ID NO: 44655 - DNA, 34 bp, Homo sapiens; identical to SEQ ID NO: 16036
  misc_feature 1..34: note = chr16:29139111-29139145
  misc_feature 1..34: note = hypo
  source 1..34: mol_type = genomic DNA

SEQ ID NO: 44656 - DNA, 102 bp, Homo sapiens
  misc_feature 1..102: note = chr16:29153203-29153305
  misc_feature 1..102: note = hypo
  source 1..102: mol_type = genomic DNA
catggcacaagggagcggtggaataatcctctgtggcacgcgggggggggtgtggaataatcctccgtggcacgagggggtggtggaataatcctccgtggc

SEQ ID NO: 44657 - DNA, 162 bp, Homo sapiens
  misc_feature 1..162: note = chr16:29153365-29153527
  misc_feature 1..162: note = hypo
  source 1..162: mol_type = genomic DNA
gagggggcagtggtataatcctctgtggcacgaggggtcggcggtataatcctccgtggcacgaggatggtcaccgcattcgtcactcttagctgcagtgcgtgtgacagtcgccagggctgctgtttgaggaatgggagttgcctgcgtctgctctgcccc

SEQ ID NO: 44658 - DNA, 96 bp, Homo sapiens
  misc_feature 1..96: note = chr16:29244717-29244813
  misc_feature 1..96: note = hypo
  source 1..96: mol_type = genomic DNA
ggaagggccctgagccgggtgccacggccgacgccctgtcctttgccgtgacagtctctgtgcagtgcaggcagcccccaccgaatccaggtacag

SEQ ID NO: 44659 - DNA, 30 bp, Homo sapiens
  misc_feature 1..30: note = chr16:29262965-29262995
  misc_feature 1..30: note = hypo
  source 1..30: mol_type = genomic DNA
ccaggattatagtggcgaggcagggtgtta

SEQ ID NO: 44660 - DNA, 30 bp, Homo sapiens
  misc_feature 1..30: note = chr16:29266418-29266448
  misc_feature 1..30: note = hypo
  source 1..30: mol_type = genomic DNA
atcaaggagcctgcccgggggtgccagcca

SEQ ID NO: 44661 - DNA, 34 bp, Homo sapiens
  misc_feature 1..34: note = chr16:29324812-29324846
  misc_feature 1..34: note = hypo
  source 1..34: mol_type = genomic DNA
cgtccaggatctcagcgtgcggggggcatccggg

SEQ ID NO: 44662 - DNA, 73 bp, Homo sapiens
  misc_feature 1..73: note = chr16:29691644-29691717
  misc_feature 1..73: note = hypo
  source 1..73: mol_type = genomic DNA
ctggtcacattccaacgcttcaaggaagtgtttcagcccagagcattctgtgtaaagccgcagagcaggtcat

SEQ ID NO: 44663 - DNA, 171 bp, Homo sapiens
  misc_feature 1..171: note = chr16:29830952-29831123
  misc_feature 1..171: note = hypo
  source 1..171: mol_type = genomic DNA
gaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagc

SEQ ID NO: 44664 - DNA, 433 bp, Homo sapiens
  misc_feature 1..433: note = chr16:30017228-30017661
  misc_feature 1..433: note = hypo
  source 1..433: mol_type = genomic DNA
gcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagc

SEQ ID NO: 44665 - DNA, 67 bp, Homo sapiens
  misc_feature 1..67: note = chr16:30116248-30116315
  misc_feature 1..67: note = hypo
  source 1..67: mol_type = genomic DNA
gataatccgttatgacgccagtggctcccacgctgaaggctgcttcaaaatccgactcttcattaag

SEQ ID NO: 44666 - DNA, 346 bp, Homo sapiens
  misc_feature 1..346: note = chr16:30124515-30124861
  misc_feature 1..346: note = hypo
  source 1..346: mol_type = genomic DNA
cagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcc

SEQ ID NO: 44667 - DNA, 30 bp, Homo sapiens
  misc_feature 1..30: note = chr16:30354712-30354742
  misc_feature 1..30: note = hypo
  source 1..30: mol_type = genomic DNA
cagggtcaggggcttcgcggagaaggcgga

SEQ ID NO: 44668 - DNA, 30 bp, Homo sapiens
  misc_feature 1..30: note = chr16:30430132-30430162
  misc_feature 1..30: note = hypo
  source 1..30: mol_type = genomic DNA
gttcacgatcagacacgcactgcattcggc

SEQ ID NO: 44669 - DNA, 32 bp, Homo sapiens
  misc_feature 1..32: note = chr16:30567477-30567509
  misc_feature 1..32: note = hypo
  source 1..32: mol_type = genomic DNA
ttgaatcccacagcccgcgtggacagggacag

SEQ ID NO: 44670 - DNA, 30 bp, Homo sapiens
  misc_feature 1..30: note = chr16:30803924-30803954
  misc_feature 1..30: note = hypo
  source 1..30: mol_type = genomic DNA
gttcctggccaggtgcggtggctcacacct

SEQ ID NO: 44671 - DNA, 39 bp, Homo sapiens
  misc_feature 1..39: note = chr16:30826344-30826383
  misc_feature 1..39: note = hypo
  source 1..39: mol_type = genomic DNA
attaccggcgggagccaccgctcccgtccaggacaggga

SEQ ID NO: 44672 - DNA, 76 bp, Homo sapiens
  misc_feature 1..76: note = chr16:30906986-30907062
  misc_feature 1..76: note = hypo
  source 1..76: mol_type = genomic DNA
tccagcaattgctcacggcaatacacacacccactcacacgaacacacgcacacacatgcacgcgcacatgcacac

SEQ ID NO: 44673 - DNA, 196 bp, Homo sapiens
  misc_feature 1..196: note = chr16:30907122-30907318
  misc_feature 1..196: note = hypo
  source 1..196: mol_type = genomic DNA
gcacacacgtccgcatgcacgcacacacgcagacacacgcaagcgcacacacacacgggcctcctcgtcttcattcacaaaccccattagcttctgttgtctatgggcttcctcgacagaccgcgagcccctcgcgggggccagaaaccaagtatggatcatccctatgtgccttcctttccgtctacaccaggtt

SEQ ID NO: 44674 - DNA, 30 bp, Homo sapiens
  misc_feature 1..30: note = chr16:31018076-31018106
  misc_feature 1..30: note = hypo
  source 1..30: mol_type = genomic DNA
agagggaacagcatgcgcgaaggtccttgg

SEQ ID NO: 44675 - DNA, 120 bp, Homo sapiens; identical to SEQ ID NO: 16045
  misc_feature 1..120: note = chr16:31138607-31138727
  misc_feature 1..120: note = hypo
  source 1..120: mol_type = genomic DNA

SEQ ID NO: 44676 - DNA, 39 bp, Homo sapiens
  misc_feature 1..39: note = chr16:31149942-31149981
  misc_feature 1..39: note = hypo
  source 1..39: mol_type = genomic DNA
gtctatggcgggcagcgagggcagcgggtctgagcaggg

SEQ ID NO: 44677 - DNA, 144 bp, Homo sapiens
  misc_feature 1..144: note = chr16:31373926-31374070
  misc_feature 1..144: note = hypo
  source 1..144: mol_type = genomic DNA
ctcaggttactccaccgagctggccctctggaaaggggtgcagagcctggtcctgggggccccccgctaccagcacaccgggaaggctgtcatcttcacccaggtgtccaggcaatggaggatgaaggccgaagtcacggggac

SEQ ID NO: 44678 - DNA, 30 bp, Homo sapiens
  misc_feature 1..30: note = chr16:31384803-31384833
  misc_feature 1..30: note = hypo
  source 1..30: mol_type = genomic DNA
gtgccatctggggcacgcctctgctcgtgt

SEQ ID NO: 44679 - DNA, 337 bp, Homo sapiens
  misc_feature 1..337: note = chr16:31446888-31447225
  misc_feature 1..337: note = hypo
  source 1..337: mol_type = genomic DNA
gtgtgagtcaccgcccgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattccacccagggctgcagcacgctggttcttcagtgtcgggccaggttggacctccggctggaggccttccacaccggaaacactggtagggctcctctccagtgtgggttcgagggcggtggaggagctcg

SEQ ID NO: 44680 - DNA, 92 bp, Homo sapiens
  misc_feature 1..92: note = chr16:31500544-31500636
  misc_feature 1..92: note = hypo
  source 1..92: mol_type = genomic DNA
cccagctttcctctgcggcgtgcactacctctacttcgccattgtgctgttcttctgctctggcctcctcaccctcacggtctccctgtgca

SEQ ID NO: 44681 - DNA, 33 bp, Homo sapiens
  misc_feature 1..33: note = chr16:31526376-31526409
  misc_feature 1..33: note = hypo
  source 1..33: mol_type = genomic DNA
tagagatggggaggccgggtatggtggctcatg

SEQ ID NO: 44682 - DNA, 16 bp, Homo sapiens
  misc_feature 1..16: note = chr16:31658246-31658262
  misc_feature 1..16: note = hypo
  source 1..16: mol_type = genomic DNA
aatggaaggactgggc

SEQ ID NO: 44683 - DNA, 30 bp, Homo sapiens
  misc_feature 1..30: note = chr16:32485550-32485580
  misc_feature 1..30: note = hypo
  source 1..30: mol_type = genomic DNA
tgggaacatggtgtccgcactcccggctag

SEQ ID NO: 44684 - DNA, 18 bp, Homo sapiens
  misc_feature 1..18: note = chr16:33396766-33396784
  misc_feature 1..18: note = hypo
  source 1..18: mol_type = genomic DNA
tatgagatggattttcgc

SEQ ID NO: 44685 - DNA, 120 bp, Homo sapiens
  misc_feature 1..120: note = chr16:33893446-33893566
  misc_feature 1..120: note = hypo
  source 1..120: mol_type = genomic DNA
cgatgattccatttgcttccatttaattccattcgatgattcaattggatgtcattcgatgattccataagattccctttgatgatgattctattccgtcctttcaatgatgataccaat

SEQ ID NO: 44686 - DNA, 92 bp, Homo sapiens
  misc_feature 1..92: note = chr16:33897833-33897925
  misc_feature 1..92: note = hypo
  source 1..92: mol_type = genomic DNA
atgattccatttgcttccatttagttccatttgaagattacattggatgccatttgatgattccataagattccattcgatgatgattctat

SEQ ID NO: 44687 - DNA, 30 bp, Homo sapiens
  misc_feature 1..30: note = chr16:34983961-34983991
  misc_feature 1..30: note = hypo
  source 1..30: mol_type = genomic DNA
gaagctaggcagggtcgagcctggctgggg

SEQ ID NO: 44688 - DNA, 79 bp, Homo sapiens
  misc_feature 1..79: note = chr16:46721647-46721726
  misc_feature 1..79: note = hypo
  source 1..79: mol_type = genomic DNA
aagggccaaaggggccgccaacacttgctttcggatgcaaaagtgcgacaccaagaagactaagcgagctgcctaaatt

SEQ ID NO: 44689 - DNA, 37 bp, Homo sapiens
  misc_feature 1..37: note = chr16:46803066-46803103
  misc_feature 1..37: note = hypo
  source 1..37: mol_type = genomic DNA
tcgggcggtggctaacgcctgtaatcccagcactttg

SEQ ID NO: 44690 - DNA, 120 bp, Homo sapiens
  misc_feature 1..120: note = chr16:48642029-48642149
  misc_feature 1..120: note = hypo
  source 1..120: mol_type = genomic DNA
acatacatcctttctttctgacattctccgagcgttttattactattaatggtttttttccgattctcaagaacacggttttcaccgtgtgacacaggacagtctcaatctcctgatctc

SEQ ID NO: 44691 - DNA, 30 bp, Homo sapiens
  misc_feature 1..30: note = chr16:49500178-49500208
  misc_feature 1..30: note = hypo
  source 1..30: mol_type = genomic DNA
catgggatttgggctcgcattaagtgattt

SEQ ID NO: 44692 - DNA, 30 bp, Homo sapiens
  misc_feature 1..30: note = chr16:49533007-49533037
  misc_feature 1..30: note = hypo
  source 1..30: mol_type = genomic DNA
ggtttgcctcatttacgcagatggcagggc

SEQ ID NO: 44693 - DNA, 161 bp, Homo sapiens
  misc_feature 1..161: note = chr16:49545215-49545376
  misc_feature 1..161: note = hypo
  source 1..161: mol_type = genomic DNA
aggtgaggcccacttcgagaccctgcacccagagacctacccttggcttctaagggctttgagagtcatctccaaccccactgcctcagcccgcaggctgcgaacacaggcactcatgtcagactgcctggcctcacatttctccacgctggcagctatgt

SEQ ID NO: 44694 - DNA, 90 bp, Homo sapiens
  misc_feature 1..90: note = chr16:49623675-49623765
  misc_feature 1..90: note = hypo
  source 1..90: mol_type = genomic DNA
cactgaagccgggaacgctacagtgggataattacttggctcccacacagctgagttccatagatgcattattaacggcacattcctcgc

SEQ ID NO: 44695 - DNA, 30 bp, Homo sapiens
  misc_feature 1..30: note = chr16:49634741-49634771
  misc_feature 1..30: note = hypo
  source 1..30: mol_type = genomic DNA
gccgaaataaatcaccgtcgctcaggaggg

SEQ ID NO: 44696 - DNA, 30 bp, Homo sapiens
  misc_feature 1..30: note = chr16:49638060-49638090
  misc_feature 1..30: note = hypo
  source 1..30: mol_type = genomic DNA
tcagcaccccgctggcgggcacccgggccc

SEQ ID NO: 44697 - DNA, 19 bp, Homo sapiens
  misc_feature 1..19: note = chr16:50070334-50070353
  misc_feature 1..19: note = hypo
  source 1..19: mol_type = genomic DNA
ccaccgtgcctggcctctt

SEQ ID NO: 44698 - DNA, 80 bp, Homo sapiens
  misc_feature 1..80: note = chr16:50218595-50218675
  misc_feature 1..80: note = hypo
  source 1..80: mol_type = genomic DNA
gaataatgctgccatcatgcttgagggtttttttttattttgttttgttttgtttgtggggggagcggagggcacagtct

SEQ ID NO: 44699 - DNA, 30 bp, Homo sapiens
  misc_feature 1..30: note = chr16:50335767-50335797
  misc_feature 1..30: note = hypo
  source 1..30: mol_type = genomic DNA
tttcactctggtcctcgctatgccttgggg

SEQ ID NO: 44700 - DNA, 30 bp, Homo sapiens
  misc_feature 1..30: note = chr16:50336356-50336386
  misc_feature 1..30: note = hypo
  source 1..30: mol_type = genomic DNA
gcaggctgcctgggccgacttgaatttcag

SEQ ID NO: 44701 - DNA, 152 bp, Homo sapiens
  misc_feature 1..152: note = chr16:50336625-50336777
  misc_feature 1..152: note = hypo
  source 1..152: mol_type = genomic DNA
ccacagggattttcacggacaccgagtgaactgcgagtccccccacccttcttgctaaggtggcagtggcgggccccatggtcgcgcaccctgcatttttcctaccttggggacatccctcctgtgtgcagggtgctcgtctgtagctcctg

SEQ ID NO: 44702 - DNA, 30 bp, Homo sapiens
  misc_feature 1..30: note = chr16:50958718-50958748
  misc_feature 1..30: note = hypo
  source 1..30: mol_type = genomic DNA
gcaacaaagctgttccggttacagttctac

SEQ ID NO: 44703 - DNA, 34 bp, Homo sapiens; identical to SEQ ID NO: 16051
  misc_feature 1..34: note = chr16:53448517-53448551
  misc_feature 1..34: note = hypo
  source 1..34: mol_type = genomic DNA

SEQ ID NO: 44704 - DNA, 200 bp, Homo sapiens
  misc_feature 1..200: note = chr16:53563454-53563654
  misc_feature 1..200: note = hypo
  source 1..200: mol_type = genomic DNA
ccttcatatagcaatcggctcctcttatcccccaggcaactggctgcctttcacctccgcggcacagcaattatgtggtgtaatggaggcagcgcaaataagcagaaagattttattaaaccaaatgagcaaatcatctgcgtattattgcgatttgattgacactgacaagtgtcgagcagacgcggatgtgaatatga

SEQ ID NO: 44705 - DNA, 221 bp, Homo sapiens
  misc_feature 1..221: note = chr16:55203739-55203960
  misc_feature 1..221: note = hypo
  source 1..221: mol_type = genomic DNA
tacatagagttagagcgcatattttattaatgttcatcctttagagaccagatttgtgcgttcgctaaaataaacactacagtctttagggcgtggttgggtggagactgcagaagtatgagggcaaagaacattttgcaaggaagtagccactccagagccatcgtcgggtgatgggaggcgcccagagctgggatccagggacccggagtcttgcatct

SEQ ID NO: 44706 - DNA, 30 bp, Homo sapiens
  misc_feature 1..30: note = chr16:56460223-56460253
  misc_feature 1..30: note = hypo
  source 1..30: mol_type = genomic DNA
atgctacaataggaacgaaccttaaacacg

SEQ ID NO: 44707 - DNA, 27 bp, Homo sapiens
  misc_feature 1..27: note = chr16:56774935-56774962
  misc_feature 1..27: note = hypo
  source 1..27: mol_type = genomic DNA
ggagagggagagcgctaaatttctttt

SEQ ID NO: 44708 - DNA, 63 bp, Homo sapiens
  misc_feature 1..63: note = chr16:57222193-57222256
  misc_feature 1..63: note = hypo
  source 1..63: mol_type = genomic DNA
tactagtgtttggttcgtcgtacttgttagagatggttttccaaatatcgggcaatcatttcc

SEQ ID NO: 44709 - DNA, 21 bp, Homo sapiens
  misc_feature 1..21: note = chr16:57222700-57222721
  misc_feature 1..21: note = hypo
  source 1..21: mol_type = genomic DNA
tacaggcgtgagccactgtgt

SEQ ID NO: 44710 - DNA, 30 bp, Homo sapiens
  misc_feature 1..30: note = chr16:57321322-57321352
  misc_feature 1..30: note = hypo
  source 1..30: mol_type = genomic DNA
tcagatagtgacaaacgctgtgactaaagt

SEQ ID NO: 44711 - DNA, 30 bp, Homo sapiens; identical to SEQ ID NO: 16055
  misc_feature 1..30: note = chr16:57759922-57759952
  misc_feature 1..30: note = hypo
  source 1..30: mol_type = genomic DNA

SEQ ID NO: 44712 - DNA, 122 bp, Homo sapiens
  misc_feature 1..122: note = chr16:58120963-58121085
  misc_feature 1..122: note = hypo
  source 1..122: mol_type = genomic DNA
tctctccagcatccacgactacaggtgatggccacgctactcccatgtcctcacatgcacctgggttacgtcagcggcagccatgcgtgcacatgcacactcacacacgcacactcacactc

SEQ ID NO: 44713 - DNA, 21 bp, Homo sapiens
  misc_feature 1..21: note = chr16:58462002-58462023
  misc_feature 1..21: note = hypo
  source 1..21: mol_type = genomic DNA
atacatcgtggacatccttcc

SEQ ID NO: 44714 - DNA, 39 bp, Homo sapiens
  misc_feature 1..39: note = chr16:58548346-58548385
  misc_feature 1..39: note = hypo
  source 1..39: mol_type = genomic DNA
agtaacagaccaggccgcgcgcggtggctcacgcctgta

SEQ ID NO: 44715 - DNA, 30 bp, Homo sapiens
  misc_feature 1..30: note = chr16:58886327-58886357
  misc_feature 1..30: note = hypo
  source 1..30: mol_type = genomic DNA
aaaaaaaagaggggacgttgaaagtggcca

SEQ ID NO: 44716 - DNA, 33 bp, Homo sapiens
  misc_feature 1..33: note = chr16:58932088-58932121
  misc_feature 1..33: note = hypo
  source 1..33: mol_type = genomic DNA
tttgcctaggctgagcgcagtggtgtgatctca

SEQ ID NO: 44717 - DNA, 35 bp, Homo sapiens
  misc_feature 1..35: note = chr16:58969757-58969792
  misc_feature 1..35: note = hypo
  source 1..35: mol_type = genomic DNA
ctgtaggtagtggaacgaagcgatgttccaaattt

SEQ ID NO: 44718 - DNA, 30 bp, Homo sapiens
  misc_feature 1..30: note = chr16:59046529-59046559
  misc_feature 1..30: note = hypo
  source 1..30: mol_type = genomic DNA
ggaaccccatgtattcggttaatttttttt

SEQ ID NO: 44719 - DNA, 174 bp, Homo sapiens
  misc_feature 1..174: note = chr16:67241603-67241777
  misc_feature 1..174: note = hypo
  source 1..174: mol_type = genomic DNA
gttgatgccagggcacgtggccacatccaacacccggagctgcctgcacgcctgcccaatagcatccagtgtcctgtggggaggccacctgatgagtgcctggcccggtgtgggacccagcccagcccctgcaccgtggctccatctgcctggtgtcatcggacacacttactg

SEQ ID NO: 44720 - DNA, 93 bp, Homo sapiens; identical to SEQ ID NO: 16057
  misc_feature 1..93: note = chr16:67313865-67313958
  misc_feature 1..93: note = hypo
  source 1..93: mol_type = genomic DNA

SEQ ID NO: 44721 - DNA, 48 bp, Homo sapiens
  misc_feature 1..48: note = chr16:67578633-67578681
  misc_feature 1..48: note = hypo
  source 1..48: mol_type = genomic DNA
gcatgggccctggagcggctgctgcgggaagcccgagtactggaggca

SEQ ID NO: 44722 - DNA, 27 bp, Homo sapiens
  misc_feature 1..27: note = chr16:68770701-68770728
  misc_feature 1..27: note = hypo
  source 1..27: mol_type = genomic DNA
aaaaaattagcctggcgtggtggtgtg

SEQ ID NO: 44723 - DNA, 147 bp, Homo sapiens; identical to SEQ ID NO: 16060
  misc_feature 1..147: note = chr16:68770848-68770995
  misc_feature 1..147: note = hypo
  source 1..147: mol_type = genomic DNA

SEQ ID NO: 44724 - DNA, 45 bp, Homo sapiens
  misc_feature 1..45: note = chr16:68787504-68787549
  misc_feature 1..45: note = hypo
  source 1..45: mol_type = genomic DNA
gctgggattacaggcgtgagccaccgcgcccggcacatcttacaa

SEQ ID NO: 44725 - DNA, 18 bp, Homo sapiens
  misc_feature 1..18: note = chr16:68876852-68876870
  misc_feature 1..18: note = hypo
  source 1..18: mol_type = genomic DNA
tttgagatggagtctcgc

SEQ ID NO: 44726 - DNA, 30 bp, Homo sapiens
  misc_feature 1..30: note = chr16:69133585-69133615
  misc_feature 1..30: note = hypo
  source 1..30: mol_type = genomic DNA
attgtgtctcctgttcgttacttaacactg

SEQ ID NO: 44727 - DNA, 30 bp, Homo sapiens
  misc_feature 1..30: note = chr16:69352566-69352596
  misc_feature 1..30: note = hypo
  source 1..30: mol_type = genomic DNA
gtgaaggggataatccggagaaaaagaaac

SEQ ID NO: 44728 - DNA, 121 bp, Homo sapiens
  misc_feature 1..121: note = chr16:70380004-70380125
  misc_feature 1..121: note = hypo
  source 1..121: mol_type = genomic DNA
aaagaaacgaaaaaacgcattgtgtgttgtgtttattggatggtggaattatggggtttacgggtcttctgttgcgttttggtttttgttttcttacctgttatcgcgttcctaacagtag

SEQ ID NO: 44729 - DNA, 137 bp, Homo sapiens
  misc_feature 1..137: note = chr16:70416085-70416222
  misc_feature 1..137: note = hypo
  source 1..137: mol_type = genomic DNA
agttccatttttacacgaagtaggcctggggctcagagctggtgggggcagtcgtccagctgaaattcaactacatacactctccattctatttatgtttttttttcttttctttttcaagacagcgtctcattctg

SEQ ID NO: 44730 - DNA, 126 bp, Homo sapiens
  misc_feature 1..126: note = chr16:70427606-70427732
  misc_feature 1..126: note = hypo
  source 1..126: mol_type = genomic DNA
accctcaggtggctccggggtcctggacagggtccactccaacctgctcaccctcccacttgcaccatttcccaacatgaggaaggtcttacatggaatgctgaatgcctccgagacatattgctg

SEQ ID NO: 44731 - DNA, 77 bp, Homo sapiens
  misc_feature 1..77: note = chr16:70595623-70595700
  misc_feature 1..77: note = hypo
  source 1..77: mol_type = genomic DNA
catcgggttttgcctcggaacagtgtcccgagggcattgtggccatctccaccaacaccctacggtgagtgagtctc

SEQ ID NO: 44732 - DNA, 50 bp, Homo sapiens
  misc_feature 1..50: note = chr16:70680482-70680532
  misc_feature 1..50: note = hypo
  source 1..50: mol_type = genomic DNA
agaaatcagagaaagcgtcacccagccccagattccgaggggcctgccag

SEQ ID NO: 44733 - DNA, 30 bp, Homo sapiens
  misc_feature 1..30: note = chr16:70795276-70795306
  misc_feature 1..30: note = hypo
  source 1..30: mol_type = genomic DNA
ctcacagtgccttggcgctcagaagaggaa

SEQ ID NO: 44734 - DNA, 23 bp, Homo sapiens
  misc_feature 1..23: note = chr16:71266650-71266673
  misc_feature 1..23: note = hypo
  source 1..23: mol_type = genomic DNA
gggtgcagtggctcacgcctgta

SEQ ID NO: 44735 - DNA, 29 bp, Homo sapiens
  misc_feature 1..29: note = chr16:71841040-71841069
  misc_feature 1..29: note = hypo
  source 1..29: mol_type = genomic DNA
actttttgccaggcacggtggctcacgcc

SEQ ID NO: 44736 - DNA, 36 bp, Homo sapiens
  misc_feature 1..36: note = chr16:71919045-71919081
  misc_feature 1..36: note = hypo
  source 1..36: mol_type = genomic DNA
actgtgcccggcctggttggacgcacttctagtcaa

SEQ ID NO: 44737 - DNA, 84 bp, Homo sapiens; identical to SEQ ID NO: 16064
  misc_feature 1..84: note = chr16:72461607-72461691
  misc_feature 1..84: note = hypo
  source 1..84: mol_type = genomic DNA

SEQ ID NO: 44738 - DNA, 51 bp, Homo sapiens; identical to SEQ ID NO: 16065
  misc_feature 1..51: note = chr16:72957744-72957795
  misc_feature 1..51: note = hypo
  source 1..51: mol_type = genomic DNA

SEQ ID NO: 44739 - DNA, 30 bp, Homo sapiens
  misc_feature 1..30: note = chr16:73033457-73033487
  misc_feature 1..30: note = hypo
  source 1..30: mol_type = genomic DNA
catgctcacagcaaccgctaaccagaaaac

SEQ ID NO: 44740 - DNA, 30 bp, Homo sapiens
  misc_feature 1..30: note = chr16:73062471-73062501
  misc_feature 1..30: note = hypo
  source 1..30: mol_type = genomic DNA
ccaacagacaggggacgattgttagaactc

SEQ ID NO: 44741 - DNA, 30 bp, Homo sapiens
  misc_feature 1..30: note = chr16:73397239-73397269
  misc_feature 1..30: note = hypo
  source 1..30: mol_type = genomic DNA
tacgtattttaaaaacgattccaaattcta

SEQ ID NO: 44742 - DNA, 30 bp, Homo sapiens
  misc_feature 1..30: note = chr16:74331835-74331865
  misc_feature 1..30: note = hypo
  source 1..30: mol_type = genomic DNA
aatctgattagactccgtctcaaaaaaaaa

SEQ ID NO: 44743 - DNA, 18 bp, Homo sapiens
  misc_feature 1..18: note = chr16:74901527-74901545
  misc_feature 1..18: note = hypo
  source 1..18: mol_type = genomic DNA
ctggtccaccctatccgt

SEQ ID NO: 44744 - DNA, 72 bp, Homo sapiens
  misc_feature 1..72: note = chr16:75019649-75019721
  misc_feature 1..72: note = hypo
  source 1..72: mol_type = genomic DNA
agaaaaatcaaagctcgtgcaaaccgaagatacctcttctcctgatgcctatcccatcgagatatttaaaag

SEQ ID NO: 44745 - DNA, 308 bp, Homo sapiens
  misc_feature 1..308: note = chr16:75148816-75149124
  misc_feature 1..308: note = hypo
  source 1..308: mol_type = genomic DNA
ttcagctccaggattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagccacaggtgtgccaaggtgtgctgggaccatcctcgggccgggcgagggagccccactgtacctgcacagcacagacgccaccctcaagcc

SEQ ID NO: 44746 - DNA, 37 bp, Homo sapiens
  misc_feature 1..37: note = chr16:75171636-75171673
  misc_feature 1..37: note = hypo
  source 1..37: mol_type = genomic DNA
tacaggcatgagccaacacgcccggccccaaaatatt

SEQ ID NO: 44747 - DNA, 120 bp, Homo sapiens
  misc_feature 1..120: note = chr16:75183598-75183718
  misc_feature 1..120: note = hypo
  source 1..120: mol_type = genomic DNA
ggcgtgagccaccgcgtccggccagacacaatttattgatgtaactgttcctctaaatactactttaactacatcactcaaatttttatatcttgtattttcttttctgttgttgttgtt

SEQ ID NO: 44748 - DNA, 29 bp, Homo sapiens
  misc_feature 1..29: note = chr16:75469090-75469119
  misc_feature 1..29: note = hypo
  source 1..29: mol_type = genomic DNA
gtgagccaccgcgccgggcaccttcaagg

SEQ ID NO: 44749 - DNA, 38 bp, Homo sapiens
  misc_feature 1..38: note = chr16:75658302-75658340
  misc_feature 1..38: note = hypo
  source 1..38: mol_type = genomic DNA
gctggattacaggcgtgagccaccgcacctggctgccg

SEQ ID NO: 44750 - DNA, 30 bp, Homo sapiens
  misc_feature 1..30: note = chr16:75733411-75733441
  misc_feature 1..30: note = hypo
  source 1..30: mol_type = genomic DNA
gtaaaatacataaaccgcatccttgttttt

SEQ ID NO: 44751 - DNA, 88 bp, Homo sapiens
  misc_feature 1..88: note = chr16:77247382-77247470
  misc_feature 1..88: note = hypo
  source 1..88: mol_type = genomic DNA
tctgttaaatgtgtccgccactctggaggccggcatttgggacccaaatccaaaggcacccagcagcaggctgcggccattgactgag

SEQ ID NO: 44752 - DNA, 30 bp, Homo sapiens
  misc_feature 1..30: note = chr16:77754041-77754071
  misc_feature 1..30: note = hypo
  source 1..30: mol_type = genomic DNA
attttattaatatcacggtgtgtacacact

SEQ ID NO: 44753 - DNA, 95 bp, Homo sapiens
  misc_feature 1..95: note = chr16:80644760-80644855
  misc_feature 1..95: note = hypo
  source 1..95: mol_type = genomic DNA
gcccccagtggaccccgggcagaccttgctgaggcaggcacaacacagaaggcccagcaccctccccggcatgccaggctcgcaggggccactcc

SEQ ID NO: 44754 - DNA, 59 bp, Homo sapiens
  misc_feature 1..59: note = chr16:80654771-80654830
  misc_feature 1..59: note = hypo
  source 1..59: mol_type = genomic DNA
gcagcagtttgctgtcgtctgtggctgcgttgcagagcgctcgccggacttctttcatg

SEQ ID NO: 44755 - DNA, 132 bp, Homo sapiens
  misc_feature 1..132: note = chr16:80704564-80704696
  misc_feature 1..132: note = hypo
  source 1..132: mol_type = genomic DNA
taatgacacgaggtgcgcaaacctatttccaggctcattttgccccagggtctcgattttctttctgggacaggatgaaagaaagagaagccatgttgcaacataaaaagtgtgaatcgaggcctcgaggct

SEQ ID NO: 44756 - DNA, 30 bp, Homo sapiens
  misc_feature 1..30: note = chr16:80718633-80718663
  misc_feature 1..30: note = hypo
  source 1..30: mol_type = genomic DNA
agtcctgtaagacaccgtcttggtggccct

SEQ ID NO: 44757 - DNA, 19 bp, Homo sapiens
  misc_feature 1..19: note = chr16:81042228-81042247
  misc_feature 1..19: note = hypo
  source 1..19: mol_type = genomic DNA
ggcgcgctcccggcccctc

SEQ ID NO: 44758 - DNA, 30 bp, Homo sapiens; identical to SEQ ID NO: 16070
  misc_feature 1..30: note = chr16:81533258-81533288
  misc_feature 1..30: note = hypo
  source 1..30: mol_type = genomic DNA

SEQ ID NO: 44759 - DNA, 151 bp, Homo sapiens
  misc_feature 1..151: note = chr16:81569552-81569703
  misc_feature 1..151: note = hypo
  source 1..151: mol_type = genomic DNA
cctcccagagagagtcgtgtcacctgagggcccagggaacctcggtgacaagggacctcttgtctgctgtgtgctgtgggctgatgtgatccctgtttgcagtgtaaactcataagcagggacccgaagcatcccccgacccctggctttg

SEQ ID NO: 44760 - DNA, 30 bp, Homo sapiens
  misc_feature 1..30: note = chr16:81627246-81627276
  misc_feature 1..30: note = hypo
  source 1..30: mol_type = genomic DNA
gtattgagtgcccgccgaccacctggcgcg

SEQ ID NO: 44761 - DNA, 180 bp, Homo sapiens; identical to SEQ ID NO: 16071
  misc_feature 1..180: note = chr16:81632932-81633112
  misc_feature 1..180: note = hypo
  source 1..180: mol_type = genomic DNA

SEQ ID NO: 44762 - DNA, 68 bp, Homo sapiens
  misc_feature 1..68: note = chr16:83968763-83968831
  misc_feature 1..68: note = hypo
  source 1..68: mol_type = genomic DNA
gtgtagcacctaaagcgccaatgagactgtgtagaaaaatgtagctgcgtgagcgggagggagttccg

SEQ ID NO: 44763 - DNA, 41 bp, Homo sapiens; identical to SEQ ID NO: 16073
  misc_feature 1..41: note = chr16:84075186-84075227
  misc_feature 1..41: note = hypo
  source 1..41: mol_type = genomic DNA

SEQ ID NO: 44764 - DNA, 30 bp, Homo sapiens
  misc_feature 1..30: note = chr16:84129364-84129394
  misc_feature 1..30: note = hypo
  source 1..30: mol_type = genomic DNA
cacttctggctccaccgggtttcattgcag

SEQ ID NO: 44765 - DNA, 30 bp, Homo sapiens
  misc_feature 1..30: note = chr16:84152910-84152940
  misc_feature 1..30: note = hypo
  source 1..30: mol_type = genomic DNA
tcctagtaaacctgccggtggcactacagg

SEQ ID NO: 44766 - DNA, 30 bp, Homo sapiens; identical to SEQ ID NO: 16074
  misc_feature 1..30: note = chr16:84153364-84153394
  misc_feature 1..30: note = hypo
  source 1..30: mol_type = genomic DNA

SEQ ID NO: 44767 - DNA, 30 bp, Homo sapiens
  misc_feature 1..30: note = chr16:84593218-84593248
  misc_feature 1..30: note = hypo
  source 1..30: mol_type = genomic DNA
gagccagcacccaggcggagaaagccagaa

SEQ ID NO: 44768 - DNA, 30 bp, Homo sapiens
  misc_feature 1..30: note = chr16:85001619-85001649
  misc_feature 1..30: note = hypo
  source 1..30: mol_type = genomic DNA
ctgaaagcataatgccgagtgaaagaagcc

SEQ ID NO: 44769 - DNA, 58 bp, Homo sapiens; identical to SEQ ID NO: 16075
  misc_feature 1..58: note = chr16:85007798-85007856
  misc_feature 1..58: note = hypo
  source 1..58: mol_type = genomic DNA

SEQ ID NO: 44770 - DNA, 30 bp, Homo sapiens
  misc_feature 1..30: note = chr16:85010139-85010169
  misc_feature 1..30: note = hypo
  source 1..30: mol_type = genomic DNA
aaaagcaagtggcagcggctccaggaagct

SEQ ID NO: 44771 - DNA, 173 bp, Homo sapiens; identical to SEQ ID NO: 16076
  misc_feature 1..173: note = chr16:85028164-85028337
  misc_feature 1..173: note = hypo
  source 1..173: mol_type = genomic DNA

SEQ ID NO: 44772 - DNA, 30 bp, Homo sapiens
  misc_feature 1..30: note = chr16:85028787-85028817
  misc_feature 1..30: note = hypo
  source 1..30: mol_type = genomic DNA
ttctaccctaatggccgatttaatgggatt

SEQ ID NO: 44773 - DNA, 55 bp, Homo sapiens; identical to SEQ ID NO: 16077
  misc_feature 1..55: note = chr16:85033827-85033882
  misc_feature 1..55: note = hypo
  source 1..55: mol_type = genomic DNA

SEQ ID NO: 44774 - DNA, 16 bp, Homo sapiens
  misc_feature 1..16: note = chr16:85043890-85043906
  misc_feature 1..16: note = hypo
  source 1..16: mol_type = genomic DNA
gcgctgggattacagg

SEQ ID NO: 44775 - DNA, 51 bp, Homo sapiens
  misc_feature 1..51: note = chr16:85075519-85075570
  misc_feature 1..51: note = hypo
  source 1..51: mol_type = genomic DNA
cgattcccgggattccgagcgtttgcccctatgctgcgcactcctgtccct

SEQ ID NO: 44776 - DNA, 214 bp, Homo sapiens
  misc_feature 1..214: note = chr16:85083548-85083762
  misc_feature 1..214: note = hypo
  source 1..214: mol_type = genomic DNA
agtggaaggccaagtcggtctctgtccgagttgaattcagctgtcccggagtcagccgctgtgtccttttgtgaaagaagtacagcccgtcacccagggagggcgcgccttatggcgggttctaacacgcagttgcaatggaaccaactcagtcaatggtgatcgctgatggtaaacaacccctcaccctgcactgtctcggtgcctgaaactc

SEQ ID NO: 44777 - DNA, 30 bp, Homo sapiens
  misc_feature 1..30: note = chr16:85318173-85318203
  misc_feature 1..30: note = hypo
  source 1..30: mol_type = genomic DNA
cgattctcgggaactcggtgcagatgctgt

SEQ ID NO: 44778 - DNA, 30 bp, Homo sapiens
  misc_feature 1..30: note = chr16:85328964-85328994
  misc_feature 1..30: note = hypo
  source 1..30: mol_type = genomic DNA
ttttcaaggttcacgcgtgctgcagcgcgg

SEQ ID NO: 44779 - DNA, 239 bp, Homo sapiens
  misc_feature 1..239: note = chr16:85336342-85336581
  misc_feature 1..239: note = hypo
  source 1..239: mol_type = genomic DNA
atctgaacctgagaacgtgatgagctccaggaggtcaattcttggccttggccttgtcgaggtgcggtgtgctgggcagggtgggtgaggtcagcggctgtcacaagtaaccctgcgtcttcagtggcgtgatgcagccgaagcgcattctccttcaatcgggtccaacggggtgctcagtgggtcttccacaaggtgactcggggtccggtttcccggagcctcggcctccccactgc

SEQ ID NO: 44780 - DNA, 68 bp, Homo sapiens; identical to SEQ ID NO: 16082
  misc_feature 1..68: note = chr16:85455150-85455218
  misc_feature 1..68: note = hypo
  source 1..68: mol_type = genomic DNA

SEQ ID NO: 44781 - DNA, 30 bp, Homo sapiens
  misc_feature 1..30: note = chr16:85464272-85464302
  misc_feature 1..30: note = hypo
  source 1..30: mol_type = genomic DNA
gatagtccccaggtacgggctgggcacagg

SEQ ID NO: 44782 - DNA, 86 bp, Homo sapiens
  misc_feature 1..86: note = chr16:85485769-85485855
  misc_feature 1..86: note = hypo
  source 1..86: mol_type = genomic DNA
caccctggcctgcatcggggccccgcaattaagccgattatgttttgagagtcaagctgtctgactcctcgcgtccctaatgtgat

SEQ ID NO: 44783 - DNA, 45 bp, Homo sapiens
  misc_feature 1..45: note = chr16:85516822-85516867
  misc_feature 1..45: note = hypo
  source 1..45: mol_type = genomic DNA
tgaaacctgaaaaagcgaggctctctgtcccgagctttcagagga

SEQ ID NO: 44784 - DNA, 135 bp, Homo sapiens
  misc_feature 1..135: note = chr16:85517218-85517353
  misc_feature 1..135: note = hypo
  source 1..135: mol_type = genomic DNA
gggatcaagtgtctccgaggcggcgggctgagacggatgggcctcctggccgcacacctgagaacatgctggcaaaagcgtttgcttaattaattgactttgagcgagggagcccgtccccgtgtaaacctagca

SEQ ID NO: 44785 - DNA, 30 bp, Homo sapiens
  misc_feature 1..30: note = chr16:85517571-85517601
  misc_feature 1..30: note = hypo
  source 1..30: mol_type = genomic DNA
aggaaacctcctcagcgaccctccccgaga

SEQ ID NO: 44786 - DNA, 70 bp, Homo sapiens
  misc_feature 1..70: note = chr16:85617748-85617818
  misc_feature 1..70: note = hypo
  source 1..70: mol_type = genomic DNA
gcgtgcgtgccggtgcgtgggcccctgtctgtttggagaccttcctccccctctgcgtgttccccaagat

SEQ ID NO: 44787 - DNA, 47 bp, Homo sapiens
  misc_feature 1..47: note = chr16:85668941-85668988
  misc_feature 1..47: note = hypo
  source 1..47: mol_type = genomic DNA
aggcacaggcaggaccgccagaaaaccctccacgcccttggcagggg

SEQ ID NO: 44788 - DNA, 32 bp, Homo sapiens; identical to SEQ ID NO: 16084
  misc_feature 1..32: note = chr16:85671134-85671166
  misc_feature 1..32: note = hypo
  source 1..32: mol_type = genomic DNA

SEQ ID NO: 44789 - DNA, 55 bp, Homo sapiens
  misc_feature 1..55: note = chr16:85673184-85673239
  misc_feature 1..55: note = hypo
  source 1..55: mol_type = genomic DNA
aagaggtgtttgccccgagggtgccccgggaacgcctgtgcgtggagccaggccc

SEQ ID NO: 44790 - DNA, 48 bp, Homo sapiens
  misc_feature 1..48: note = chr16:85673838-85673886
  misc_feature 1..48: note = hypo
  source 1..48: mol_type = genomic DNA
tccctgcccacacttcgctcccttaacaccggccgggggctcatggta

SEQ ID NO: 44791 - DNA, 144 bp, Homo sapiens
  misc_feature 1..144: note = chr16:85674157-85674301
  misc_feature 1..144: note = hypo
  source 1..144: mol_type = genomic DNA
ggtgccacctgaaaccgagatcccagctgagtgagtggggactacgtgtgcggggaccacggagcagggaccacagacccatcctcatgagctgccgtgggaatgcttccaccgtggagccggcctgggcgggggagaggctcc

SEQ ID NO: 44792 - DNA, 541 bp, Homo sapiens
  misc_feature 1..541: note = chr16:85678216-85678757
  misc_feature 1..541: note = hypo
  source 1..541: mol_type = genomic DNA
gcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgcccctgaggtgaggggcgtggtgccccgccctgcagccagcgtttcccctcctcaggtggatctagtagcccgccggcacagtgcccagtcccaggtgttggcccggtcgacttggggt

SEQ ID NO: 44793 - DNA, 531 bp, Homo sapiens
  misc_feature 1..531: note = chr16:85684063-85684594
  misc_feature 1..531: note = hypo
  source 1..531: mol_type = genomic DNA
ccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatgagatgaaaaagcctgttttaaagctaacagggcatgtcccgcctgtctgactat

SEQ ID NO: 44794 - DNA, 61 bp, Homo sapiens
  misc_feature 1..61: note = chr16:85699784-85699845
  misc_feature 1..61: note = hypo
  source 1..61: mol_type = genomic DNA
atgcttcactatatccggggcgctgcacccaaggacattcctgtgccgctgtcccacagca

SEQ ID NO: 44795 - DNA, 40 bp, Homo sapiens
  misc_feature 1..40: note = chr16:85721581-85721621
  misc_feature 1..40: note = hypo
  source 1..40: mol_type = genomic DNA
ctgaaaacgcaaagccgggcgggcgcgggggctcacaatc

SEQ ID NO: 44796 - DNA, 163 bp, Homo sapiens
  misc_feature 1..163: note = chr16:85731450-85731613
  misc_feature 1..163: note = hypo
  source 1..163: mol_type = genomic DNA
tggaagtggtttattcggaatgcagtcccaggaagggaggttgagaccgggaacttgagaaggagctggttcaggttagcgagaaggtttctatggccggcaaccagggctcagttccaccgggaacctctgggcagctatgacgcctcgctcctcagtgtgg

SEQ ID NO: 44797 - DNA, 30 bp, Homo sapiens
  misc_feature 1..30: note = chr16:85741538-85741568
  misc_feature 1..30: note = hypo
  source 1..30: mol_type = genomic DNA
aggcagccacgcccccggacacctgaagcc

SEQ ID NO: 44798 - DNA, 30 bp, Homo sapiens
  misc_feature 1..30: note = chr16:85752258-85752288
  misc_feature 1..30: note = hypo
  source 1..30: mol_type = genomic DNA
tcactccagccaatgcggtgcgatgattct

SEQ ID NO: 44799 - DNA, 30 bp, Homo sapiens
  misc_feature 1..30: note = chr16:85758266-85758296
  misc_feature 1..30: note = hypo
  source 1..30: mol_type = genomic DNA
gaatcatggggatgacgaggataatgggga

SEQ ID NO: 44800 - DNA, 55 bp, Homo sapiens
  misc_feature 1..55: note = chr16:86119064-86119119
  misc_feature 1..55: note = hypo
  source 1..55: mol_type = genomic DNA
tgtggaaaaggcctccggactgcctcctgcttggagaagccgcattcctgagaac

SEQ ID NO: 44801 - DNA, 62 bp, Homo sapiens
  misc_feature 1..62: note = chr16:86215345-86215407
  misc_feature 1..62: note = hypo
  source 1..62: mol_type = genomic DNA
gccaggccatgagcacgtgctgggctaaggctgcagtgagagacggccgcccaggtcagtga

SEQ ID NO: 44802 - DNA, 45 bp, Homo sapiens
  misc_feature 1..45: note = chr16:86878195-86878240
  misc_feature 1..45: note = hypo
  source 1..45: mol_type = genomic DNA
gctgggattacaggcttgagccaccgcgcccggctggtgacttct

SEQ ID NO: 44803 - DNA, 38 bp, Homo sapiens
  misc_feature 1..38: note = chr16:86903475-86903513
  misc_feature 1..38: note = hypo
  source 1..38: mol_type = genomic DNA
cggagaggtgatggccgcgcaggcgcagtttggaactg

SEQ ID NO: 44804 - DNA, 30 bp, Homo sapiens
  misc_feature 1..30: note = chr16:87022637-87022667
  misc_feature 1..30: note = hypo
  source 1..30: mol_type = genomic DNA
ctatgacacaggtgacgtgcgtgacgcacc

SEQ ID NO: 44805 - DNA, 177 bp, Homo sapiens
  misc_feature 1..177: note = chr16:87092376-87092553
  misc_feature 1..177: note = hypo
  source 1..177: mol_type = genomic DNA
tgacaaatatgctctcggatagaacagcccagaaagggcaagagggagagttggaacactcagataattacccttcagcgacgcagtgcacttaagtggtgaaaggagattcactggttggaaaaacactccagggcgaagggccagcgtgtgcaaaagcaccgaagcatgaccgag

SEQ ID NO: 44806 - DNA, 30 bp, Homo sapiens
  misc_feature 1..30: note = chr16:87188016-87188046
  misc_feature 1..30: note = hypo
  source 1..30: mol_type = genomic DNA
aagtgcccagtccctcgagatgcttaaagt

SEQ ID NO: 44807 - DNA, 147 bp, Homo sapiens; identical to SEQ ID NO: 16090
  misc_feature 1..147: note = chr16:87296936-87297083
  misc_feature 1..147: note = hypo
  source 1..147: mol_type = genomic DNA

SEQ ID NO: 44808 - DNA, 135 bp, Homo sapiens
  misc_feature 1..135: note = chr16:87354991-87355126
  misc_feature 1..135: note = hypo
  source 1..135: mol_type = genomic DNA
gcacaaaggctgagccgcaccctgccaaaggagaaaggcagacagactccctgctgggagagcccactccccagacgttctggttgaggctgaactacggggtggagagcagatcaggggcgccaggggctggag

SEQ ID NO: 44809 - DNA, 46 bp, Homo sapiens
  misc_feature 1..46: note = chr16:87356783-87356829
  misc_feature 1..46: note = hypo
  source 1..46: mol_type = genomic DNA
acgcatggagcggcccggcgcacgactcacccggccccaaacacca

SEQ ID NO: 44810 - DNA, 85 bp, Homo sapiens
  misc_feature 1..85: note = chr16:87421370-87421455
  misc_feature 1..85: note = hypo
  source 1..85: mol_type = genomic DNA
ccacatgcactgggcaatggtgcattccagcctgggcgacagagagaaaaaaaagaaagaaagaaagccacgttaactgtatccc

SEQ ID NO: 44811 - DNA, 130 bp, Homo sapiens
  misc_feature 1..130: note = chr16:87594957-87595087
  misc_feature 1..130: note = hypo
  source 1..130: mol_type = genomic DNA
cctaaggattggaaacgaccatcggcaggggacgggttaaaccgattaaggtgactgacaccgcgcagtgatgcgcagccagtgtaacggccctgtggaggacatctaggtgcatcgtctggtagaaggt

SEQ ID NO: 44812 - DNA, 93 bp, Homo sapiens
  misc_feature 1..93: note = chr16:87648265-87648358
  misc_feature 1..93: note = hypo
  source 1..93: mol_type = genomic DNA
gcaggtccctgcacacgtgaggagccgcgcgtcccctcccgggataaactctggtccctgcacacacgaggagccgcgcgtcccctcccggga

SEQ ID NO: 44813 - DNA, 112 bp, Homo sapiens
  misc_feature 1..112: note = chr16:87688591-87688703
  misc_feature 1..112: note = hypo
  source 1..112: mol_type = genomic DNA
tttgttgcagtcccccgggggcatggcccggcaagtttccttagccaggggccagtttgcctggggtcagtgggcagcgcctgggagtcgagtgtctcgagtggggctctgc

SEQ ID NO: 44814 - DNA, 30 bp, Homo sapiens
  misc_feature 1..30: note = chr16:87701846-87701876
  misc_feature 1..30: note = hypo
  source 1..30: mol_type = genomic DNA
cggagccggcacatgcgtctgacagcagcg

SEQ ID NO: 44815 - DNA, 171 bp, Homo sapiens
  misc_feature 1..171: note = chr16:87723156-87723327
  misc_feature 1..171: note = hypo
  source 1..171: mol_type = genomic DNA
tgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgca

SEQ ID NO: 44816 - DNA, 507 bp, Homo sapiens
  misc_feature 1..507: note = chr16:87723606-87724113
  misc_feature 1..507: note = hypo
  source 1..507: mol_type = genomic DNA
gcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatgggga

SEQ ID NO: 44817 - DNA, 48 bp, Homo sapiens
  misc_feature 1..48: note = chr16:88101496-88101544
  misc_feature 1..48: note = hypo
  source 1..48: mol_type = genomic DNA
cttcccgcagttacacgttgcacggggcctccccgtagcatccactgt

SEQ ID NO: 44818 - DNA, 86 bp, Homo sapiens
  misc_feature 1..86: note = chr16:88164472-88164558
  misc_feature 1..86: note = hypo
  source 1..86: mol_type = genomic DNA
cgcgtgggaaggccccgcggagtgggggtgtgaagtggccgcggggtgtcggcagagacaggcggaagtggcgtcccgatgaggac

SEQ ID NO: 44819 - DNA, 191 bp, Homo sapiens
  misc_feature 1..191: note = chr16:88165560-88165751
  misc_feature 1..191: note = hypo
  source 1..191: mol_type = genomic DNA
cggcccgcgcatctccggggctgctgaagacagggcagcgatgctccgcccgtgggaagctgggcagcggcaggacggcactcccagcctctccatcggctttgaatcacggcctggagttccgatgcttcgtggccactctcctctccatgtgtggacatcgctgtctgtggccccggccataccgatgg

SEQ ID NO: 44820 - DNA, 85 bp, Homo sapiens
  misc_feature 1..85: note = chr16:88375259-88375344
  misc_feature 1..85: note = hypo
  source 1..85: mol_type = genomic DNA
gtggactgggtatctcggttttgccatctgcgggggcatggatgcatgctccctgaggcaggtggtgcagcgtccacagactggg

SEQ ID NO: 44821 - DNA, 159 bp, Homo sapiens
  misc_feature 1..159: note = chr16:88476104-88476263
  misc_feature 1..159: note = hypo
  source 1..159: mol_type = genomic DNA
acgtgtgcagctctgcgtgaggaaaatgcaaacaaagctcggtaaagcaggccggggcccacacatgcgggcagggcatccaggcagcttgggcagagtgatcagaggtcctcgctcagtggcctgtgagcggaggcctgagtgcgacaggtgtggtgg

SEQ ID NO: 44822 - DNA, 170 bp, Homo sapiens
  misc_feature 1..170: note = chr16:88495551-88495721
  misc_feature 1..170: note = hypo
  source 1..170: mol_type = genomic DNA
tcagcccctgttcttcggggtggcccagccccaggtttcaccccacgggacacccagcctgcccccaccgagggtagtgggagcctcccccagcgagtccccactgccgtcaccggccaccaacacggccggcagcacctgctcttccctgtcgccgatgtccagcagcc

SEQ ID NO: 44823 - DNA, 36 bp, Homo sapiens
  misc_feature 1..36: note = chr16:88498199-88498235
  misc_feature 1..36: note = hypo
  source 1..36: mol_type = genomic DNA
caggcagggctgcatcgccaccgaccttggagtcct

SEQ ID NO: 44824 - DNA, 305 bp, Homo sapiens
  misc_feature 1..305: note = chr16:88498512-88498817
  misc_feature 1..305: note = hypo
  source 1..305: mol_type = genomic DNA
ggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccg

SEQ ID NO: 44825 - DNA, 30 bp, Homo sapiens
  misc_feature 1..30: note = chr16:88502327-88502357
  misc_feature 1..30: note = hypo
  source 1..30: mol_type = genomic DNA
gcctccagggcctcccggacaacccagaca

SEQ ID NO: 44826 - DNA, 30 bp, Homo sapiens
  misc_feature 1..30: note = chr16:88502901-88502931
  misc_feature 1..30: note = hypo
  source 1..30: mol_type = genomic DNA
ctcctcctcttctctcggagatgtgagccc

SEQ ID NO: 44827 - DNA, 30 bp, Homo sapiens; identical to SEQ ID NO: 16096
  misc_feature 1..30: note = chr16:88503235-88503265
  misc_feature 1..30: note = hypo
  source 1..30: mol_type = genomic DNA

SEQ ID NO: 44828 - DNA, 161 bp, Homo sapiens
  misc_feature 1..161: note = chr16:88503557-88503718
  misc_feature 1..161: note = hypo
  source 1..161: mol_type = genomic DNA
ttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagc

SEQ ID NO: 44829 - DNA, 336 bp, Homo sapiens
  misc_feature 1..336: note = chr16:88504017-88504353
  misc_feature 1..336: note = hypo
  source 1..336: mol_type = genomic DNA
gctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcc

SEQ ID NO: 44830 - DNA, 30 bp, Homo sapiens
  misc_feature 1..30: note = chr16:88504602-88504632
  misc_feature 1..30: note = hypo
  source 1..30: mol_type = genomic DNA
ggagaggccagagaacgaggcttccccagg

SEQ ID NO: 44831 - DNA, 153 bp, Homo sapiens
  misc_feature 1..153: note = chr16:88506388-88506541
  misc_feature 1..153: note = hypo
  source 1..153: mol_type = genomic DNA
cttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatg

SEQ ID NO: 44832 - DNA, 250 bp, Homo sapiens
  misc_feature 1..250: note = chr16:88507040-88507290
  misc_feature 1..250: note = hypo
  source 1..250: mol_type = genomic DNA
gtaggccattcaaaacgcctccggagtgtcgcaaaccaagtgcggaggggccctgaggttgtactgtaaacatcatagtgacttgtcttttcaaatatattcccactattttcgcagaaaacctccagctgcgtgacgtctgtcctcccgccggcccccatccctggtctgcacctccctgagcctcagaacttggctcccagggtgtctgcgccagctgccactctcgggccaccgtgggccaagggcc

SEQ ID NO: 44833 - DNA, 90 bp, Homo sapiens
  misc_feature 1..90: note = chr16:88507982-88508072
  misc_feature 1..90: note = hypo
  source 1..90: mol_type = genomic DNA
cctcccccaggtgggcgctgggcctcccctgctttccacttgttgctggcggaactcacaccgtaagggcgtctgcgaaggggcccagcg

SEQ ID NO: 44834 - DNA, 123 bp, Homo sapiens
  misc_feature 1..123: note = chr16:88512427-88512550
  misc_feature 1..123: note = hypo
  source 1..123: mol_type = genomic DNA
ctcaccgtgtctcagcgtcaggctcaggcccggggccctgacatttagatagggccaggtgtggctgaggccatcgagtcattcctccggtgaagtatgcccgtgcgtcggggtgcagggcac

SEQ ID NO: 44835 - DNA, 124 bp, Homo sapiens
  misc_feature 1..124: note = chr16:88551425-88551549
  misc_feature 1..124: note = hypo
  source 1..124: mol_type = genomic DNA
cgacaagtctgtgagcgcctcctttgtgctgggtgagggtgtcaccccagggagttcccagaccgagggaatgagtgtgagggaagtgcacggggactgggcccctgggcggggcactggcagg

SEQ ID NO: 44836 - DNA, 30 bp, Homo sapiens
  misc_feature 1..30: note = chr16:88601644-88601674
  misc_feature 1..30: note = hypo
  source 1..30: mol_type = genomic DNA
gtacacaggccactgcggcccggagtggct

SEQ ID NO: 44837 - DNA, 51 bp, Homo sapiens
  misc_feature 1..51: note = chr16:88602946-88602997
  misc_feature 1..51: note = hypo
  source 1..51: mol_type = genomic DNA
aggcaaagaaggcagcggcctcttgcctcagaagcccgaggcacttcccag

SEQ ID NO: 44838 - DNA, 46 bp, Homo sapiens; identical to SEQ ID NO: 16101
  misc_feature 1..46: note = chr16:88603730-88603776
  misc_feature 1..46: note = hypo
  source 1..46: mol_type = genomic DNA

SEQ ID NO: 44839 - DNA, 39 bp, Homo sapiens; identical to SEQ ID NO: 16102
  misc_feature 1..39: note = chr16:88623960-88623999
  misc_feature 1..39: note = hypo
  source 1..39: mol_type = genomic DNA

SEQ ID NO: 44840 - DNA, 61 bp, Homo sapiens
  misc_feature 1..61: note = chr16:88624831-88624892
  misc_feature 1..61: note = hypo
  source 1..61: mol_type = genomic DNA
tccgggggtgtgagtcgcgcatccccccgtcggggggtgagtcgcccgtccccccgtgctc

SEQ ID NO: 44841 - DNA, 83 bp, Homo sapiens
  misc_feature 1..83: note = chr16:88683834-88683917
  misc_feature 1..83: note = hypo
  source 1..83: mol_type = genomic DNA
gtagagctaagggggcggtcccttatgtgaaacctaatctttatagctaggccgatgggtgtgctcaccgccgaggcacgtca

SEQ ID NO: 44842 - DNA, 96 bp, Homo sapiens
  misc_feature 1..96: note = chr16:88722642-88722738
  misc_feature 1..96: note = hypo
  source 1..96: mol_type = genomic DNA
ctgcctgagccccggcgagccacttctgagaggtcactctccacgccgtagacacgggccagggtgtaggctgcaggcatgcggattcagggaggg

SEQ ID NO: 44843 - DNA, 107 bp, Homo sapiens
  misc_feature 1..107: note = chr16:88757527-88757634
  misc_feature 1..107: note = hypo
  source 1..107: mol_type = genomic DNA
tgagccatcaagcagcgaggcagcgtgcgtgtgagtctgcaggccacaggcgtgttcgtgcgtgtgtccatgggcgtatgcgtgtgggaagtcgcagtagctgctct

SEQ ID NO: 44844 - DNA, 120 bp, Homo sapiens
  misc_feature 1..120: note = chr16:88791699-88791819
  misc_feature 1..120: note = hypo
  source 1..120: mol_type = genomic DNA
tgcggacaggacaggcgggctgggagccctgtgggacgtcacatgggcacagacgcagcacacgccagcaggcacagacatgctggacacggggccctgggtgcccgactccagctgcac

SEQ ID NO: 44845 - DNA, 42 bp, Homo sapiens
  misc_feature 1..42: note = chr16:88793407-88793449
  misc_feature 1..42: note = hypo
  source 1..42: mol_type = genomic DNA
tcccagaaggttccccgtggagggtgacgtggaacccacctg

SEQ ID NO: 44846 - DNA, 157 bp, Homo sapiens
  misc_feature 1..157: note = chr16:88794604-88794761
  misc_feature 1..157: note = hypo
  source 1..157: mol_type = genomic DNA
tgctggggatgggagcggccggggcctgctggggagggagccgtggcactgccggcccccggccacacttcctgggaggcgtgtgaggcagggagggtcggtccctaaggactgagggcatggatgtgactccacgcatctgcgaaacccacagccc

SEQ ID NO: 44847 - DNA, 30 bp, Homo sapiens
  misc_feature 1..30: note = chr16:88798777-88798807
  misc_feature 1..30: note = hypo
  source 1..30: mol_type = genomic DNA
agtacttgaggcagccgagcagatcctggt

SEQ ID NO: 44848 - DNA, 30 bp, Homo sapiens
  misc_feature 1..30: note = chr16:88803397-88803427
  misc_feature 1..30: note = hypo
  source 1..30: mol_type = genomic DNA
ccctttccagctctgcgcacctgaagactc

SEQ ID NO: 44849 - DNA, 54 bp, Homo sapiens
  misc_feature 1..54: note = chr16:88805867-88805921
  misc_feature 1..54: note = hypo
  source 1..54: mol_type = genomic DNA
tccccatctgtgactcgggggctctcctggtggctgaggcgccaggtgcccggg

SEQ ID NO: 44850 - DNA, 30 bp, Homo sapiens
  misc_feature 1..30: note = chr16:88827321-88827351
  misc_feature 1..30: note = hypo
  source 1..30: mol_type = genomic DNA
ctcatctgacctacacggggcagggtcctg

SEQ ID NO: 44851 - DNA, 36 bp, Homo sapiens
  misc_feature 1..36: note = chr16:88831239-88831275
  misc_feature 1..36: note = hypo
  source 1..36: mol_type = genomic DNA
ccaaaacgaggactccgccctcggcaccaggggcag

SEQ ID NO: 44852 - DNA, 143 bp, Homo sapiens
  misc_feature 1..143: note = chr16:88832684-88832827
  misc_feature 1..143: note = hypo
  source 1..143: mol_type = genomic DNA
aggaattcccaggaccgccacagagaagcccggcctgagcgcacagcctggactcgagactgcaacagcggctcttgacagccagcgcgccctgcgaacttcagacgtgacagccccacaatcgcgtgcgtcagctccttaaa

SEQ ID NO: 44853 - DNA, 137 bp, Homo sapiens
  misc_feature 1..137: note = chr16:88879970-88880107
  misc_feature 1..137: note = hypo
  source 1..137: mol_type = genomic DNA
aacagcaaggagccccgagtcctgcccttcaacaaccaatgtggcgctggcctctggaggaggccggccgggaggcagcgggagctgggcacctgattcttggcagctgctgagaaggtgtgaaaggaaaataaatc

SEQ ID NO: 44854 - DNA, 21 bp, Homo sapiens
  misc_feature 1..21: note = chr16:88881425-88881446
  misc_feature 1..21: note = hypo
  source 1..21: mol_type = genomic DNA
ccaccgcgcttggcctcgagc

SEQ ID NO: 44855 - DNA, 633 bp, Homo sapiens
  misc_feature 1..633: note = chr16:88882841-88883474
  misc_feature 1..633: note = hypo
  source 1..633: mol_type = genomic DNA
gtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggctgaagtctgcagctgccgaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgagggccgcacgtgtcccatctgaa

SEQ ID NO: 44856 - DNA, 72 bp, Homo sapiens
  misc_feature 1..72: note = chr16:88884207-88884279
  misc_feature 1..72: note = hypo
  source 1..72: mol_type = genomic DNA
cgttgttctggtccccgagtcgcttggctcctgcctcccgaatcccggacgccgccgcgtgtgctctgaggc

SEQ ID NO: 44857 - DNA, 91 bp, Homo sapiens
  misc_feature 1..91: note = chr16:88931237-88931328
  misc_feature 1..91: note = hypo
  source 1..91: mol_type = genomic DNA
ggacctggggagcaccggcgcaccttgatgacccggccccggaagaggctctggtccagctccacggcggcctgcacggagcccttggtgg

SEQ ID NO: 44858 - DNA, 30 bp, Homo sapiens
  misc_feature 1..30: note = chr16:88933367-88933397
  misc_feature 1..30: note = hypo
  source 1..30: mol_type = genomic DNA
cactgcatgaacactcgatctaagtgggaa

SEQ ID NO: 44859 - DNA, 30 bp, Homo sapiens
  misc_feature 1..30: note = chr16:88941444-88941474
  misc_feature 1..30: note = hypo
  source 1..30: mol_type = genomic DNA
aactcctgatagccacgcacacagatgcca

SEQ ID NO: 44860 - DNA, 156 bp, Homo sapiens
  misc_feature 1..156: note = chr16:88941985-88942141
  misc_feature 1..156: note = hypo
  source 1..156: mol_type = genomic DNA
aggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaag

SEQ ID NO: 44861 - DNA, 78 bp, Homo sapiens
  misc_feature 1..78: note = chr16:88943090-88943168
  misc_feature 1..78: note = hypo
  source 1..78: mol_type = genomic DNA
tgtctaaagctcagtcgaggcttctgaggatgcttgaagagacgttgtcaggaggtctccgcgcggaatcattaggta

SEQ ID NO: 44862 - DNA, 582 bp, Homo sapiens
  misc_feature 1..582: note = chr16:88943442-88944024
  misc_feature 1..582: note = hypo
  source 1..582: mol_type = genomic DNA
ccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggc

SEQ ID NO: 44863 - DNA, 63 bp, Homo sapiens
  misc_feature 1..63: note = chr16:88944955-88945018
  misc_feature 1..63: note = hypo
  source 1..63: mol_type = genomic DNA
aattctcaggcctgccgtgtgcaccgggagggagccgggcgcctcggacgccacctggggccc

SEQ ID NO: 44864 - DNA, 477 bp, Homo sapiens; identical to SEQ ID NO: 16111
  misc_feature 1..477: note = chr16:88945602-88946079
  misc_feature 1..477: note = hypo
  source 1..477: mol_type = genomic DNA

SEQ ID NO: 44865 - DNA, 440 bp, Homo sapiens
  misc_feature 1..440: note = chr16:88948329-88948769
  misc_feature 1..440: note = hypo
  source 1..440: mol_type = genomic DNA
agcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgt

SEQ ID NO: 44866 - DNA, 579 bp, Homo sapiens
  misc_feature 1..579: note = chr16:88952219-88952798
  misc_feature 1..579: note = hypo
  source 1..579: mol_type = genomic DNA
tagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgt

SEQ ID NO: 44867 - DNA, 179 bp, Homo sapiens
  misc_feature 1..179: note = chr16:88955189-88955368
  misc_feature 1..179: note = hypo
  source 1..179: mol_type = genomic DNA
atgtcccactggccccgggccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccaggg

SEQ ID NO: 44868 - DNA, 198 bp, Homo sapiens
  misc_feature 1..198: note = chr16:88956141-88956339
  misc_feature 1..198: note = hypo
  source 1..198: mol_type = genomic DNA
cttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctc

SEQ ID NO: 44869 - DNA, 118 bp, Homo sapiens
  misc_feature 1..118: note = chr16:88956594-88956712
  misc_feature 1..118: note = hypo
  source 1..118: mol_type = genomic DNA
agattcccctgagcccgggagtgaggccccgttctttccgcgtgtccctccacgctgtctcctcaacagcctgaggatgattccattttgcagatacagaaaccgaagcacagaggaa

SEQ ID NO: 44870 - DNA, 622 bp, Homo sapiens
  misc_feature 1..622: note = chr16:88957373-88957995
  misc_feature 1..622: note = hypo
  source 1..622: mol_type = genomic DNA
agactggcatctttaaaaatgcaggctctgattcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaaatcacccgtggagtgagcgagcacattcggccaacggcaaccagaggcg

SEQ ID NO: 44871 - DNA, 104 bp, Homo sapiens
  misc_feature 1..104: note = chr16:88958345-88958449
  misc_feature 1..104: note = hypo
  source 1..104: mol_type = genomic DNA
tggaatgaaactcctcgatcgtcaatgtcgagttctgcaggggagaaaacccacctcacatcagcaccgctcggcatgtgagccagcgccgacccacccatgcc

SEQ ID NO: 44872 - DNA, 99 bp, Homo sapiens
  misc_feature 1..99: note = chr16:88962807-88962906
  misc_feature 1..99: note = hypo
  source 1..99: mol_type = genomic DNA
tggagcgcgcggcaccgataacggcgtcgtattctggggctttccctcttctggggggacagtggacgctgacacaggatgcaccgagcccctggtctc

SEQ ID NO: 44873 - DNA, 549 bp, Homo sapiens; identical to SEQ ID NO: 5180
  misc_feature 1..549: note = chr16:88963214-88963763
  misc_feature 1..549: note = hypo
  source 1..549: mol_type = genomic DNA

SEQ ID NO: 44874 - DNA, 30 bp, Homo sapiens
  misc_feature 1..30: note = chr16:88965028-88965058
  misc_feature 1..30: note = hypo
  source 1..30: mol_type = genomic DNA
ctcagggacctgggccgaagccgcgtgtcc

SEQ ID NO: 44875 - DNA, 443 bp, Homo sapiens
  misc_feature 1..443: note = chr16:88966387-88966830
  misc_feature 1..443: note = hypo
  source 1..443: mol_type = genomic DNA
agggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggccccca

SEQ ID NO: 44876 - DNA, 224 bp, Homo sapiens
  misc_feature 1..224: note = chr16:88967701-88967925
  misc_feature 1..224: note = hypo
  source 1..224: mol_type = genomic DNA
ggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtg

SEQ ID NO: 44877 - DNA, 520 bp, Homo sapiens
  misc_feature 1..520: note = chr16:88968292-88968812
  misc_feature 1..520: note = hypo
  source 1..520: mol_type = genomic DNA
tggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaa

SEQ ID NO: 44878 - DNA, 30 bp, Homo sapiens
  misc_feature 1..30: note = chr16:88970496-88970526
  misc_feature 1..30: note = hypo
  source 1..30: mol_type = genomic DNA
catggccaccacctgcgtgctcacggccac

SEQ ID NO: 44879 - DNA, 50 bp, Homo sapiens
  misc_feature 1..50: note = chr16:88976653-88976703
  misc_feature 1..50: note = hypo
  source 1..50: mol_type = genomic DNA
aggctgcctccttcccggtgatgctgcagcccgcgcggcccttcaccctg

SEQ ID NO: 44880 - DNA, 172 bp, Homo sapiens
  misc_feature 1..172: note = chr16:88977950-88978122
  misc_feature 1..172: note = hypo
  source 1..172: mol_type = genomic DNA
ctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccaccca

SEQ ID NO: 44881 - DNA, 30 bp, Homo sapiens
  misc_feature 1..30: note = chr16:88980132-88980162
  misc_feature 1..30: note = hypo
  source 1..30: mol_type = genomic DNA
tgtttgtcacagcatcgtttatgagaatga

SEQ ID NO: 44882 - DNA, 81 bp, Homo sapiens
  misc_feature 1..81: note = chr16:88993078-88993159
  misc_feature 1..81: note = hypo
  source 1..81: mol_type = genomic DNA
agctggccatggtcccgtgcgtgccagggtggggcctgctgagcctcagtttcctcggctgtaagacgggacggaggtgtt

SEQ ID NO: 44883 - DNA, 272 bp, Homo sapiens
  misc_feature 1..272: note = chr16:88994398-88994670
  misc_feature 1..272: note = hypo
  source 1..272: mol_type = genomic DNA
tctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctg

SEQ ID NO: 44884 - DNA, 88 bp, Homo sapiens
  misc_feature 1..88: note = chr16:89000151-89000239
  misc_feature 1..88: note = hypo
  source 1..88: mol_type = genomic DNA
tctatacgcctcacacgcctcacagtgccacacgtctgcgtccccacagccatagtggccacttcatgccacgcgtatgtgacttggt

SEQ ID NO: 44885 - DNA, 161 bp, Homo sapiens
  misc_feature 1..161: note = chr16:89001001-89001162
  misc_feature 1..161: note = hypo
  source 1..161: mol_type = genomic DNA
ggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttc

SEQ ID NO: 44886 - DNA, 38 bp, Homo sapiens; identical to SEQ ID NO: 16126
  misc_feature 1..38: note = chr16:89025782-89025820
  misc_feature 1..38: note = hypo
  source 1..38: mol_type = genomic DNA

SEQ ID NO: 44887 - DNA, 93 bp, Homo sapiens
  misc_feature 1..93: note = chr16:89026022-89026115
  misc_feature 1..93: note = hypo
  source 1..93: mol_type = genomic DNA
ggagagggaaggtcccggggaaaccctccttttcctcctccttcctcccagcagctgggaaaggcgatggagagaaaacgggagcagggcaga

SEQ ID NO: 44888 - DNA, 30 bp, Homo sapiens
  misc_feature 1..30: note = chr16:89028699-89028729
  misc_feature 1..30: note = hypo
  source 1..30: mol_type = genomic DNA
tttccactgcatactcgtacttttttactt

SEQ ID NO: 44889 - DNA, 30 bp, Homo sapiens
  misc_feature 1..30: note = chr16:89029708-89029738
  misc_feature 1..30: note = hypo
  source 1..30: mol_type = genomic DNA
atcttctgccaggggcgggcgctcatcttc

SEQ ID NO: 44890 - DNA, 535 bp, Homo sapiens
  misc_feature 1..535: note = chr16:89055410-89055945
  misc_feature 1..535: note = hypo
  source 1..535: mol_type = genomic DNA
acccactcagtgtctcgtgcatggcacacacgtgtcctgcgggcccgctgggagctggctgctggtccctgtacgaggctgggggtctgacctcaccaccagggacagacagcaaagcagaccatgagacaggggagcaaagccgtgcggtgggaggggtgaggcgtgcggcatgactgcagggcggggagggcctcaaggggagaggcaactcggggcagcccgcatggcccaggcgtgggtcaagctctgggaggcacgctccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggagccggggccatatggcc

SEQ ID NO: 44891 - DNA, 324 bp, Homo sapiens
  misc_feature 1..324: note = chr16:89072503-89072827
  misc_feature 1..324: note = hypo
  source 1..324: mol_type = genomic DNA
ggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctggagacaaggaactgactgcaagtggaccatttgcagggcgaccccaagggcag

SEQ ID NO: 44892 - DNA, 30 bp, Homo sapiens
  misc_feature 1..30: note = chr16:89103482-89103512
  misc_feature 1..30: note = hypo
  source 1..30: mol_type = genomic DNA
ctccattctcttggccgcctgaaagtcatc

SEQ ID NO: 44893 - DNA, 123 bp, Homo sapiens
  misc_feature 1..123: note = chr16:89105547-89105670
  misc_feature 1..123: note = hypo
  source 1..123: mol_type = genomic DNA
caaggtggaggtctgcggggcgcaggtctctgtctggggctgccatccacatacgctgtggctcatgtacagtgaccacctgctgcaggatgagacggtggcacccgccgctccctgagagcg

SEQ ID NO: 44894 - DNA, 137 bp, Homo sapiens
  misc_feature 1..137: note = chr16:89107647-89107784
  misc_feature 1..137: note = hypo
  source 1..137: mol_type = genomic DNA
ggagggcaaccgagtcggcctgggttcaagttctccagagtgccggccctccactcgagttcccctgccccggggaatgccctttccctacacctgcaatcccctgagggacgggaggaggccggtagtccatgagc

SEQ ID NO: 44895 - DNA, 177 bp, Homo sapiens
  misc_feature 1..177: note = chr16:89109482-89109659
  misc_feature 1..177: note = hypo
  source 1..177: mol_type = genomic DNA
attcccgtgaggtggcgggagaagattctatgattgatccgtcatgcctgccgtggctcaggatgggaccggcctctcaagctacagatcaagaaactgagaagggagtagcctaaagtcaccatgagagtggccaggtctgggccggcctggcctccaccccgcagagaccatctc

SEQ ID NO: 44896 - DNA, 30 bp, Homo sapiens
  misc_feature 1..30: note = chr16:89110091-89110121
  misc_feature 1..30: note = hypo
  source 1..30: mol_type = genomic DNA
atctcctgggagaaccggtattgccaggtt

SEQ ID NO: 44897 - DNA, 30 bp, Homo sapiens
  misc_feature 1..30: note = chr16:89115322-89115352
  misc_feature 1..30: note = hypo
  source 1..30: mol_type = genomic DNA
tgtggggcagactcccgctcagaggggcct

SEQ ID NO: 44898 - DNA, 368 bp, Homo sapiens
  misc_feature 1..368: note = chr16:89120038-89120406
  misc_feature 1..368: note = hypo
  source 1..368: mol_type = genomic DNA
tgaggctgctccctccgcaaggtgggcgaggagccaggaagagccaagggagtggccaccctgccctgacggccaccaacggccaccacgtcaccctagaagacaacccaagcccgtctccccacacctcgcggatggtgcagtgcagagagaaggccgggcgggtgctggggggcccatctccccgagccttgcaaatagtgcagtgcagggagaaggccgggcgggtgctggggggcccgtctccctgtgactcgtggacggtgcggtgcagggagaagggcgggcaggtgctggaggactgagtgaggcccctccaggatggctccctgcccctccatgcgctgggtcctcgggccaggacaggt

SEQ ID NO: 44899 - DNA, 180 bp, Homo sapiens
  misc_feature 1..180: note = chr16:89120684-89120864
  misc_feature 1..180: note = hypo
  source 1..180: mol_type = genomic DNA
tggctggggctcctgcggccaccctgctccccagaacctcgtcgtcttcccggtgccctgcggcaggaacacagggctggagccgacccccagggcatggctgggagctgcgggagtgaacggggagttaacccccagggcatggctgggagctgcgggagtgaacggggagctgcctgt

SEQ ID NO: 44900 - DNA, 107 bp, Homo sapiens
  misc_feature 1..107: note = chr16:89138016-89138123
  misc_feature 1..107: note = hypo
  source 1..107: mol_type = genomic DNA
gaggaaagacagacacggcgttggctgcgcgggggcctgcatccctcccgaccttctcatttgatcctcctgccctatgcggttggtgccaacgttcatcccatttt

SEQ ID NO: 44901 - DNA, 25 bp, Homo sapiens
  misc_feature 1..25: note = chr16:89139536-89139561
  misc_feature 1..25: note = hypo
  source 1..25: mol_type = genomic DNA
cacttacctggagtgcggtggcccc

SEQ ID NO: 44902 - DNA, 52 bp, Homo sapiens
  misc_feature 1..52: note = chr16:89140367-89140419
  misc_feature 1..52: note = hypo
  source 1..52: mol_type = genomic DNA
gagccatgtcatgaacgactcatgcatgcaccagtcacgtgaggacctgtca

SEQ ID NO: 44903 - DNA, 30 bp, Homo sapiens
  misc_feature 1..30: note = chr16:89141923-89141953
  misc_feature 1..30: note = hypo
  source 1..30: mol_type = genomic DNA
agacaggcctccagccggggcacctcccaa

SEQ ID NO: 44904 - DNA, 402 bp, Homo sapiens
  misc_feature 1..402: note = chr16:89172134-89172536
  misc_feature 1..402: note = hypo
  source 1..402: mol_type = genomic DNA
agcaacggccattgtcgtggaccgtgccagggcgagatgcagctggcaggggcagaggcagaacatctcccagggagctgagggcaggttggttccatcgtcccggagggcaggttggttccatcctcccaagtaaagagtgtgttaccctcagggcgagaggcaggtgggtgtgggtgctggcgcaggccagctgtcaaggatctgggctttctggtcttgctgcttctccagcactgcatgaatgacaccacctggccctttccagtgcccacaggcacacggcttgggagctgctgctgcggcgtctctgcccaggggcatctgccagggggtccctgccttggggtctgtgtcccaagggcgtctgcccagggatttctgctccgagagtgtctaccc

SEQ ID NO: 44905 - DNA, 44 bp, Homo sapiens
  misc_feature 1..44: note = chr16:89189859-89189903
  misc_feature 1..44: note = hypo
  source 1..44: mol_type = genomic DNA
tgcccctcactaccacggtcccggatccacgtggctcaagtgag

SEQ ID NO: 44906 - DNA, 54 bp, Homo sapiens
  misc_feature 1..54: note = chr16:89219318-89219372
  misc_feature 1..54: note = hypo
  source 1..54: mol_type = genomic DNA
tggaaatgtggaggtcgaggttgacagcgacaccgaggtcgaagccagttgccc

SEQ ID NO: 44907 - DNA, 707 bp, Homo sapiens
  misc_feature 1..707: note = chr16:89220327-89221034
  misc_feature 1..707: note = hypo
  source 1..707: mol_type = genomic DNA
gggcagagacagctgcggtggcccggtgcacctgcctggcctcaggatggccgaggcgcctggcaaggctgcagggtcccaggggcacctgtccgtactgctgggcgcctgagttcctcctgctgggcactgtcagggcagtgcgcctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcctgtgcctca

SEQ ID NO: 44908 - DNA, 82 bp, Homo sapiens
  misc_feature 1..82: note = chr16:89225881-89225963
  misc_feature 1..82: note = hypo
  source 1..82: mol_type = genomic DNA
ggcggagggcgctgccgcaggtccccacatacccagcgcacgctcaccccacactggaggcacctgccgggttctgacaccc

SEQ ID NO: 44909 - DNA, 390 bp, Homo sapiens
  misc_feature 1..390: note = chr16:89226330-89226720
  misc_feature 1..390: note = hypo
  source 1..390: mol_type = genomic DNA
gcagatctggagaggcggagggatggggacggagcgccatgcagaggccgctcggtcctcaggagctgagcatcaccctgggagtctcaaggagggtgtcccctggccttagcgggcagccagggccagcatgtggtctgtggcagccggtctcagaggtggcctggttcgcagtcttgctggatggagatccccagctcctagggcaagggcaggtggggtggggccgcctcggtcagctgataggaactgaactgagaaggctgtgagccgctgagtcgccctaactgcagggtggtcctgcgggcagtactgagcccgccctgctgggcaccccacagcccctgtggctctccagctgccactgaggccggacgcctcatgaggagg

SEQ ID NO: 44910 - DNA, 112 bp, Homo sapiens
  misc_feature 1..112: note = chr16:89242936-89243048
  misc_feature 1..112: note = hypo
  source 1..112: mol_type = genomic DNA
actcggtgctccctccgctcgcacaatgtggggagctgttctaggtgttggtgtggcgtggccggcacacctctgtagtaggcacaggacttggtgccggctggggagtccc

SEQ ID NO: 44911 - DNA, 151 bp, Homo sapiens
  misc_feature 1..151: note = chr16:89245291-89245442
  misc_feature 1..151: note = hypo
  source 1..151: mol_type = genomic DNA
tgtgcccacaggcaccgccactggcttcttggggtcattccgtgtcaggaccccacgctctccccagccctggctggcccaggggctttccgtgtgcaccgctaccctggcacctggggcgaggctgtgtccccgccgggtgaatctcagg

SEQ ID NO: 44912 - DNA, 102 bp, Homo sapiens
  misc_feature 1..102: note = chr16:89245643-89245745
  misc_feature 1..102: note = hypo
  source 1..102: mol_type = genomic DNA
tttgcccttgtgctacgcagccccgtgtgtggaagccgccttgcgccaatgggcaccgacccgtgggctgagggaaacactgcgccccgtggcctcctcacc

SEQ ID NO: 44913 - DNA, 159 bp, Homo sapiens
  misc_feature 1..159: note = chr16:89254633-89254792
  misc_feature 1..159: note = hypo
  source 1..159: mol_type = genomic DNA
gggcagttcaccatccgcacggaccccaagaccaacgagggtgttctgtccattgtgaaggtgagcggcccccggctggcacacagatgccggcagacgcagatgccgacacacacagatgcccacacacagatgccggcacacacagatgcccacaca

SEQ ID NO: 44914 - DNA, 30 bp, Homo sapiens
  misc_feature 1..30: note = chr16:89311109-89311139
  misc_feature 1..30: note = hypo
  source 1..30: mol_type = genomic DNA
ttaggtagcttcgcccggctggcagacatg

SEQ ID NO: 44915 - DNA, 30 bp, Homo sapiens
  misc_feature 1..30: note = chr16:89531824-89531854
  misc_feature 1..30: note = hypo
  source 1..30: mol_type = genomic DNA
ttacagcagaggccacgacagagaacaggg

SEQ ID NO: 44916 - DNA, 134 bp, Homo sapiens
  misc_feature 1..134: note = chr16:89558631-89558765
  misc_feature 1..134: note = hypo
  source 1..134: mol_type = genomic DNA
tggatgaggggtgagcgcctgataaaaacagccggcgtatgcgctgatgtgcgttcacgaagaggtgatccaagtgtttccatatttgcctcactggacgaagtatttggtaaaattgacgaaattcagagtcc

SEQ ID NO: 44917 - DNA, 44 bp, Homo sapiens
  misc_feature 1..44: note = chr16:89575654-89575698
  misc_feature 1..44: note = hypo
  source 1..44: mol_type = genomic DNA
aggttgttgttttttcggttatttttgagacagagatctcgctc

SEQ ID NO: 44918 - DNA, 30 bp, Homo sapiens; identical to SEQ ID NO: 16146
  misc_feature 1..30: note = chr16:89576068-89576098
  misc_feature 1..30: note = hypo
  source 1..30: mol_type = genomic DNA

SEQ ID NO: 44919 - DNA, 26 bp, Homo sapiens
  misc_feature 1..26: note = chr16:89637111-89637137
  misc_feature 1..26: note = hypo
  source 1..26: mol_type = genomic DNA
acaggaggaggtgagcggggattgga

SEQ ID NO: 44920 - DNA, 30 bp, Homo sapiens
  misc_feature 1..30: note = chr16:89651651-89651681
  misc_feature 1..30: note = hypo
  source 1..30: mol_type = genomic DNA
tggaggcacagggctcggaaatgtgtctcc

SEQ ID NO: 44921 - DNA, 79 bp, Homo sapiens; identical to SEQ ID NO: 16147
  misc_feature 1..79: note = chr16:89655054-89655133
  misc_feature 1..79: note = hypo
  source 1..79: mol_type = genomic DNA

SEQ ID NO: 44922 - DNA, 30 bp, Homo sapiens
  misc_feature 1..30: note = chr16:89667452-89667482
  misc_feature 1..30: note = hypo
  source 1..30: mol_type = genomic DNA
actgcctgcagcaggcggaggagctcctcc

SEQ ID NO: 44923 - DNA, 30 bp, Homo sapiens; identical to SEQ ID NO: 16148
  misc_feature 1..30: note = chr16:89668379-89668409
  misc_feature 1..30: note = hypo
  source 1..30: mol_type = genomic DNA

SEQ ID NO: 44924 - DNA, 79 bp, Homo sapiens
  misc_feature 1..79: note = chr16:89688162-89688241
  misc_feature 1..79: note = hypo
  source 1..79: mol_type = genomic DNA
tgcgtttactcatcccgtgggaaagtctgcacatgtctgttctaggtacgcggacgtatctgaccgtgtgggcttgcga

SEQ ID NO: 44925 - DNA, 255 bp, Homo sapiens
  misc_feature 1..255: note = chr16:89702746-89703001
  misc_feature 1..255: note = hypo
  source 1..255: mol_type = genomic DNA
gtccaccgcatgtgccggatgtacccggagaccttcctgtatgtcaccagcagtgcaggtggggtcctgacctgggtcctccaggtcctgcgtcttctcacccagccctcatcctgagcagcaggtgccggtcaggacacctcaccctccagataccaggtgcccactcccctgcaccctgactctccccgcaggcattcggcaggccttccgggaagggaaggtggccagcctgatcggcgtggagggcggcca

SEQ ID NO: 44926 - DNA, 48 bp, Homo sapiens
  misc_feature 1..48: note = chr16:89704648-89704696
  misc_feature 1..48: note = hypo
  source 1..48: mol_type = genomic DNA
cccctttagggttcccggagctccgggaagacccgcccatcccaggac

SEQ ID NO: 44927 - DNA, 30 bp, Homo sapiens
  misc_feature 1..30: note = chr16:89713595-89713625
  misc_feature 1..30: note = hypo
  source 1..30: mol_type = genomic DNA
gtaggggccacataccgatgtatggacgtc

SEQ ID NO: 44928 - DNA, 37 bp, Homo sapiens
  misc_feature 1..37: note = chr16:89763835-89763872
  misc_feature 1..37: note = hypo
  source 1..37: mol_type = genomic DNA
agcgagtggcctggacggcaggcgggcagggctgcac

SEQ ID NO: 44929 - DNA, 420 bp, Homo sapiens
  misc_feature 1..420: note = chr16:89883922-89884342
  misc_feature 1..420: note = hypo
  source 1..420: mol_type = genomic DNA
ggcagagcgagactctgtctcaaaacaaaaccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggcacagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatc

SEQ ID NO: 44930 - DNA, 93 bp, Homo sapiens
  misc_feature 1..93: note = chr16:89884896-89884989
  misc_feature 1..93: note = hypo
  source 1..93: mol_type = genomic DNA
aaccatgaagatggccggaggaaaaagatacgttaaatacagtaacaaaggtaagaattccagcctgggcaatatggcaagacctcgtctcta

SEQ ID NO: 44931 - DNA, 33 bp, Homo sapiens
  misc_feature 1..33: note = chr16:89885109-89885142
  misc_feature 1..33: note = hypo
  source 1..33: mol_type = genomic DNA
atttcagtataataaaatcgttacaataagaac

SEQ ID NO: 44932 - DNA, 30 bp, Homo sapiens
  misc_feature 1..30: note = chr16:89896219-89896249
  misc_feature 1..30: note = hypo
  source 1..30: mol_type = genomic DNA
tgaggcgcaggcttgcgctggcactcagac

SEQ ID NO: 44933 - DNA, 56 bp, Homo sapiens
  misc_feature 1..56: note = chr16:89900124-89900180
  misc_feature 1..56: note = hypo
  source 1..56: mol_type = genomic DNA
ctgcacctgtgcactcgctggacctgccttggggagcagcacgtgtgggtccaggc

SEQ ID NO: 44934 - DNA, 431 bp, Homo sapiens
  misc_feature 1..431: note = chr16:89900384-89900815
  misc_feature 1..431: note = hypo
  source 1..431: mol_type = genomic DNA
tgtagatggcattcccgatatagtctcacctctgagcaagggttacctcacaggaaggcagtcctgcagcaagactcttctctttacggagacatctgtgaacctgcctgcgctcgcggttggccgtcgtagaagcatggataagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtga

SEQ ID NO: 44935 - DNA, 30 bp, Homo sapiens
  misc_feature 1..30: note = chr16:89972205-89972235
  misc_feature 1..30: note = hypo
  source 1..30: mol_type = genomic DNA
actgctctccaagagcgatttccagcaggg

SEQ ID NO: 44936 - DNA, 40 bp, Homo sapiens
  misc_feature 1..40: note = chr16:90037700-90037740
  misc_feature 1..40: note = hypo
  source 1..40: mol_type = genomic DNA
cagcattctcttcctcggaaataaacgttcctttgggcat

SEQ ID NO: 44937 - DNA, 321 bp, Homo sapiens
  misc_feature 1..321: note = chr16:90066626-90066947
  misc_feature 1..321: note = hypo
  source 1..321: mol_type = genomic DNA
cgaggtccggcacctcgtcagtgccacctacaggtgcaccctggacctgctgacacggtgccgggagcatgtggagaaggtgagtgtggcctctgcccagacaggtcgtgggtcccatgttgagtcacggtcatgccacacccgaaggccacacccgtccttcagcttgcttaggtttgggctgtgatcatgtcctcagagccgtctgacaggtgggccgttgtttccaggtgggccagcggctcctggagaaggaagtactggagaaggcagacatggtggagctgctgggcccccggcccttctcggagaagtctacct

SEQ ID NO: 44938 - DNA, 133 bp, Homo sapiens; identical to SEQ ID NO: 16154
  misc_feature 1..133: note = chr16:90069191-90069324
  misc_feature 1..133: note = hypo
  source 1..133: mol_type = genomic DNA

SEQ ID NO: 44939 - DNA, 37 bp, Homo sapiens
  misc_feature 1..37: note = chr17:616989-617026
  misc_feature 1..37: note = hypo
  source 1..37: mol_type = genomic DNA
gcaggcagggccgcgcgtggtggctcacgcctgtaat

SEQ ID NO: 44940 - DNA, 57 bp, Homo sapiens
  misc_feature 1..57: note = chr17:706526-706583
  misc_feature 1..57: note = hypo
  source 1..57: mol_type = genomic DNA
tccctctgatgagatcggcccactgcagccagcgcggaggcacgaacccagcatttt

SEQ ID NO: 44941 - DNA, 121 bp, Homo sapiens
  misc_feature 1..121: note = chr17:745667-745788
  misc_feature 1..121: note = hypo
  source 1..121: mol_type = genomic DNA
tgtgggctgcagttccgtgatcccggcggggaaggccacgtgggttactggggaggatgaaggatgaacacggggccgcgtctcacatgcaacccaccttcgaagacgccaaccagaggca

SEQ ID NO: 44942 - DNA, 30 bp, Homo sapiens
  misc_feature 1..30: note = chr17:876870-876900
  misc_feature 1..30: note = hypo
  source 1..30: mol_type = genomic DNA
ttctaggtctttcttcgcagttataatctc

SEQ ID NO: 44943 - DNA, 30 bp, Homo sapiens
  misc_feature 1..30: note = chr17:896321-896351
  misc_feature 1..30: note = hypo
  source 1..30: mol_type = genomic DNA
ctggaggaccccatccggagcctggagtgc

SEQ ID NO: 44944 - DNA, 30 bp, Homo sapiens
  misc_feature 1..30: note = chr17:915987-916017
  misc_feature 1..30: note = hypo
  source 1..30: mol_type = genomic DNA
ttcaggctcatatctcggctggtgaatttc

SEQ ID NO: 44945 - DNA, 34 bp, Homo sapiens
  misc_feature 1..34: note = chr17:1136687-1136721
  misc_feature 1..34: note = hypo
  source 1..34: mol_type = genomic DNA
tctttctttctttctaactcggtgtgccactggc

SEQ ID NO: 44946 - DNA, 30 bp, Homo sapiens
  misc_feature 1..30: note = chr17:1193094-1193124
  misc_feature 1..30: note = hypo
  source 1..30: mol_type = genomic DNA
atactcatggcaccccgcacctctgcccaa

SEQ ID NO: 44947 - DNA, 121 bp, Homo sapiens
  misc_feature 1..121: note = chr17:1387772-1387893
  misc_feature 1..121: note = hypo
  source 1..121: mol_type = genomic DNA
ccgggtgcggaaagccgggtgtggagggcccgggtcccagtgtggcagcagagggatcaccgaggctgcgggcacagaacagagacaacatgaaccacttgggactcggacacagggcatg

SEQ ID NO: 44948 - DNA, 51 bp, Homo sapiens
  misc_feature 1..51: note = chr17:1412412-1412463
  misc_feature 1..51: note = hypo
  source 1..51: mol_type = genomic DNA
gttagtgggggttagcgtggggcagagggcggggaacggtctgccagaccc

SEQ ID NO: 44949 - DNA, 18 bp, Homo sapiens
  misc_feature 1..18: note = chr17:1471448-1471466
  misc_feature 1..18: note = hypo
  source 1..18: mol_type = genomic DNA
acccggccactctttcat

SEQ ID NO: 44950 - DNA, 18 bp, Homo sapiens
  misc_feature 1..18: note = chr17:1520967-1520985
  misc_feature 1..18: note = hypo
  source 1..18: mol_type = genomic DNA
agccgccacacccagccg

SEQ ID NO: 44951 - DNA, 30 bp, Homo sapiens
  misc_feature 1..30: note = chr17:1536225-1536255
  misc_feature 1..30: note = hypo
  source 1..30: mol_type = genomic DNA
atatccaggatatgtcgttaagtaaaaaag

SEQ ID NO: 44952 - DNA, 49 bp, Homo sapiens
  misc_feature 1..49: note = chr17:1543917-1543966
  misc_feature 1..49: note = hypo
  source 1..49: mol_type = genomic DNA
tgtgtctggagagcacggctcattgtgtttgcagcggccacagctggga

SEQ ID NO: 44953 - DNA, 30 bp, Homo sapiens
  misc_feature 1..30: note = chr17:1544312-1544342
  misc_feature 1..30: note = hypo
  source 1..30: mol_type = genomic DNA
ttttccacactgagccgtccccaggtctgg

SEQ ID NO: 44954 - DNA, 16 bp, Homo sapiens
  misc_feature 1..16: note = chr17:1545305-1545321
  misc_feature 1..16: note = hypo
  source 1..16: mol_type = genomic DNA
gcgcccagccagggat

SEQ ID NO: 44955 - DNA, 139 bp, Homo sapiens
  misc_feature 1..139: note = chr17:1546311-1546450
  misc_feature 1..139: note = hypo
  source 1..139: mol_type = genomic DNA
cgttcctctgctttgtatgttttttgagaggagcaccgcgaagccctgacccctcctcccggcgccccgccgcggccacctgtctccgctccgccccgcccgctcacaggtctccgcgcagcctcgctcacctgtgtcc

SEQ ID NO: 44956 - DNA, 32 bp, Homo sapiens
  misc_feature 1..32: note = chr17:1623703-1623735
  misc_feature 1..32: note = hypo
  source 1..32: mol_type = genomic DNA
gcatcagaattacctcgcgtacttgttaaaca

SEQ ID NO: 44957 - DNA, 30 bp, Homo sapiens
  misc_feature 1..30: note = chr17:1819565-1819595
  misc_feature 1..30: note = hypo
  source 1..30: mol_type = genomic DNA
aggggacgtctcttccgtggaaaagcagca

SEQ ID NO: 44958 - DNA, 180 bp, Homo sapiens
  misc_feature 1..180: note = chr17:2207801-2207981
  misc_feature 1..180: note = hypo
  source 1..180: mol_type = genomic DNA
gctgggattacaggcgtgagccaccgcgcccggccgccccctgacttttaaaaactagatacgatatagttggaatcgtgtggaaggaagtacatcaggaggcatataagtccatttgggacctgtaatcccggcgactcggaacgctgagacgggcggatcgcttgaacccgggaggcg

SEQ ID NO: 44959 - DNA, 22 bp, Homo sapiens
  misc_feature 1..22: note = chr17:2208041-2208063
  misc_feature 1..22: note = hypo
  source 1..22: mol_type = genomic DNA
gagactccgcctcaaaaaaaaa

SEQ ID NO: 44960 - DNA, 25 bp, Homo sapiens
  misc_feature 1..25: note = chr17:2220972-2220997
  misc_feature 1..25: note = hypo
  source 1..25: mol_type = genomic DNA
gccgggataacggagactccatctc

SEQ ID NO: 44961 - DNA, 30 bp, Homo sapiens
  misc_feature 1..30: note = chr17:2264699-2264729
  misc_feature 1..30: note = hypo
  source 1..30: mol_type = genomic DNA
tgtgtgcgcaccaggcgagggagagggaca

SEQ ID NO: 44962 - DNA, 126 bp, Homo sapiens
  misc_feature 1..126: note = chr17:2298883-2299009
  misc_feature 1..126: note = hypo
  source 1..126: mol_type = genomic DNA
cagcccagccaggcacgggggaaagtgccgggggcacagcagtgaacaaatcaagcagacctgttccccgccaccagggaatagtaggacagtcacgggggctgacagtcacgggggctgacagtc

SEQ ID NO: 44963 - DNA, 33 bp, Homo sapiens
  misc_feature 1..33: note = chr17:2495626-2495659
  misc_feature 1..33: note = hypo
  source 1..33: mol_type = genomic DNA
ttaaaaatcaagggtcggctgagcacggtggct

SEQ ID NO: 44964 - DNA, 30 bp, Homo sapiens
  misc_feature 1..30: note = chr17:2634361-2634391
  misc_feature 1..30: note = hypo
  source 1..30: mol_type = genomic DNA
aagccccagttgcgccgtattccccacggc

SEQ ID NO: 44965 - DNA, 30 bp, Homo sapiens
  misc_feature 1..30: note = chr17:2859488-2859518
  misc_feature 1..30: note = hypo
  source 1..30: mol_type = genomic DNA
catctggatgtttggcggctcacttctggt

SEQ ID NO: 44966 - DNA, 30 bp, Homo sapiens
  misc_feature 1..30: note = chr17:3541079-3541109
  misc_feature 1..30: note = hypo
  source 1..30: mol_type = genomic DNA
tcccacttgacaatgcgtgctttacatctc

SEQ ID NO: 44967 - DNA, 43 bp, Homo sapiens
  misc_feature 1..43: note = chr17:3658849-3658892
  misc_feature 1..43: note = hypo
  source 1..43: mol_type = genomic DNA
gcacacagaaaaaagcgacctcctgtcatcaatatggccaccc

SEQ ID NO: 44968 - DNA, 30 bp, Homo sapiens
  misc_feature 1..30: note = chr17:3686152-3686182
  misc_feature 1..30: note = hypo
  source 1..30: mol_type = genomic DNA
gacatcgcactctcacgggaagacacactc

SEQ ID NO: 44969 - DNA, 191 bp, Homo sapiens
  misc_feature 1..191: note = chr17:3741605-3741796
  misc_feature 1..191: note = hypo
  source 1..191: mol_type = genomic DNA
ctcgggaccagaggtcgacaggtgtgataaagctatgacgccctcgcggtagagttgtgagagagactcacaggtatgcttgcgcccggctgtgcaggcacatgaaggtcaagccacacctggccttcacaggacttctcctcaaacagaaaccccgcccatgagggaagcaagggcgtgtttctgacttg

SEQ ID NO: 44970 - DNA, 30 bp, Homo sapiens
  misc_feature 1..30: note = chr17:3792191-3792221
  misc_feature 1..30: note = hypo
  source 1..30: mol_type = genomic DNA
ggaccagggtggtggcgtgtgtgtgtgtgt

SEQ ID NO: 44971 - DNA, 39 bp, Homo sapiens; identical to SEQ ID NO: 16163
  misc_feature 1..39: note = chr17:4236673-4236712
  misc_feature 1..39: note = hypo
  source 1..39: mol_type = genomic DNA

SEQ ID NO: 44972 - DNA, 30 bp, Homo sapiens
  misc_feature 1..30: note = chr17:4446308-4446338
  misc_feature 1..30: note = hypo
  source 1..30: mol_type = genomic DNA
gcaggtagagagaggcgttgaagtggtaga

SEQ ID NO: 44973 - DNA, 41 bp, Homo sapiens
  misc_feature 1..41: note = chr17:4699211-4699252
  misc_feature 1..41: note = hypo
  source 1..41: mol_type = genomic DNA
ccgcctcagcctcccaaagtgccgaacggtttttgggtttt

SEQ ID NO: 44974 - DNA, 21 bp, Homo sapiens
  misc_feature 1..21: note = chr17:4976841-4976862
  misc_feature 1..21: note = hypo
  source 1..21: mol_type = genomic DNA
gtgtaataaagcagacggtgg

SEQ ID NO: 44975 - DNA, 20 bp, Homo sapiens
  misc_feature 1..20: note = chr17:5320631-5320651
  misc_feature 1..20: note = hypo
  source 1..20: mol_type = genomic DNA
aagtaaatagccaggcgtgg

SEQ ID NO: 44976 - DNA, 120 bp, Homo sapiens
  misc_feature 1..120: note = chr17:5320771-5320891
  misc_feature 1..120: note = hypo
  source 1..120: mol_type = genomic DNA
agaaagaccccatttcaaaaataaaaaataaaatacgtttttaaaaaatgacaagggcagacccagcccctgccttggagcttacagtctagaaaagaagacagaggcagagtgccatgg

SEQ ID NO: 44977 - DNA, 98 bp, Homo sapiens
  misc_feature 1..98: note = chr17:7047830-7047928
  misc_feature 1..98: note = hypo
  source 1..98: mol_type = genomic DNA
tcatcttggttttggcgggcttcgatccacttatgtaccgcatcttgtttcagcagcggggtcctcgtgacctgtaccttgcaaaacctgtcctgaca

SEQ ID NO: 44978 - DNA, 30 bp, Homo sapiens
  misc_feature 1..30: note = chr17:7107670-7107700
  misc_feature 1..30: note = hypo
  source 1..30: mol_type = genomic DNA
tagccaagcccactccgccaccctgagagc

SEQ ID NO: 44979 - DNA, 30 bp, Homo sapiens
  misc_feature 1..30: note = chr17:7156905-7156935
  misc_feature 1..30: note = hypo
  source 1..30: mol_type = genomic DNA
tctacttcctagtcccggcaactcagtgga

SEQ ID NO: 44980 - DNA, 59 bp, Homo sapiens
  misc_feature 1..59: note = chr17:7369017-7369076
  misc_feature 1..59: note = hypo
  source 1..59: mol_type = genomic DNA
tggatcactcacctgcgctcccccgtgtgccacacttcatgcttcgtgcggtactccgc

SEQ ID NO: 44981 - DNA, 153 bp, Homo sapiens
  misc_feature 1..153: note = chr17:7466711-7466864
  misc_feature 1..153: note = hypo
  source 1..153: mol_type = genomic DNA
acctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccgg

SEQ ID NO: 44982 - DNA, 30 bp, Homo sapiens
  misc_feature 1..30: note = chr17:7727283-7727313
  misc_feature 1..30: note = hypo
  source 1..30: mol_type = genomic DNA
tgctgaatatgaagtcggtcggtggctcgg

SEQ ID NO: 44983 - DNA, 25 bp, Homo sapiens
  misc_feature 1..25: note = chr17:7856920-7856945
  misc_feature 1..25: note = hypo
  source 1..25: mol_type = genomic DNA
ccgctcacctcgtgctttgcagtcc

SEQ ID NO: 44984 - DNA, 225 bp, Homo sapiens
  misc_feature 1..225: note = chr17:8104414-8104639
  misc_feature 1..225: note = hypo
  source 1..225: mol_type = genomic DNA
gggcaacagagcaagattccgtcttgagaaaaagcaaaaaccttgcctttatctcgtttgaattcttgccctcgagaaaacagaggagagaggttgctgcagagttgcaactccggagtttcccggatagctgcaggcttacccgcaggtaacagtagaagtaggagtcagcgttaaggctgtgggaaaataggtgtccttcattattgccggtgggagtgtaaa

SEQ ID NO: 44985 - DNA, 23 bp, Homo sapiens
  misc_feature 1..23: note = chr17:8104911-8104934
  misc_feature 1..23: note = hypo
  source 1..23: mol_type = genomic DNA
tataggctgaaaggccgggcgcg

SEQ ID NO: 44986 - DNA, 25 bp, Homo sapiens
  misc_feature 1..25: note = chr17:8123524-8123549
  misc_feature 1..25: note = hypo
  source 1..25: mol_type = genomic DNA
cccatcccaccggttttgtttttca

SEQ ID NO: 44987 - DNA, 30 bp, Homo sapiens
  misc_feature 1..30: note = chr17:8287729-8287759
  misc_feature 1..30: note = hypo
  source 1..30: mol_type = genomic DNA
tggtttctgaggcagcggcagtgcagcagg

SEQ ID NO: 44988 - DNA, 149 bp, Homo sapiens
  misc_feature 1..149: note = chr17:8296142-8296291
  misc_feature 1..149: note = hypo
  source 1..149: mol_type = genomic DNA
cccagggcaggatggcggccaccacggccaccacagcgatgagcgtgatgagcagcagggcccgcgatcggcagcagaaggcgcgggcggagcggggcgccagggaggcctccgagagctctgccaggctgcggcggggcagcacgctg

SEQ ID NO: 44989 - DNA, 228 bp, Homo sapiens
  misc_feature 1..228: note = chr17:8384676-8384904
  misc_feature 1..228: note = hypo
  source 1..228: mol_type = genomic DNA
catctctctcctgctcggcgtgtcggcgggctcgctcagatgaggcaagttcctaagcagtggagactgcgttaagctctggctgtgaatagtttcctcacctgtggaatctgacagtgcctggagctacagcgaccttgctcctgtcactgtttacctgcacctcaagctgtcatttagatttgagaaattaaactgtcaagaaaatctgctcggtgcaggccagcc

SEQ ID NO: 44990 - DNA, 18 bp, Homo sapiens
  misc_feature 1..18: note = chr17:8464515-8464533
  misc_feature 1..18: note = hypo
  source 1..18: mol_type = genomic DNA
ggggcctctcctctccgg

SEQ ID NO: 44991 - DNA, 30 bp, Homo sapiens
  misc_feature 1..30: note = chr17:8572387-8572417
  misc_feature 1..30: note = hypo
  source 1..30: mol_type = genomic DNA
ttgttcttgaataaccgggcctggggaaac

SEQ ID NO: 44992 - DNA, 30 bp, Homo sapiens
  misc_feature 1..30: note = chr17:8732186-8732216
  misc_feature 1..30: note = hypo
  source 1..30: mol_type = genomic DNA
gacagcacagaaacccgggccaactcccgg

SEQ ID NO: 44993 - DNA, 38 bp, Homo sapiens
  misc_feature 1..38: note = chr17:8789494-8789532
  misc_feature 1..38: note = hypo
  source 1..38: mol_type = genomic DNA
tcgcgtcccaggccccgcctcaccgtctgtctctgctc

SEQ ID NO: 44994 - DNA, 30 bp, Homo sapiens
  misc_feature 1..30: note = chr17:8789780-8789810
  misc_feature 1..30: note = hypo
  source 1..30: mol_type = genomic DNA
agggaggccttacctcggtctgatagactt

SEQ ID NO: 44995 - DNA, 36 bp, Homo sapiens
  misc_feature 1..36: note = chr17:9808139-9808175
  misc_feature 1..36: note = hypo
  source 1..36: mol_type = genomic DNA
tcttgctgatggtcccgttaccgtccacgtcgtaga

SEQ ID NO: 44996 - DNA, 137 bp, Homo sapiens
  misc_feature 1..137: note = chr17:9810182-9810319
  misc_feature 1..137: note = hypo
  source 1..137: mol_type = genomic DNA
gtgcactttccttagcggagcgcagtgctcgaggggacacactcagaaccccagccttgccaccgtggatggagagttgtctctttttgccctggggtgagaatgatgaagaataaaccccacggtctccaggcagg

SEQ ID NO: 44997 - DNA, 194 bp, Homo sapiens
  misc_feature 1..194: note = chr17:10212814-10213008
  misc_feature 1..194: note = hypo
  source 1..194: mol_type = genomic DNA
cgcagaggcggccaccgtgctcaccttgagctggccctggaccgtgcgcagatgcttctgggtctctgccatctggcggttggagtggcccagctgaatctccatctcattaaggtctccctccatcttcttctttagcctcagggcgtcgttccggctgcggatttcagcatccagcacgctctgcagggcct

SEQ ID NO: 44998 - DNA, 30 bp, Homo sapiens; identical to SEQ ID NO: 16169
  misc_feature 1..30: note = chr17:11572707-11572737
  misc_feature 1..30: note = hypo
  source 1..30: mol_type = genomic DNA

SEQ ID NO: 44999 - DNA, 165 bp, Homo sapiens
  misc_feature 1..165: note = chr17:11637555-11637720
  misc_feature 1..165: note = hypo
  source 1..165: mol_type = genomic DNA
ctccagtgattactacgcacaataaaatcggggactgtgccgctctggcacagtcatctcaaccctggctgcacattagaatggcctgggtaattctacaaaatagtaatgcacagtgtccaccccgaaaagatgttgatttaattcctgcggaataggaccagt

SEQ ID NO: 45000 - DNA, 144 bp, Homo sapiens
  misc_feature 1..144: note = chr17:11672360-11672504
  misc_feature 1..144: note = hypo
  source 1..144: mol_type = genomic DNA
aatgcttcggaacgccgctggtgcatctgtttctccctagagcccacccttggcaggcttattgtgctcccattccaggcgtgtttggtgcacacgagtgagaccatccgtgtgtgctacttcatggagcggttgatggcgcgg

SEQ ID NO: 45001 - DNA, 24 bp, Homo sapiens
  misc_feature 1..24: note = chr17:15702893-15702917
  misc_feature 1..24: note = hypo
  source 1..24: mol_type = genomic DNA
gattacaggcgtgagccaccgcgc

SEQ ID NO: 45002 - DNA, 24 bp, Homo sapiens
  misc_feature 1..24: note = chr17:16120077-16120101
  misc_feature 1..24: note = hypo
  source 1..24: mol_type = genomic DNA
cagcctgggcgacagagcctctca

SEQ ID NO: 45003 - DNA, 30 bp, Homo sapiens; identical to SEQ ID NO: 16171
  misc_feature 1..30: note = chr17:16282207-16282237
  misc_feature 1..30: note = hypo
  source 1..30: mol_type = genomic DNA

SEQ ID NO: 45004 - DNA, 85 bp, Homo sapiens
  misc_feature 1..85: note = chr17:16282438-16282523
  misc_feature 1..85: note = hypo
  source 1..85: mol_type = genomic DNA
tcagcaacaggtttccggtccccgcagagggtcccactctgaactcccgatttacagactgttctcgggccgtgatgaggattaa

SEQ ID NO: 45005 - DNA, 54 bp, Homo sapiens
  misc_feature 1..54: note = chr17:17123922-17123976
  misc_feature 1..54: note = hypo
  source 1..54: mol_type = genomic DNA
tgcccagcacacctgcgtttccagctctcacaaaggcttcgacagacctggctc

SEQ ID NO: 45006 - DNA, 30 bp, Homo sapiens
  misc_feature 1..30: note = chr17:17146203-17146233
  misc_feature 1..30: note = hypo
  source 1..30: mol_type = genomic DNA
aaacggactgtgagccgatgagtagcattt

SEQ ID NO: 45007 - DNA, 77 bp, Homo sapiens
  misc_feature 1..77: note = chr17:17395970-17396047
  misc_feature 1..77: note = hypo
  source 1..77: mol_type = genomic DNA
ctcgaggaggaggtgcgaagtcctggagtattgtttgggtctcggaatgggcgcataacctgcgctgaccagtttag

SEQ ID NO: 45008 - DNA, 187 bp, Homo sapiens; identical to SEQ ID NO: 16172
  misc_feature 1..187: note = chr17:17579341-17579528
  misc_feature 1..187: note = hypo
  source 1..187: mol_type = genomic DNA

SEQ ID NO: 45009 - DNA, 39 bp, Homo sapiens
  misc_feature 1..39: note = chr17:17592178-17592217
  misc_feature 1..39: note = hypo
  source 1..39: mol_type = genomic DNA
tgggattacaggcgtgagtcactgcgcccagccttgggc

SEQ ID NO: 45010 - DNA, 108 bp, Homo sapiens
  misc_feature 1..108: note = chr17:17891258-17891366
  misc_feature 1..108: note = hypo
  source 1..108: mol_type = genomic DNA
caacattgagaccatcgaggggctggacacactggtgaacctggaggacctgagcttgttcaacaaccggatctccaagatcgactccctggacgccctcgtcaagct

SEQ ID NO: 45011 - DNA, 40 bp, Homo sapiens
  misc_feature 1..40: note = chr17:17910311-17910351
  misc_feature 1..40: note = hypo
  source 1..40: mol_type = genomic DNA
ggcctttgcttaactcggggctgcacgatggctcagtgcc

SEQ ID NO: 45012 - DNA, 38 bp, Homo sapiens
  misc_feature 1..38: note = chr17:18070928-18070966
  misc_feature 1..38: note = hypo
  source 1..38: mol_type = genomic DNA
tcttcagcagtgtgccggccagccggcccagcgagcag

SEQ ID NO: 45013 - DNA, 283 bp, Homo sapiens
  misc_feature 1..283: note = chr17:18163071-18163354
  misc_feature 1..283: note = hypo
  source 1..283: mol_type = genomic DNA
gcgtgagccaccgcgccctacccagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcacccctgtgctcgtacccccctacaaagggaggctccagaagagaagcatccgtcttggtccttgctgttcaagggggctcgccctggctgacac

SEQ ID NO: 45014 - DNA, 21 bp, Homo sapiens
  misc_feature 1..21: note = chr17:18272614-18272635
  misc_feature 1..21: note = hypo
  source 1..21: mol_type = genomic DNA
tttttgagaaagtctcgatct

SEQ ID NO: 45015 - DNA, 34 bp, Homo sapiens
  misc_feature 1..34: note = chr17:19230161-19230195
  misc_feature 1..34: note = hypo
  source 1..34: mol_type = genomic DNA
ggtaaccataagggacgatcggtaaaagactcaa

SEQ ID NO: 45016 - DNA, 179 bp, Homo sapiens
  misc_feature 1..179: note = chr17:19622428-19622607
  misc_feature 1..179: note = hypo
  source 1..179: mol_type = genomic DNA
actgcacacaacagacggatcagcagctcactctcaggaacagggctgccaatcccctagaatatacaagcaagtccgggcgatgctggaccctttcccttctcagctgatcacttgtttccaaggcccttatttcctggggcacatggcctatgacattctcccgatgccagttgccg

SEQ ID NO: 45017 - DNA, 89 bp, Homo sapiens
  misc_feature 1..89: note = chr17:19769823-19769912
  misc_feature 1..89: note = hypo
  source 1..89: mol_type = genomic DNA
aataaataaataaataaataagaaaagtagcattacttcatccgataagcaacaaagtcagcccacttttaacacgccccttgggcaac

SEQ ID NO: 45018 - DNA, 118 bp, Homo sapiens
  misc_feature 1..118: note = chr17:19771594-19771712
  misc_feature 1..118: note = hypo
  source 1..118: mol_type = genomic DNA
actccaggctttgcccgcgctctggaaaaccagagttcacgctgccaaactgccagccttcggacgcctctcggggtttactcgcttaggatccctagagggacggtgacaggcggga

SEQ ID NO: 45019 - DNA, 30 bp, Homo sapiens
  misc_feature 1..30: note = chr17:20008410-20008440
  misc_feature 1..30: note = hypo
  source 1..30: mol_type = genomic DNA
ttttcggtgggggggcgggagacagggttt

SEQ ID NO: 45020 - DNA, 162 bp, Homo sapiens
  misc_feature 1..162: note = chr17:20771807-20771969
  misc_feature 1..162: note = hypo
  source 1..162: mol_type = genomic DNA
taaatgatgctgaagcggaaacacgttttttcaagttcctgtatttttatgtggagttgctcactgcccaacgtagaggactaggaatcaggagtcggtggccgtatgctggaggctggagccgcgggagcgcggctcgcctcgctgcggttgttggcagtg

SEQ ID NO: 45021 - DNA, 30 bp, Homo sapiens
  misc_feature 1..30: note = chr17:20773688-20773718
  misc_feature 1..30: note = hypo
  source 1..30: mol_type = genomic DNA
tctgctttgctgaggcgttttttttgtttt

SEQ ID NO: 45022 - DNA, 102 bp, Homo sapiens
  misc_feature 1..102: note = chr17:20813557-20813659
  misc_feature 1..102: note = hypo
  source 1..102: mol_type = genomic DNA
aacaatacactgtaacgatgatgacagaataatataaaatgagacccctttctgctctaatcatatgaaaatagcacagatggccgggcgcggtggctcacg

SEQ ID NO: 45023 - DNA, 38 bp, Homo sapiens
  misc_feature 1..38: note = chr17:20817586-20817624
  misc_feature 1..38: note = hypo
  source 1..38: mol_type = genomic DNA
aatgtgactcttggccgggcgcggtggctcacgcctgt

SEQ ID NO: 45024 - DNA, 70 bp, Homo sapiens
  misc_feature 1..70: note = chr17:21104001-21104071
  misc_feature 1..70: note = hypo
  source 1..70: mol_type = genomic DNA
atgtacctgaagctccgaatgtgcctgacaggaactagcttcctttcatggctaacgagaagcacagccc

SEQ ID NO: 45025 - DNA, 53 bp, Homo sapiens; identical to SEQ ID NO: 16179
  misc_feature 1..53: note = chr17:21147486-21147539
  misc_feature 1..53: note = hypo
  source 1..53: mol_type = genomic DNA

SEQ ID NO: 45026 - DNA, 30 bp, Homo sapiens
  misc_feature 1..30: note = chr17:21150794-21150824
  misc_feature 1..30: note = hypo
  source 1..30: mol_type = genomic DNA
ccatcccactaaacacgattctcacagccc

SEQ ID NO: 45027 - DNA, 27 bp, Homo sapiens
  misc_feature 1..27: note = chr17:21168792-21168819
  misc_feature 1..27: note = hypo
  source 1..27: mol_type = genomic DNA
acctgaggctcttaacgattctctgga

SEQ ID NO: 45028 - DNA, 37 bp, Homo sapiens
  misc_feature 1..37: note = chr17:21860030-21860067
  misc_feature 1..37: note = hypo
  source 1..37: mol_type = genomic DNA
cacctggtccatgcccgccgcccggtgagcactgaga

SEQ ID NO: 45029 - DNA, 30 bp, Homo sapiens
  misc_feature 1..30: note = chr17:25432186-25432216
  misc_feature 1..30: note = hypo
  source 1..30: mol_type = genomic DNA
tcttggctcctcccccgtggagattttttt

SEQ ID NO: 45030 - DNA, 142 bp, Homo sapiens; identical to SEQ ID NO: 1616
  misc_feature 1..142: note = chr17:25620573-25620715
  misc_feature 1..142: note = hypo
  source 1..142: mol_type = genomic DNA

SEQ ID NO: 45031 - DNA, 108 bp, Homo sapiens
  misc_feature 1..108: note = chr17:25676881-25676989
  misc_feature 1..108: note = hypo
  source 1..108: mol_type = genomic DNA
cccccgcctggtgtgcgcatgctaggggcagtgctgacacgctccactggtttcagatcaactttggagaatttggcgatagctagttaaagccgaagatgtgcatgc

SEQ ID NO: 45032 - DNA, 30 bp, Homo sapiens
  misc_feature 1..30: note = chr17:25680264-25680294
  misc_feature 1..30: note = hypo
  source 1..30: mol_type = genomic DNA
atcccagcacgttgccgagctgaggcggga

SEQ ID NO: 45033 - DNA, 105 bp, Homo sapiens
  misc_feature 1..105: note = chr17:25907750-25907855
  misc_feature 1..105: note = hypo
  source 1..105: mol_type = genomic DNA
tgtgcaatacaggtgcgtcagtcccttctcacaggctgtaaagaaatacctgaaactggattggttatttatttatttatgagacggcctggagtgcagtggcgc

SEQ ID NO: 45034 - DNA, 116 bp, Homo sapiens
  misc_feature 1..116: note = chr17:25931618-25931734
  misc_feature 1..116: note = hypo
  source 1..116: mol_type = genomic DNA
gtctcagatctctcccgggagtccccgctagctgagagcagagcggtgttcctcaaggtctccttgacaaaccttgtttactcttaggctcgatgaccagccgaaagcagatgtgt

SEQ ID NO: 45035 - DNA, 30 bp, Homo sapiens
  misc_feature 1..30: note = chr17:25957285-25957315
  misc_feature 1..30: note = hypo
  source 1..30: mol_type = genomic DNA
agaggtgcagactcacgtatggccctgggg

SEQ ID NO: 45036 - DNA, 40 bp, Homo sapiens; identical to SEQ ID NO: 16181
  misc_feature 1..40: note = chr17:26263183-26263223
  misc_feature 1..40: note = hypo
  source 1..40: mol_type = genomic DNA

SEQ ID NO: 45037 - DNA, 22 bp, Homo sapiens
  misc_feature 1..22: note = chr17:26927142-26927164
  misc_feature 1..22: note = hypo
  source 1..22: mol_type = genomic DNA
actggatttcaaacacgtcgta

SEQ ID NO: 45038 - DNA, 30 bp, Homo sapiens
  misc_feature 1..30: note = chr17:26961906-26961936
  misc_feature 1..30: note = hypo
  source 1..30: mol_type = genomic DNA
catccttcatcagctcgtagttatcatgaa

SEQ ID NO: 45039 - DNA, 24 bp, Homo sapiens
  misc_feature 1..24: note = chr17:27056401-27056425
  misc_feature 1..24: note = hypo
  source 1..24: mol_type = genomic DNA
ctccctctgtcaccccggctggag

SEQ ID NO: 45040 - DNA, 24 bp, Homo sapiens
  misc_feature 1..24: note = chr17:27056845-27056869
  misc_feature 1..24: note = hypo
  source 1..24: mol_type = genomic DNA
gagccaccgcgacaggccagaagt

SEQ ID NO: 45041 - DNA, 30 bp, Homo sapiens; identical to SEQ ID NO: 16185
  misc_feature 1..30: note = chr17:27074858-27074888
  misc_feature 1..30: note = hypo
  source 1..30: mol_type = genomic DNA

SEQ ID NO: 45042 - DNA, 22 bp, Homo sapiens
  misc_feature 1..22: note = chr17:27081800-27081822
  misc_feature 1..22: note = hypo
  source 1..22: mol_type = genomic DNA
ttttttttcctgagacgggagt

SEQ ID NO: 45043 - DNA, 20 bp, Homo sapiens
  misc_feature 1..20: note = chr17:27170162-27170182
  misc_feature 1..20: note = hypo
  source 1..20: mol_type = genomic DNA
tttttttttctgagtcgaag

SEQ ID NO: 45044 - DNA, 30 bp, Homo sapiens; identical to SEQ ID NO: 16187
  misc_feature 1..30: note = chr17:27411663-27411693
  misc_feature 1..30: note = hypo
  source 1..30: mol_type = genomic DNA

SEQ ID NO: 45045 - DNA, 30 bp, Homo sapiens
  misc_feature 1..30: note = chr17:27419477-27419507
  misc_feature 1..30: note = hypo
  source 1..30: mol_type = genomic DNA
gacacagaccacccccgccccagggagaga

SEQ ID NO: 45046 - DNA, 96 bp, Homo sapiens
  misc_feature 1..96: note = chr17:27716046-27716142
  misc_feature 1..96: note = hypo
  source 1..96: mol_type = genomic DNA
catacactgtatacacggattgcttaggtctgatcaacatgctccttccttggagcacagatctactatggccagcctggtctcgaactcctgacc

SEQ ID NO: 45047 - DNA, 120 bp, Homo sapiens
  misc_feature 1..120: note = chr17:27716202-27716322
  misc_feature 1..120: note = hypo
  source 1..120: mol_type = genomic DNA
gcccggcccagagttaatttttattcatgaaactcatataacaggtttatttatttcagtcgttttgttggttaaagaaccaagattttttatgactacactttgtgtacacttttaggt

SEQ ID NO: 45048 - DNA, 30 bp, Homo sapiens
  misc_feature 1..30: note = chr17:28715779-28715809
  misc_feature 1..30: note = hypo
  source 1..30: mol_type = genomic DNA
tgtctgggccaggggcgacattgccacaag

SEQ ID NO: 45049 - DNA, 17 bp, Homo sapiens
  misc_feature 1..17: note = chr17:28988919-28988936
  misc_feature 1..17: note = hypo
  source 1..17: mol_type = genomic DNA
gggtgcggtggctcacg

SEQ ID NO: 45050 - DNA, 23 bp, Homo sapiens
  misc_feature 1..23: note = chr17:29232244-29232267
  misc_feature 1..23: note = hypo
  source 1..23: mol_type = genomic DNA
aggtttgtcttaggccgggcgcg

SEQ ID NO: 45051 - DNA, 186 bp, Homo sapiens
  misc_feature 1..186: note = chr17:30243768-30243954
  misc_feature 1..186: note = hypo
  source 1..186: mol_type = genomic DNA
acgatgtaactaaaacgccactctacagttaactccctctattccttagatttcattcccggggtcacctctttggcctaggtgcacacaccgcgggctccgctctaggtggggcacaggccttcgcccgccgcatgcaccctgggctgcgcagccccagccagcccgacccgggctcagcgaccc

SEQ ID NO: 45052 - DNA, 30 bp, Homo sapiens
  misc_feature 1..30: note = chr17:30333112-30333142
  misc_feature 1..30: note = hypo
  source 1..30: mol_type = genomic DNA
attaacatatgtttacgaaacctttctttt

SEQ ID NO: 45053 - DNA, 44 bp, Homo sapiens
  misc_feature 1..44: note = chr17:30710883-30710927
  misc_feature 1..44: note = hypo
  source 1..44: mol_type = genomic DNA
cactccagcctggacaaggagtgggactccgtctcaaaaaacaa

SEQ ID NO: 45054 - DNA, 30 bp, Homo sapiens
  misc_feature 1..30: note = chr17:30822187-30822217
  misc_feature 1..30: note = hypo
  source 1..30: mol_type = genomic DNA
atgtggttgaacagacgccaccaggtctct

SEQ ID NO: 45055 - DNA, 50 bp, Homo sapiens
  misc_feature 1..50: note = chr17:30954269-30954319
  misc_feature 1..50: note = hypo
  source 1..50: mol_type = genomic DNA
ggattgagggagggccgagggagtgagtaggctagcgcacaccagcacag

SEQ ID NO: 45056 - DNA, 30 bp, Homo sapiens
  misc_feature 1..30: note = chr17:31162054-31162084
  misc_feature 1..30: note = hypo
  source 1..30: mol_type = genomic DNA
ccacatttcttcaaccgcttcccattgcct

SEQ ID NO: 45057 - DNA, 155 bp, Homo sapiens
  misc_feature 1..155: note = chr17:31214020-31214175
  misc_feature 1..155: note = hypo
  source 1..155: mol_type = genomic DNA
taaagccctggtttacgtccctcctggcacaactcttcccatttccccattccgtgtgaagagtgccatcccatggagccttgattgttacctgccaatttgtatatgttatttgcattaaaacttctgattcacggaggagccaagatggccga

SEQ ID NO: 45058 - DNA, 184 bp, Homo sapiens
  misc_feature 1..184: note = chr17:32237066-32237250
  misc_feature 1..184: note = hypo
  source 1..184: mol_type = genomic DNA
aaatgagtgaatacccgtgcagtgctaagagtggtgcttggcatgtagcaagagcccaggaaatgttggctattaatattcaaacagcttttggggatatcgctacatattctgtgcctaagatgcaaagatgaataaggggatatctgtcctcagagcatccatattccggttggatgacaga

SEQ ID NO: 45059 - DNA, 23 bp, Homo sapiens
  misc_feature 1..23: note = chr17:32239704-32239727
  misc_feature 1..23: note = hypo
  source 1..23: mol_type = genomic DNA
attatagactagggccgggtgag

SEQ ID NO: 45060 - DNA, 30 bp, Homo sapiens
  misc_feature 1..30: note = chr17:32275435-32275465
  misc_feature 1..30: note = hypo
  source 1..30: mol_type = genomic DNA
gagatcacacaatcacgggctcagagagtt

SEQ ID NO: 45061 - DNA, 17 bp, Homo sapiens
  misc_feature 1..17: note = chr17:33877286-33877303
  misc_feature 1..17: note = hypo
  source 1..17: mol_type = genomic DNA
aggtgcagtggctcacg

SEQ ID NO: 45062 - DNA, 38 bp, Homo sapiens
  misc_feature 1..38: note = chr17:33917230-33917268
  misc_feature 1..38: note = hypo
  source 1..38: mol_type = genomic DNA
ccggctgtaacttctaatgaagacgtcagtttttgcca

SEQ ID NO: 45063 - DNA, 189 bp, Homo sapiens
  misc_feature 1..189: note = chr17:35061647-35061836
  misc_feature 1..189: note = hypo
  source 1..189: mol_type = genomic DNA
gaacagtttttatggcggctattcgggggatgcttttatattgatggtatacagcctgaatctgtcttttttgcatcccaccccccttccctgggcagggaggggaagtctgtgtaactatttttcatgcatttaatatattaattatctggtaaatgctccccaggctgtgctcgggacattggagag

SEQ ID NO: 45064 - DNA, 43 bp, Homo sapiens
  misc_feature 1..43: note = chr17:37011090-37011133
  misc_feature 1..43: note = hypo
  source 1..43: mol_type = genomic DNA
aatagtatcgcttctcggccttttggccaagatcaagtgtaaa

SEQ ID NO: 45065 - DNA, 29 bp, Homo sapiens
  misc_feature 1..29: note = chr17:37192172-37192201
  misc_feature 1..29: note = hypo
  source 1..29: mol_type = genomic DNA
ttagccgccacccccgggcagtaactggc

SEQ ID NO: 45066 - DNA, 30 bp, Homo sapiens; identical to SEQ ID NO: 16197
  misc_feature 1..30: note = chr17:37369159-37369189
  misc_feature 1..30: note = hypo
  source 1..30: mol_type = genomic DNA

SEQ ID NO: 45067 - DNA, 23 bp, Homo sapiens
  misc_feature 1..23: note = chr17:37606489-37606512
  misc_feature 1..23: note = hypo
  source 1..23: mol_type = genomic DNA
actgctcccggcctcacctttcg

SEQ ID NO: 45068 - DNA, 17 bp, Homo sapiens
  misc_feature 1..17: note = chr17:37887620-37887637
  misc_feature 1..17: note = hypo
  source 1..17: mol_type = genomic DNA
cccggtgctgatggcat

SEQ ID NO: 45069 - DNA, 33 bp, Homo sapiens
  misc_feature 1..33: note = chr17:38179589-38179622
  misc_feature 1..33: note = hypo
  source 1..33: mol_type = genomic DNA
ctgtctgctgcagcacgtcggcacacatgcgct

SEQ ID NO: 45070 - DNA, 17 bp, Homo sapiens
  misc_feature 1..17: note = chr17:38445245-38445262
  misc_feature 1..17: note = hypo
  source 1..17: mol_type = genomic DNA
cccggcccatttcaggt

SEQ ID NO: 45071 - DNA, 146 bp, Homo sapiens; identical to SEQ ID NO: 1618
  misc_feature 1..146: note = chr17:39682499-39682645
  misc_feature 1..146: note = hypo
  source 1..146: mol_type = genomic DNA

SEQ ID NO: 45072 - DNA, 124 bp, Homo sapiens
  misc_feature 1..124: note = chr17:39768852-39768976
  misc_feature 1..124: note = hypo
  source 1..124: mol_type = genomic DNA
ggctggagccgcccccgatgccgcctccgatgccgcaggagcccttcatggagctggaggaggtgaactggcggctgcaggtggtcatggtgccaaggagggaggtgagcgagtgagcagttgg

SEQ ID NO: 45073 - DNA, 36 bp, Homo sapiens
  misc_feature 1..36: note = chr17:39803800-39803836
  misc_feature 1..36: note = hypo
  source 1..36: mol_type = genomic DNA
aactgcaggatgcaccggcagcgatggagaagcctc

SEQ ID NO: 45074 - DNA, 30 bp, Homo sapiens
  misc_feature 1..30: note = chr17:39855665-39855695
  misc_feature 1..30: note = hypo
  source 1..30: mol_type = genomic DNA
tatgcttctactgtccgtttttgtgtgctc

SEQ ID NO: 45075 - DNA, 23 bp, Homo sapiens
  misc_feature 1..23: note = chr17:40477866-40477889
  misc_feature 1..23: note = hypo
  source 1..23: mol_type = genomic DNA
accgcgcccggccaatcaatttc

SEQ ID NO: 45076 - DNA, 30 bp, Homo sapiens
  misc_feature 1..30: note = chr17:40705998-40706028
  misc_feature 1..30: note = hypo
  source 1..30: mol_type = genomic DNA
ctggccctctctgcccggctcacattagct

SEQ ID NO: 45077 - DNA, 24 bp, Homo sapiens
  misc_feature 1..24: note = chr17:40801969-40801993
  misc_feature 1..24: note = hypo
  source 1..24: mol_type = genomic DNA
ctccctctccgaaaaaaaaaaaac

SEQ ID NO: 45078 - DNA, 103 bp, Homo sapiens; identical to SEQ ID NO: 16200
  misc_feature 1..103: note = chr17:40975574-40975677
  misc_feature 1..103: note = hypo
  source 1..103: mol_type = genomic DNA

SEQ ID NO: 45079 - DNA, 30 bp, Homo sapiens
  misc_feature 1..30: note = chr17:41188525-41188555
  misc_feature 1..30: note = hypo
  source 1..30: mol_type = genomic DNA
cccagagcccggcgccgccccagttgggcc

SEQ ID NO: 45080 - DNA, 138 bp, Homo sapiens
  misc_feature 1..138: note = chr17:41278565-41278703
  misc_feature 1..138: note = hypo
  source 1..138: mol_type = genomic DNA
ctttttccgtgtctccggacagctaatcgttttagtgacaggatgagagagcccttcgtgttctgagggaccgagtgggcgaaaagcgccggagagttggagagtctgtggttcagaatgcgaggtgacaacgtgcta

SEQ ID NO: 45081 - DNA, 30 bp, Homo sapiens
  misc_feature 1..30: note = chr17:41416844-41416874
  misc_feature 1..30: note = hypo
  source 1..30: mol_type = genomic DNA
tcttcggattccttgcgggatctgcagact

SEQ ID NO: 45082 - DNA, 193 bp, Homo sapiens
  misc_feature 1..193: note = chr17:41464759-41464952
  misc_feature 1..193: note = hypo
  source 1..193: mol_type = genomic DNA
tcttagccaaaaggacgagaagagatgtcgtcgccttcctccctgccatcaccgtcccactctcatctacattcaagacgcggtgagagccccagcctcgctccttgcctcattcactttgtcttgtccacaccaatattgacgccattacacactcgggctgatttcttattctccacgttttaaaagaaaa

SEQ ID NO: 45083 - DNA, 34 bp, Homo sapiens
  misc_feature 1..34: note = chr17:41957252-41957286
  misc_feature 1..34: note = hypo
  source 1..34: mol_type = genomic DNA
aggtagcgcccagcacggacgtcagcctccatct

SEQ ID NO: 45084 - DNA, 294 bp, Homo sapiens
  misc_feature 1..294: note = chr17:42330572-42330866
  misc_feature 1..294: note = hypo
  source 1..294: mol_type = genomic DNA
ccatgacagtgagggcgttggcatgggtgacggaacgcacggtggtggcactgagccagggcatcccaaagagggcggccaccccacccatgcctactaccagcagcaggtccaggtggaagccggagcccttgaccatcttgcgctcaggtttgctgacaatcagcctacggtaggggaaggtgaggggtaagcagggttctcccctgcctcctccaccccctccttccttctccatacttggtgtccttgtagctcagttttgtcttctgtgcccctcgctctttgagttcc

SEQ ID NO: 45085 - DNA, 144 bp, Homo sapiens
  misc_feature 1..144: note = chr17:42331627-42331771
  misc_feature 1..144: note = hypo
  source 1..144: mol_type = genomic DNA
gccaccgcgcccggccacgttttttttttcttaaaaagagctctccaaattatacaacttctggtcccacaaaacctggaactgcccctggcttttcactattcctgctagtcgggagggccacacacccgcagggactagctt

SEQ ID NO: 45086 - DNA, 30 bp, Homo sapiens
  misc_feature 1..30: note = chr17:42335482-42335512
  misc_feature 1..30: note = hypo
  source 1..30: mol_type = genomic DNA
cacgcaccaggcccccgaagagctggcctg

SEQ ID NO: 45087 - DNA, 41 bp, Homo sapiens; identical to SEQ ID NO: 16204
  misc_feature 1..41: note = chr17:42395128-42395169
  misc_feature 1..41: note = hypo
  source 1..41: mol_type = genomic DNA

SEQ ID NO: 45088 - DNA, 16 bp, Homo sapiens
  misc_feature 1..16: note = chr17:42401285-42401301
  misc_feature 1..16: note = hypo
  source 1..16: mol_type = genomic DNA
gcgtgagccaccgcac

SEQ ID NO: 45089 - DNA, 23 bp, Homo sapiens
  misc_feature 1..23: note = chr17:42587332-42587355
  misc_feature 1..23: note = hypo
  source 1..23: mol_type = genomic DNA
gagccagacgccttctcaaaaaa

SEQ ID NO: 45090 - DNA, 82 bp, Homo sapiens
  misc_feature 1..82: note = chr17:42787212-42787294
  misc_feature 1..82: note = hypo
  source 1..82: mol_type = genomic DNA
catggcacttccctccgtactgcccctttagttaatatcatctagttggccgggcgcggctgctcacgcctgtaatcccagc

SEQ ID NO: 45091 - DNA, 82 bp, Homo sapiens
  misc_feature 1..82: note = chr17:42787534-42787616
  misc_feature 1..82: note = hypo
  source 1..82: mol_type = genomic DNA
cgtctcaaaaaaaagaaaaaaaaaataccgtctacttttacttctggattgttaacagatatgccatcggcttgttgccttt

SEQ ID NO: 45092 - DNA, 30 bp, Homo sapiens
  misc_feature 1..30: note = chr17:43001916-43001946
  misc_feature 1..30: note = hypo
  source 1..30: mol_type = genomic DNA
tgtgaagtgaagagccgggctcagacctca

SEQ ID NO: 45093 - DNA, 30 bp, Homo sapiens
  misc_feature 1..30: note = chr17:43318029-43318059
  misc_feature 1..30: note = hypo
  source 1..30: mol_type = genomic DNA
ggcccacagggcacacgggccacagggcca

SEQ ID NO: 45094 - DNA, 20 bp, Homo sapiens
  misc_feature 1..20: note = chr17:45268837-45268857
  misc_feature 1..20: note = hypo
  source 1..20: mol_type = genomic DNA
tacattttttttttccgaga

SEQ ID NO: 45095 - DNA, 30 bp, Homo sapiens
  misc_feature 1..30: note = chr17:45971018-45971048
  misc_feature 1..30: note = hypo
  source 1..30: mol_type = genomic DNA
gaagcatagctaccccgtttttctcccaga

SEQ ID NO: 45096 - DNA, 39 bp, Homo sapiens
  misc_feature 1..39: note = chr17:46177212-46177251
  misc_feature 1..39: note = hypo
  source 1..39: mol_type = genomic DNA
taaaatatggccaggcgcagtggctcacgcctataatcc

SEQ ID NO: 45097 - DNA, 116 bp, Homo sapiens
  misc_feature 1..116: note = chr17:46946208-46946324
  misc_feature 1..116: note = hypo
  source 1..116: mol_type = genomic DNA
tatgcattgtgaattcgatctcaaattatcatttgggacatgaaggatgtctcaaatacaaacacagagcaagttaaacactgttgaacttggatagattacggtgatgtcagtac

SEQ ID NO: 45098 - DNA, 30 bp, Homo sapiens
  misc_feature 1..30: note = chr17:47170202-47170232
  misc_feature 1..30: note = hypo
  source 1..30: mol_type = genomic DNA
ctcactattacacctcgtagactgcttgaa

SEQ ID NO: 45099 - DNA, 95 bp, Homo sapiens
  misc_feature 1..95: note = chr17:47227368-47227463
  misc_feature 1..95: note = hypo
  source 1..95: mol_type = genomic DNA
ttgtatttcctcttccgttaattacctgtttatgttctttaccatttaaaaattttggaggtcggggggggtcagccccccacctggccagccgc

SEQ ID NO: 45100 - DNA, 30 bp, Homo sapiens
  misc_feature 1..30: note = chr17:47330524-47330554
  misc_feature 1..30: note = hypo
  source 1..30: mol_type = genomic DNA
cagttaggaggccagcgtgaggctgcagtg

SEQ ID NO: 45101 - DNA, 30 bp, Homo sapiens
  misc_feature 1..30: note = chr17:47449030-47449060
  misc_feature 1..30: note = hypo
  source 1..30: mol_type = genomic DNA
ggagaggcctatgggcggagctcagaggag

SEQ ID NO: 45102 - DNA, 86 bp, Homo sapiens
  misc_feature 1..86: note = chr17:47657508-47657594
  misc_feature 1..86: note = hypo
  source 1..86: mol_type = genomic DNA
agaccggggttctcccggatctggatggcgccgccctctcagcagcgggcacgggtggggcggggccgggccgcagagcatgtgct

SEQ ID NO: 45103 - DNA, 32 bp, Homo sapiens; identical to SEQ ID NO: 16208
  misc_feature 1..32: note = chr17:47851118-47851150
  misc_feature 1..32: note = hypo
  source 1..32: mol_type = genomic DNA

SEQ ID NO: 45104 - DNA, 31 bp, Homo sapiens; identical to SEQ ID NO: 16209
  misc_feature 1..31: note = chr17:47851390-47851421
  misc_feature 1..31: note = hypo
  source 1..31: mol_type = genomic DNA

SEQ ID NO: 45105 - DNA, 30 bp, Homo sapiens
  misc_feature 1..30: note = chr17:48239531-48239561
  misc_feature 1..30: note = hypo
  source 1..30: mol_type = genomic DNA
tccagctctcctgaccgacgccccaactgg

SEQ ID NO: 45106 - DNA, 35 bp, Homo sapiens
  misc_feature 1..35: note = chr17:48611963-48611998
  misc_feature 1..35: note = hypo
  source 1..35: mol_type = genomic DNA
cccacagaaggcccacgacccgctggaaggaaaga

SEQ ID NO: 45107 - DNA, 62 bp, Homo sapiens
  misc_feature 1..62: note = chr17:48612246-48612308
  misc_feature 1..62: note = hypo
  source 1..62: mol_type = genomic DNA
gatggagggtggagccgaaaggtgtttggtgggtgggggacagttcacgggtgaagtggagg

SEQ ID NO: 45108 - DNA, 440 bp, Homo sapiens
  misc_feature 1..440: note = chr17:48652984-48653424
  misc_feature 1..440: note = hypo
  source 1..440: mol_type = genomic DNA
ctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgca

SEQ ID NO: 45109 - DNA, 64 bp, Homo sapiens
  misc_feature 1..64: note = chr17:48687158-48687222
  misc_feature 1..64: note = hypo
  source 1..64: mol_type = genomic DNA
gagctgaggggaagccgcccctgaggggccctgcccagcgcacctggtccggccagtgaccaat

SEQ ID NO: 45110 - DNA, 25 bp, Homo sapiens
  misc_feature 1..25: note = chr17:48799845-48799870
  misc_feature 1..25: note = hypo
  source 1..25: mol_type = genomic DNA
cgcgcccggccggctcctcttatgc

SEQ ID NO: 45111 - DNA, 120 bp, Homo sapiens; identical to SEQ ID NO: 1620
  misc_feature 1..120: note = chr17:49229470-49229590
  misc_feature 1..120: note = hypo
  source 1..120: mol_type = genomic DNA

SEQ ID NO: 45112 - DNA, 30 bp, Homo sapiens
  misc_feature 1..30: note = chr17:51321147-51321177
  misc_feature 1..30: note = hypo
  source 1..30: mol_type = genomic DNA
ttatgaatatttcctcggtaaaaattaact

SEQ ID NO: 45113 - DNA, 39 bp, Homo sapiens; identical to SEQ ID NO: 16215
  misc_feature 1..39: note = chr17:53479136-53479175
  misc_feature 1..39: note = hypo
  source 1..39: mol_type = genomic DNA

SEQ ID NO: 45114 - DNA, 40 bp, Homo sapiens
  misc_feature 1..40: note = chr17:53916938-53916978
  misc_feature 1..40: note = hypo
  source 1..40: mol_type = genomic DNA
aactggggtgcaggacgagtgtcctcataagaagtcaaag

SEQ ID NO: 45115 - DNA, 30 bp, Homo sapiens; identical to SEQ ID NO: 16216
  misc_feature 1..30: note = chr17:54473510-54473540
  misc_feature 1..30: note = hypo
  source 1..30: mol_type = genomic DNA

SEQ ID NO: 45116 - DNA, 34 bp, Homo sapiens; identical to SEQ ID NO: 5202
  misc_feature 1..34: note = chr17:55037248-55037282
  misc_feature 1..34: note = hypo
  source 1..34: mol_type = genomic DNA

SEQ ID NO: 45117 - DNA, 44 bp, Homo sapiens; identical to SEQ ID NO: 16218
  misc_feature 1..44: note = chr17:55184791-55184835
  misc_feature 1..44: note = hypo
  source 1..44: mol_type = genomic DNA

SEQ ID NO: 45118 - DNA, 181 bp, Homo sapiens
  misc_feature 1..181: note = chr17:55364048-55364229
  misc_feature 1..181: note = hypo
  source 1..181: mol_type = genomic DNA
ggagaatgtatttcccggctcactgtgagcctcgacttaatttgttcctttcctaaggcaaaatgaccttccagtaaacccacaccccctcccccgcttattattatttatttatttttctggtgaacaaacagaattaggaaaggtgtgttcttccaggagagagcgggcagtgtgggag

SEQ ID NO: 45119 - DNA, 70 bp, Homo sapiens
  misc_feature 1..70: note = chr17:56031530-56031600
  misc_feature 1..70: note = hypo
  source 1..70: mol_type = genomic DNA
gtggctcaggtgctgcgggatcacccagggaaggctcattcctctcgctacaagacgctgactgcggatc

SEQ ID NO: 45120 - DNA, 102 bp, Homo sapiens
  misc_feature 1..102: note = chr17:57297027-57297129
  misc_feature 1..102: note = hypo
  source 1..102: mol_type = genomic DNA
tacaggcgtgggccaccgcgcccggctgaatcaggattttaaatattcactctgcttttctagtcctgtgggagatatggtcttctccgtaaaatttctccc

SEQ ID NO: 45121 - DNA, 30 bp, Homo sapiens
  misc_feature 1..30: note = chr17:57881555-57881585
  misc_feature 1..30: note = hypo
  source 1..30: mol_type = genomic DNA
gaaagcaaaattgcacgtaacatatagaac

SEQ ID NO: 45122 - DNA, 21 bp, Homo sapiens
  misc_feature 1..21: note = chr17:58471329-58471350
  misc_feature 1..21: note = hypo
  source 1..21: mol_type = genomic DNA
ccaccgcgccccaccaatatt

SEQ ID NO: 45123 - DNA, 110 bp, Homo sapiens
  misc_feature 1..110: note = chr17:60216644-60216754
  misc_feature 1..110: note = hypo
  source 1..110: mol_type = genomic DNA
acctggcgctctaggcggttcttggtctcccgtagctcccggcacagtgctttctcccattggtcccgcagggtcttcagggtcttccgcgcgtgcgtgacctccttgct

SEQ ID NO: 45124 - DNA, 41 bp, Homo sapiens
  misc_feature 1..41: note = chr17:60221577-60221618
  misc_feature 1..41: note = hypo
  source 1..41: mol_type = genomic DNA
atatagagtaattcaagctaaggacccgcatgctaactagg

SEQ ID NO: 45125 - DNA, 30 bp, Homo sapiens
  misc_feature 1..30: note = chr17:60242060-60242090
  misc_feature 1..30: note = hypo
  source 1..30: mol_type = genomic DNA
aatgagactctatttcggaaaaaaaaaaga

SEQ ID NO: 45126 - DNA, 35 bp, Homo sapiens
  misc_feature 1..35: note = chr17:60670444-60670479
  misc_feature 1..35: note = hypo
  source 1..35: mol_type = genomic DNA
gcccagttcctaacaaggcacggacctgtactggg

SEQ ID NO: 45127 - DNA, 54 bp, Homo sapiens
  misc_feature 1..54: note = chr17:60744566-60744620
  misc_feature 1..54: note = hypo
  source 1..54: mol_type = genomic DNA
acccaggttagaaagcgcggaggaccccgtggtctggggcggagctggagctga

SEQ ID NO: 45128 - DNA, 59 bp, Homo sapiens
  misc_feature 1..59: note = chr17:60766944-60767003
  misc_feature 1..59: note = hypo
  source 1..59: mol_type = genomic DNA
ctcaacggcaccttccggctgcttcagaagccgctgcgctggcacgatgccctcctgct

SEQ ID NO: 45129 - DNA, 234 bp, Homo sapiens
  misc_feature 1..234: note = chr17:60856637-60856871
  misc_feature 1..234: note = hypo
  source 1..234: mol_type = genomic DNA
cagaaagaagaggcccgacccacaaggaatctgagaatgggcaagcagaaattagagaaaattaaaagcatgattcatggaacacatatgccacatcctaagccgtggctgctttcatgacactgtaaagggtgtcagtgggttgacattgacagattaatgggaggatgtctccccaagagccgtttgaaagtggagaagctgaaggtttcacggacacgataggatgaatca

SEQ ID NO: 45130 - DNA, 80 bp, Homo sapiens
  misc_feature 1..80: note = chr17:61580796-61580876
  misc_feature 1..80: note = hypo
  source 1..80: mol_type = genomic DNA
ccgtcctcagcttcacgctcgaataaacctgttaaactggattctgatcttttttattatttcaggttgacagaacactg

SEQ ID NO: 45131 - DNA, 19 bp, Homo sapiens
  misc_feature 1..19: note = chr17:61580936-61580955
  misc_feature 1..19: note = hypo
  source 1..19: mol_type = genomic DNA
tgcccgatcatatggtaat

SEQ ID NO: 45132 - DNA, 66 bp, Homo sapiens
  misc_feature 1..66: note = chr17:61607855-61607921
  misc_feature 1..66: note = hypo
  source 1..66: mol_type = genomic DNA
cataaggtggtggagcggacacagaacgtcactgagaaggtcacccaggtgcgggcctgcagagca

SEQ ID NO: 45133 - DNA, 30 bp, Homo sapiens
  misc_feature 1..30: note = chr17:61677509-61677539
  misc_feature 1..30: note = hypo
  source 1..30: mol_type = genomic DNA
gtgagccaccgcgcccggctgtcctgcttc

SEQ ID NO: 45134 - DNA, 160 bp, Homo sapiens
  misc_feature 1..160: note = chr17:61817857-61818017
  misc_feature 1..160: note = hypo
  source 1..160: mol_type = genomic DNA
gcgaaactccatctcaaaaaaattaaaataaaaataaagagagaaaataataaacccagcaaacatttatggcaaacttcctacgtgtcaggcactgtgctaaatgcttcatgagcagctcacaagtattatcatctctgttttacggatcaggaaattc

SEQ ID NO: 45135 - DNA, 30 bp, Homo sapiens
  misc_feature 1..30: note = chr17:61847674-61847704
  misc_feature 1..30: note = hypo
  source 1..30: mol_type = genomic DNA
aggcattgcagactgcggaacaggtttggc

SEQ ID NO: 45136 - DNA, 30 bp, Homo sapiens
  misc_feature 1..30: note = chr17:62020148-62020178
  misc_feature 1..30: note = hypo
  source 1..30: mol_type = genomic DNA
tcagtgctgccctgccggtccagcccgccc

SEQ ID NO: 45137 - DNA, 16 bp, Homo sapiens
  misc_feature 1..16: note = chr17:62054818-62054834
  misc_feature 1..16: note = hypo
  source 1..16: mol_type = genomic DNA
gcgatagagcaagacc

SEQ ID NO: 45138 - DNA, 227 bp, Homo sapiens
  misc_feature 1..227: note = chr17:64672331-64672558
  misc_feature 1..227: note = hypo
  source 1..227: mol_type = genomic DNA
tcccagtaacgtgaccgggaaaatgtgagccagaggaaacttgagagctccgtggtgcggctgagctggtggggtgagggttttttccctttttctatctggtccagcccatcggccacttgagatgctcctgaactgagtaaccaagctgttcggagggtactttctcagcaggacaagccctgagctctggaaaaacgcagctagaataacgaggaagcagaggg

SEQ ID NO: 45139 - DNA, 30 bp, Homo sapiens
  misc_feature 1..30: note = chr17:65298508-65298538
  misc_feature 1..30: note = hypo
  source 1..30: mol_type = genomic DNA
atctcagtattctatcgatcactaggaaga

SEQ ID NO: 45140 - DNA, 24 bp, Homo sapiens
  misc_feature 1..24: note = chr17:65789887-65789911
  misc_feature 1..24: note = hypo
  source 1..24: mol_type = genomic DNA
cccagcactttgggacgttgaggc

SEQ ID NO: 45141 - DNA, 39 bp, Homo sapiens
  misc_feature 1..39: note = chr17:66421027-66421066
  misc_feature 1..39: note = hypo
  source 1..39: mol_type = genomic DNA
caaaacaaatcagtacttccatctcgaaatgatttcagg

SEQ ID NO: 45142 - DNA, 20 bp, Homo sapiens
  misc_feature 1..20: note = chr17:66462836-66462856
  misc_feature 1..20: note = hypo
  source 1..20: mol_type = genomic DNA
gtcaccgtgcccaaccatgt

SEQ ID NO: 45143 - DNA, 30 bp, Homo sapiens; identical to SEQ ID NO: 16224
  misc_feature 1..30: note = chr17:66643303-66643333
  misc_feature 1..30: note = hypo
  source 1..30: mol_type = genomic DNA

SEQ ID NO: 45144 - DNA, 30 bp, Homo sapiens
  misc_feature 1..30: note = chr17:66872616-66872646
  misc_feature 1..30: note = hypo
  source 1..30: mol_type = genomic DNA
cctcggggtccatcccggtcgacggctcat

SEQ ID NO: 45145 - DNA, 22 bp, Homo sapiens
  misc_feature 1..22: note = chr17:67410388-67410410
  misc_feature 1..22: note = hypo
  source 1..22: mol_type = genomic DNA
tccctctcgggaaaaaaacaac

SEQ ID NO: 45146 - DNA, 24 bp, Homo sapiens
  misc_feature 1..24: note = chr17:68268160-68268184
  misc_feature 1..24: note = hypo
  source 1..24: mol_type = genomic DNA
ttaaaaaaatattgtcggccgggc

SEQ ID NO: 45147 - DNA, 38 bp, Homo sapiens; identical to SEQ ID NO: 16227
  misc_feature 1..38: note = chr17:70657503-70657541
  misc_feature 1..38: note = hypo
  source 1..38: mol_type = genomic DNA

SEQ ID NO: 45148 - DNA, 30 bp, Homo sapiens; identical to SEQ ID NO: 16228
  misc_feature 1..30: note = chr17:70712704-70712734
  misc_feature 1..30: note = hypo
  source 1..30: mol_type = genomic DNA

SEQ ID NO: 45149 - DNA, 30 bp, Homo sapiens
  misc_feature 1..30: note = chr17:71201620-71201650
  misc_feature 1..30: note = hypo
  source 1..30: mol_type = genomic DNA
tgaagctgtttattacgctcacataccaag

SEQ ID NO: 45150 - DNA, 30 bp, Homo sapiens
  misc_feature 1..30: note = chr17:71202377-71202407
  misc_feature 1..30: note = hypo
  source 1..30: mol_type = genomic DNA
catcgcctggtgcagcgaacttctgtgagt

SEQ ID NO: 45151 - DNA, 30 bp, Homo sapiens
  misc_feature 1..30: note = chr17:71375377-71375407
  misc_feature 1..30: note = hypo
  source 1..30: mol_type = genomic DNA
gctgtgtggccgtggcgccgtggacgacca

SEQ ID NO: 45152 - DNA, 30 bp, Homo sapiens; identical to SEQ ID NO: 16229
  misc_feature 1..30: note = chr17:71391476-71391506
  misc_feature 1..30: note = hypo
  source 1..30: mol_type = genomic DNA

SEQ ID NO: 45153 - DNA, 30 bp, Homo sapiens
  misc_feature 1..30: note = chr17:71417363-71417393
  misc_feature 1..30: note = hypo
  source 1..30: mol_type = genomic DNA
taactgctctccacacgggctgccacctgc

SEQ ID NO: 45154 - DNA, 30 bp, Homo sapiens
  misc_feature 1..30: note = chr17:71427753-71427783
  misc_feature 1..30: note = hypo
  source 1..30: mol_type = genomic DNA
tccaggggtgtgaagcgaggcagctgcaca

SEQ ID NO: 45155 - DNA, 30 bp, Homo sapiens
  misc_feature 1..30: note = chr17:71484009-71484039
  misc_feature 1..30: note = hypo
  source 1..30: mol_type = genomic DNA
agtctttaacaacctcggctgtggcttcag

SEQ ID NO: 45156 - DNA, 21 bp, Homo sapiens
  misc_feature 1..21: note = chr17:71879558-71879579
  misc_feature 1..21: note = hypo
  source 1..21: mol_type = genomic DNA
ctccaaaatccgaaacgctcc

SEQ ID NO: 45157 - DNA, 30 bp, Homo sapiens
  misc_feature 1..30: note = chr17:72233647-72233677
  misc_feature 1..30: note = hypo
  source 1..30: mol_type = genomic DNA
ctacaggtgaaggaccggtgggaggcagag

SEQ ID NO: 45158 - DNA, 119 bp, Homo sapiens
  misc_feature 1..119: note = chr17:72356210-72356329
  misc_feature 1..119: note = hypo
  source 1..119: mol_type = genomic DNA
gcagcaggcggtgggcgtggaatacccggacctcatcggtgcccgcagcctgcacccgcagaaccacatcgctggcgttgccctgccgcagcagctcctgcaagcgctggagcaccgcc

SEQ ID NO: 45159 - DNA, 30 bp, Homo sapiens; identical to SEQ ID NO: 16232
  misc_feature 1..30: note = chr17:72370768-72370798
  misc_feature 1..30: note = hypo
  source 1..30: mol_type = genomic DNA

SEQ ID NO: 45160 - DNA, 30 bp, Homo sapiens
  misc_feature 1..30: note = chr17:72731669-72731699
  misc_feature 1..30: note = hypo
  source 1..30: mol_type = genomic DNA
gtctccgggagcccacggcattgagcaaac

SEQ ID NO: 45161 - DNA, 30 bp, Homo sapiens
  misc_feature 1..30: note = chr17:72800435-72800465
  misc_feature 1..30: note = hypo
  source 1..30: mol_type = genomic DNA
cagtgtcccagccagcggtgctggccctgc

SEQ ID NO: 45162 - DNA, 30 bp, Homo sapiens
  misc_feature 1..30: note = chr17:72969610-72969640
  misc_feature 1..30: note = hypo
  source 1..30: mol_type = genomic DNA
tcatcaaaacaaggccgggtgcggtggcta

SEQ ID NO: 45163 - DNA, 19 bp, Homo sapiens
  misc_feature 1..19: note = chr17:73031621-73031640
  misc_feature 1..19: note = hypo
  source 1..19: mol_type = genomic DNA
actccagtctctggccggg

SEQ ID NO: 45164 - DNA, 26 bp, Homo sapiens
  misc_feature 1..26: note = chr17:73083437-73083463
  misc_feature 1..26: note = hypo
  source 1..26: mol_type = genomic DNA
agcgagactcccggccaactgagtac

SEQ ID NO: 45165 - DNA, 257 bp, Homo sapiens
  misc_feature 1..257: note = chr17:73089693-73089950
  misc_feature 1..257: note = hypo
  source 1..257: mol_type = genomic DNA
cattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcaggtgagcggcctagggagggg

SEQ ID NO: 45166 - DNA, 105 bp, Homo sapiens
  misc_feature 1..105: note = chr17:73091075-73091180
  misc_feature 1..105: note = hypo
  source 1..105: mol_type = genomic DNA
agactgcagagaccccggcctcggaggggcccggtggacagcagcccgagctgatggcccacaggcctctgcaggcgtgtgtctgctggccgcagctgcccatct

SEQ ID NO: 45167 - DNA, 30 bp, Homo sapiens
  misc_feature 1..30: note = chr17:73091437-73091467
  misc_feature 1..30: note = hypo
  source 1..30: mol_type = genomic DNA
tccccagctgacttgcggctcaccaccccc

SEQ ID NO: 45168 - DNA, 30 bp, Homo sapiens
  misc_feature 1..30: note = chr17:73124882-73124912
  misc_feature 1..30: note = hypo
  source 1..30: mol_type = genomic DNA
tgtctgccatcaccacgctcatgcacctga

SEQ ID NO: 45169 - DNA, 17 bp, Homo sapiens
  misc_feature 1..17: note = chr17:73135904-73135921
  misc_feature 1..17: note = hypo
  source 1..17: mol_type = genomic DNA
tccgtctcaaaaataaa

SEQ ID NO: 45170 - DNA, 41 bp, Homo sapiens
  misc_feature 1..41: note = chr17:73179823-73179864
  misc_feature 1..41: note = hypo
  source 1..41: mol_type = genomic DNA
ggattacaggcgtgagccaccgcgcccggcctacagtgtct

SEQ ID NO: 45171 - DNA, 463 bp, Homo sapiens
  misc_feature 1..463: note = chr17:73585955-73586418
  misc_feature 1..463: note = hypo
  source 1..463: mol_type = genomic DNA
cccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttat

SEQ ID NO: 45172 - DNA, 48 bp, Homo sapiens
  misc_feature 1..48: note = chr17:73592635-73592683
  misc_feature 1..48: note = hypo
  source 1..48: mol_type = genomic DNA
ggtaagaggattgggcgtggacgtggcaggggccgctcaggcattgcc

SEQ ID NO: 45173 - DNA, 52 bp, Homo sapiens
  misc_feature 1..52: note = chr17:73606380-73606432
  misc_feature 1..52: note = hypo
  source 1..52: mol_type = genomic DNA
gctgcctgagctggccgagctggccaaatcccagcagcgttgaccctctcag

SEQ ID NO: 45174 - DNA, 30 bp, Homo sapiens
  misc_feature 1..30: note = chr17:73608306-73608336
  misc_feature 1..30: note = hypo
  source 1..30: mol_type = genomic DNA
ttattgaatgggagacgttatttagatcca

SEQ ID NO: 45175 - DNA, 200 bp, Homo sapiens
  misc_feature 1..200: note = chr17:73615929-73616129
  misc_feature 1..200: note = hypo
  source 1..200: mol_type = genomic DNA
acctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggtaagtgtggggcacgggttgagaggccg

SEQ ID NO: 45176 - DNA, 30 bp, Homo sapiens
  misc_feature 1..30: note = chr17:73635801-73635831
  misc_feature 1..30: note = hypo
  source 1..30: mol_type = genomic DNA
ccatgaacctgctctcgggagaacctgctc

SEQ ID NO: 45177 - DNA, 254 bp, Homo sapiens
  misc_feature 1..254: note = chr17:73636137-73636391
  misc_feature 1..254: note = hypo
  source 1..254: mol_type = genomic DNA
gacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagt

SEQ ID NO: 45178 - DNA, 37 bp, Homo sapiens; identical to SEQ ID NO: 16241
  misc_feature 1..37: note = chr17:73638388-73638425
  misc_feature 1..37: note = hypo
  source 1..37: mol_type = genomic DNA

SEQ ID NO: 45179 - DNA, 39 bp, Homo sapiens
  misc_feature 1..39: note = chr17:73693123-73693162
  misc_feature 1..39: note = hypo
  source 1..39: mol_type = genomic DNA
tgggattacaggtgtgagccaccgcgcccggcccctcct

SEQ ID NO: 45180 - DNA, 30 bp, Homo sapiens
  misc_feature 1..30: note = chr17:73931814-73931844
  misc_feature 1..30: note = hypo
  source 1..30: mol_type = genomic DNA
tcaaggcttgagactcgccagaaggcgtca

SEQ ID NO: 45181 - DNA, 42 bp, Homo sapiens
  misc_feature 1..42: note = chr17:74005455-74005497
  misc_feature 1..42: note = hypo
  source 1..42: mol_type = genomic DNA
agctgagccttcaggcggtcgatctcacgcagcacctcgggg

SEQ ID NO: 45182 - DNA, 30 bp, Homo sapiens
  misc_feature 1..30: note = chr17:74028304-74028334
  misc_feature 1..30: note = hypo
  source 1..30: mol_type = genomic DNA
aggttagagatgaaacgatccctggggctg

SEQ ID NO: 45183 - DNA, 30 bp, Homo sapiens
  misc_feature 1..30: note = chr17:74062044-74062074
  misc_feature 1..30: note = hypo
  source 1..30: mol_type = genomic DNA
acctatgtgaatgggcgtggctgggttcca

SEQ ID NO: 45184 - DNA, 165 bp, Homo sapiens; identical to SEQ ID NO: 16242
  misc_feature 1..165: note = chr17:74128189-74128354
  misc_feature 1..165: note = hypo
  source 1..165: mol_type = genomic DNA

SEQ ID NO: 45185 - DNA, 30 bp, Homo sapiens
  misc_feature 1..30: note = chr17:74362291-74362321
  misc_feature 1..30: note = hypo
  source 1..30: mol_type = genomic DNA
tggctggttctgattcgtgttcttttgctg

SEQ ID NO: 45186 - DNA, 30 bp, Homo sapiens; identical to SEQ ID NO: 16243
  misc_feature 1..30: note = chr17:74908784-74908814
  misc_feature 1..30: note = hypo
  source 1..30: mol_type = genomic DNA

SEQ ID NO: 45187 - DNA, 30 bp, Homo sapiens
  misc_feature 1..30: note = chr17:74920559-74920589
  misc_feature 1..30: note = hypo
  source 1..30: mol_type = genomic DNA
gcctgcagcagctcgcggcctcagccagcc

SEQ ID NO: 45188 - DNA, 178 bp, Homo sapiens
  misc_feature 1..178: note = chr17:75049797-75049975
  misc_feature 1..178: note = hypo
  source 1..178: mol_type = genomic DNA
ggcctgtgttcaaatcgactctgctctgacttgtggtgtggacttggccgcgggactgagcgcggggcctgctcaggggccagcgtcacagggaagacagtccgagcaagcatgggtcagggcgctgaggcttcctcctgcgagccaaagggaaactcagccacggggactcagggag

SEQ ID NO: 45189 - DNA, 30 bp, Homo sapiens
  misc_feature 1..30: note = chr17:75207839-75207869
  misc_feature 1..30: note = hypo
  source 1..30: mol_type = genomic DNA
tgtagcaggatccagcggttgaatggatgg

SEQ ID NO: 45190 - DNA, 104 bp, Homo sapiens
  misc_feature 1..104: note = chr17:75523080-75523184
  misc_feature 1..104: note = hypo
  source 1..104: mol_type = genomic DNA
agtttgagaagatggcggcctgaaccggagtccttcttcccctcctccctctccgctgctgcaatgcccaggccccccgcaacgttcctcgtctgtaatggtgc

SEQ ID NO: 45191 - DNA, 39 bp, Homo sapiens
  misc_feature 1..39: note = chr17:75544134-75544173
  misc_feature 1..39: note = hypo
  source 1..39: mol_type = genomic DNA
ctaggactaacaggcgtgagccaccgcacccggccaagc

SEQ ID NO: 45192 - DNA, 56 bp, Homo sapiens
  misc_feature 1..56: note = chr17:75630378-75630434
  misc_feature 1..56: note = hypo
  source 1..56: mol_type = genomic DNA
gcaacatgggcaaggcgaaggttggaggctgggagggacatcgattcaaatcattg

SEQ ID NO: 45193 - DNA, 41 bp, Homo sapiens
  misc_feature 1..41: note = chr17:75733967-75734008
  misc_feature 1..41: note = hypo
  source 1..41: mol_type = genomic DNA
acagagaataaaagacgcggcccgtacgcagagctgaagtg

SEQ ID NO: 45194 - DNA, 33 bp, Homo sapiens
  misc_feature 1..33: note = chr17:75770731-75770764
  misc_feature 1..33: note = hypo
  source 1..33: mol_type = genomic DNA
ccctttttagaacaacgtcggggggtggtctgt

SEQ ID NO: 45195 - DNA, 30 bp, Homo sapiens
  misc_feature 1..30: note = chr17:75840791-75840821
  misc_feature 1..30: note = hypo
  source 1..30: mol_type = genomic DNA
ttgtacacttaaaaacggctcattttgagc

SEQ ID NO: 45196 - DNA, 43 bp, Homo sapiens
  misc_feature 1..43: note = chr17:75905178-75905221
  misc_feature 1..43: note = hypo
  source 1..43: mol_type = genomic DNA
catagggaatgaacacggatgaccccctcgttttctgagtaag

SEQ ID NO: 45197 - DNA, 79 bp, Homo sapiens
  misc_feature 1..79: note = chr17:76021242-76021321
  misc_feature 1..79: note = hypo
  source 1..79: mol_type = genomic DNA
ttgacatgcacagtattgtgtatctgtcatagcagtttccctgccctaaaaatcccctgtgctccgcatagtcatcccc

SEQ ID NO: 45198 - DNA, 41 bp, Homo sapiens
  misc_feature 1..41: note = chr17:76101087-76101128
  misc_feature 1..41: note = hypo
  source 1..41: mol_type = genomic DNA
aaacagtgcgggctgcggtgggtcagcgtcacatgctaatg

SEQ ID NO: 45199 - DNA, 92 bp, Homo sapiens
  misc_feature 1..92: note = chr17:76134317-76134409
  misc_feature 1..92: note = hypo
  source 1..92: mol_type = genomic DNA
gccttgagctgggctcgcctcctgctcctgctcctgcccccttccctgggtgtcagccccctggggtctgcataactcgctgactcctggtt

SEQ ID NO: 45200 - DNA, 82 bp, Homo sapiens
  misc_feature 1..82: note = chr17:76136106-76136188
  misc_feature 1..82: note = hypo
  source 1..82: mol_type = genomic DNA
gagcaaaactccgtctcaaaaaaggaaaaaaggataacatggctgagtgcagtggctcacgccgaggcgtgaagagtgcttg

SEQ ID NO: 45201 - DNA, 292 bp, Homo sapiens; identical to SEQ ID NO: 5208
  misc_feature 1..292: note = chr17:76137898-76138190
  misc_feature 1..292: note = hypo
  source 1..292: mol_type = genomic DNA

SEQ ID NO: 45202 - DNA, 38 bp, Homo sapiens
  misc_feature 1..38: note = chr17:76138696-76138734
  misc_feature 1..38: note = hypo
  source 1..38: mol_type = genomic DNA
agctctgtgttccatcgagggggcgacaagcctggacc

SEQ ID NO: 45203 - DNA, 19 bp, Homo sapiens
  misc_feature 1..19: note = chr17:76146895-76146914
  misc_feature 1..19: note = hypo
  source 1..19: mol_type = genomic DNA
agcctacactccaaacggc

SEQ ID NO: 45204 - DNA, 33 bp, Homo sapiens
  misc_feature 1..33: note = chr17:76211252-76211285
  misc_feature 1..33: note = hypo
  source 1..33: mol_type = genomic DNA
tttcggaggctgaggcgggcggatcacctgagg

SEQ ID NO: 45205 - DNA, 93 bp, Homo sapiens
  misc_feature 1..93: note = chr17:76211525-76211618
  misc_feature 1..93: note = hypo
  source 1..93: mol_type = genomic DNA
aaagaaagcatatacttcagtgttgttctggatttttttcttcaagatgcctagttaatgacaatgaaattctgtactcggatggtatctgtc

SEQ ID NO: 45206 - DNA, 18 bp, Homo sapiens
  misc_feature 1..18: note = chr17:76212036-76212054
  misc_feature 1..18: note = hypo
  source 1..18: mol_type = genomic DNA
atccttacagtgggccgg

SEQ ID NO: 45207 - DNA, 30 bp, Homo sapiens
  misc_feature 1..30: note = chr17:76217104-76217134
  misc_feature 1..30: note = hypo
  source 1..30: mol_type = genomic DNA
gggcgatgcattgggcgctgattcttgttc

SEQ ID NO: 45208 - DNA, 125 bp, Homo sapiens
  misc_feature 1..125: note = chr17:76395588-76395713
  misc_feature 1..125: note = hypo
  source 1..125: mol_type = genomic DNA
cctcttcgacaacagcgtcatcttgagcgggtgagtgcttcccaccgtcagtgcttttgccctcctgctctgcaggctggagggcagtggaataggaacagtgggaaacccgttcccctcagtct

SEQ ID NO: 45209 - DNA, 44 bp, Homo sapiens
  misc_feature 1..44: note = chr17:76404759-76404803
  misc_feature 1..44: note = hypo
  source 1..44: mol_type = genomic DNA
aaggtgctgccaggccgcttcacctgcatcgccttggctttggg

SEQ ID NO: 45210 - DNA, 30 bp, Homo sapiens; identical to SEQ ID NO: 16251
  misc_feature 1..30: note = chr17:76419409-76419439
  misc_feature 1..30: note = hypo
  source 1..30: mol_type = genomic DNA

SEQ ID NO: 45211 - DNA, 53 bp, Homo sapiens
  misc_feature 1..53: note = chr17:76498919-76498972
  misc_feature 1..53: note = hypo
  source 1..53: mol_type = genomic DNA
cccttatctcagccacgaggcgccgccgagcccccacccgcctcagacctggg

SEQ ID NO: 45212 - DNA, 99 bp, Homo sapiens
  misc_feature 1..99: note = chr17:76501675-76501774
  misc_feature 1..99: note = hypo
  source 1..99: mol_type = genomic DNA
aacaaaaggaaccagcgaagactgctctgagtcaggacacagaaaccaggccaggaaccgcagcccttctaagccaaacatccattctggaagatttct

SEQ ID NO: 45213 - DNA, 30 bp, Homo sapiens
  misc_feature 1..30: note = chr17:76526202-76526232
  misc_feature 1..30: note = hypo
  source 1..30: mol_type = genomic DNA
aggtgctcggtacaccgggtttggagaagg

SEQ ID NO: 45214 - DNA, 66 bp, Homo sapiens
  misc_feature 1..66: note = chr17:76557445-76557511
  misc_feature 1..66: note = hypo
  source 1..66: mol_type = genomic DNA
accgtgaagcctccccggcccctggctgtccaggagacttggccaagtgcacgcaacagtggctca

SEQ ID NO: 45215 - DNA, 78 bp, Homo sapiens
  misc_feature 1..78: note = chr17:76670740-76670818
  misc_feature 1..78: note = hypo
  source 1..78: mol_type = genomic DNA
gcctcctcagggctgcgccctgcaccgccctggtccagggtcctgtggaggggcggggcgagacggccagacagccag

SEQ ID NO: 45216 - DNA, 112 bp, Homo sapiens
  misc_feature 1..112: note = chr17:76676225-76676337
  misc_feature 1..112: note = hypo
  source 1..112: mol_type = genomic DNA
gagggctgcaccaggcgcgcactgccctttctcagcagtcacttacttaatgcacttaatccactcctccttctcctcgggcgtcggagctgagatccggtaaacagtgtgg

SEQ ID NO: 45217 - DNA, 80 bp, Homo sapiens
  misc_feature 1..80: note = chr17:76897106-76897186
  misc_feature 1..80: note = hypo
  source 1..80: mol_type = genomic DNA
gcaggcacagcgccacgtccacgggcaccgcccgttcccaccctgcaggacgccacagcatcagacgagacggcccgtgt

SEQ ID NO: 45218 - DNA, 33 bp, Homo sapiens
  misc_feature 1..33: note = chr17:76958740-76958773
  misc_feature 1..33: note = hypo
  source 1..33: mol_type = genomic DNA
tttccacctttggatcgacgctgaccttgtgat

SEQ ID NO: 45219 - DNA, 213 bp, Homo sapiens
  misc_feature 1..213: note = chr17:76974264-76974477
  misc_feature 1..213: note = hypo
  source 1..213: mol_type = genomic DNA
agggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccccttgtcggggctccccgggcaccactggag

SEQ ID NO: 45220 - DNA, 49 bp, Homo sapiens
  misc_feature 1..49: note = chr17:76991604-76991653
  misc_feature 1..49: note = hypo
  source 1..49: mol_type = genomic DNA
cactctgaaggggcacgtgtgtcccaggggagtgcgggtgctgccctcg

SEQ ID NO: 45221 - DNA, 30 bp, Homo sapiens
  misc_feature 1..30: note = chr17:76997571-76997601
  misc_feature 1..30: note = hypo
  source 1..30: mol_type = genomic DNA
ctgctgaataaatggcgaatctgttaatga

SEQ ID NO: 45222 - DNA, 272 bp, Homo sapiens
  misc_feature 1..272: note = chr17:77002640-77002912
  misc_feature 1..272: note = hypo
  source 1..272: mol_type = genomic DNA
tgtctatggtgtgggcgcacagcttcagaaccctctacggtttgcagttactgccttgtaaagaggctgtgtctgcttaatttgtatcatcgatgttacacctggaggaattttagccaaaaggcgaccttctcagttgaaaggcacattccaaatggcaccacacatctgggaaggtgtccttttccagagtgtgtgaaaataacgggatgggatcatcgccccatggacctggatcagggctgccttccacaccgcggtggcacctgcac

SEQ ID NO: 45223 - DNA, 32 bp, Homo sapiens
  misc_feature 1..32: note = chr17:77003134-77003166
  misc_feature 1..32: note = hypo
  source 1..32: mol_type = genomic DNA
accatcccagaggaacgcggggagcagcgtcc

SEQ ID NO: 45224 - DNA, 30 bp, Homo sapiens
  misc_feature 1..30: note = chr17:77104088-77104118
  misc_feature 1..30: note = hypo
  source 1..30: mol_type = genomic DNA
cttccttcgccttcccgcctcaattccatg

SEQ ID NO: 45225 - DNA, 178 bp, Homo sapiens
  misc_feature 1..178: note = chr17:77105020-77105198
  misc_feature 1..178: note = hypo
  source 1..178: mol_type = genomic DNA
cagctctgtcccctgcgttgaacagcgaggatgcagcacacaccccacagcgtgggaaccgctgtcccgatgctcacctgggcatgcgctgcaggacctgtctcagcagacgcgccatgtggtatgctgtcccaattccgacaagcatgtgttctgagctgtacgtgttcccaaggtg

SEQ ID NO: 45226 - DNA, 30 bp, Homo sapiens
  misc_feature 1..30: note = chr17:77126850-77126880
  misc_feature 1..30: note = hypo
  source 1..30: mol_type = genomic DNA
ccctgtccttcagcccgggcttggtgcggg

SEQ ID NO: 45227 - DNA, 30 bp, Homo sapiens; identical to SEQ ID NO: 16254
  misc_feature 1..30: note = chr17:77127147-77127177
  misc_feature 1..30: note = hypo
  source 1..30: mol_type = genomic DNA

SEQ ID NO: 45228 - DNA, 72 bp, Homo sapiens
  misc_feature 1..72: note = chr17:77135878-77135950
  misc_feature 1..72: note = hypo
  source 1..72: mol_type = genomic DNA
gcatctctgcactgacgatgccggaggggcagaaccaccgtgtgtgcccggggaggacgtcttgctgacttc

SEQ ID NO: 45229 - DNA, 206 bp, Homo sapiens
  misc_feature 1..206: note = chr17:77143891-77144097
  misc_feature 1..206: note = hypo
  source 1..206: mol_type = genomic DNA
gcaagctttgccaagcgccttcgatccagcctctctctcatgctaatgactgtcaacatgaaacagaggctgtgaaggggaagaaaattactccctgaaaaggaattgactgatccccatcatttctcaaggaatcactgacctgtgaatatttcattacccaaaatgctgcaccatccatccagagccgccgctgccgtggggcc

SEQ ID NO: 45230 - DNA, 154 bp, Homo sapiens
  misc_feature 1..154: note = chr17:77145129-77145283
  misc_feature 1..154: note = hypo
  source 1..154: mol_type = genomic DNA
agctcccaccactgacgaacagcgcactctaaagcttaagaagcacaaggagatcctccagggcatggaggctcccgcagcacccaggctgggacccccgctgcctgccaggaaaatgcgacgtctgtgctattattgccggggttacaccagg

SEQ ID NO: 45231 - DNA, 45 bp, Homo sapiens
  misc_feature 1..45: note = chr17:77147241-77147286
  misc_feature 1..45: note = hypo
  source 1..45: mol_type = genomic DNA
ggcaagcaacaaagccggcatcagaccctgcgtgctgaccacccc

SEQ ID NO: 45232 - DNA, 30 bp, Homo sapiens
  misc_feature 1..30: note = chr17:77174895-77174925
  misc_feature 1..30: note = hypo
  source 1..30: mol_type = genomic DNA
agaataaacatcacccgacctcaactactt

SEQ ID NO: 45233 - DNA, 30 bp, Homo sapiens
  misc_feature 1..30: note = chr17:77365458-77365488
  misc_feature 1..30: note = hypo
  source 1..30: mol_type = genomic DNA
gaccgtgacccttgccgtgactgctggggg

SEQ ID NO: 45234 - DNA, 34 bp, Homo sapiens
  misc_feature 1..34: note = chr17:77390969-77391003
  misc_feature 1..34: note = hypo
  source 1..34: mol_type = genomic DNA
gagacgcaacacaggcgctcggggcgtgtgcagg

SEQ ID NO: 45235 - DNA, 34 bp, Homo sapiens
  misc_feature 1..34: note = chr17:77807459-77807493
  misc_feature 1..34: note = hypo
  source 1..34: mol_type = genomic DNA
ctagaactctgaggccgggcgcagagctgccctg

SEQ ID NO: 45236 - DNA, 244 bp, Homo sapiens
  misc_feature 1..244: note = chr17:77807717-77807961
  misc_feature 1..244: note = hypo
  source 1..244: mol_type = genomic DNA
cccccgcgggaatggcgcttccccttccgacgccctccggctacaccgtcacgtactccttgaaagtaacggtgaggcagttcgcggtgacgtcggtgataattatattcccaaagaagggcttgaactcgctcagcgactctgcaggttcgtcctgggcctcggctggaggcttctccgccgtcgtggtgggtgccgctgccgccgccaccgccaccgccgccgacgccggtgtctcgggctt

SEQ ID NO: 45237 - DNA, 78 bp, Homo sapiens
  misc_feature 1..78: note = chr17:77808479-77808557
  misc_feature 1..78: note = hypo
  source 1..78: mol_type = genomic DNA
ccttcttctcctctgcgcccgccgcctttttaaaagtcctgtcggcaggagggtggcgctcgtcggctgcccgcttct

SEQ ID NO: 45238 - DNA, 217 bp, Homo sapiens
  misc_feature 1..217: note = chr17:77825381-77825598
  misc_feature 1..217: note = hypo
  source 1..217: mol_type = genomic DNA
ctgcaagcgtcggggcgtgtccacacccttgtccgacgtgtccctggcatctggcacagtgcccagcacgtacctgtcagatgaatgttgaattaataggatttgtgtgaggaccgagtgagctcacacagccagatgaagctggtccacccgtacgggctggcaagagccgttggccacattctcagacattttgtgaacccgttgttgaacccag

SEQ ID NO: 45239 - DNA, 78 bp, Homo sapiens; identical to SEQ ID NO: 16257
  misc_feature 1..78: note = chr17:77926480-77926558
  misc_feature 1..78: note = hypo
  source 1..78: mol_type = genomic DNA

SEQ ID NO: 45240 - DNA, 211 bp, Homo sapiens
  misc_feature 1..211: note = chr17:77948908-77949119
  misc_feature 1..211: note = hypo
  source 1..211: mol_type = genomic DNA
acacccggaacaatccgccaggccgcgtcactcctcaccctccagcagggctttggatttttggacagcgagttctgtttcattttgttttgtttttccctttgcatttggtgaactccgtgtcaggaaagctagtctttgggattcaaggaagaacaaaacaaacccgatctcctgtaatctacctggattggaacgcccagctttgtac

SEQ ID NO: 45241 - DNA, 57 bp, Homo sapiens
  misc_feature 1..57: note = chr17:78078914-78078971
  misc_feature 1..57: note = hypo
  source 1..57: mol_type = genomic DNA
accgcctccacttcacggtgggcagggcaggggcgggggcggcggccagggcagagg

SEQ ID NO: 45242 - DNA, 40 bp, Homo sapiens
  misc_feature 1..40: note = chr17:78083747-78083787
  misc_feature 1..40: note = hypo
  source 1..40: mol_type = genomic DNA
ctgccatcagcagctcgggccctgccgggagctacaggcc

SEQ ID NO: 45243 - DNA, 103 bp, Homo sapiens
  misc_feature 1..103: note = chr17:78122150-78122253
  misc_feature 1..103: note = hypo
  source 1..103: mol_type = genomic DNA
gcacctgggaccacaggtgtccacgcgcagccactaaccgctttcttatctgacactttaagtgcttcttcgtacccagctcctctaacgccttttgaagcag

SEQ ID NO: 45244 - DNA, 60 bp, Homo sapiens
  misc_feature 1..60: note = chr17:78151768-78151828
  misc_feature 1..60: note = hypo
  source 1..60: mol_type = genomic DNA
ttcagcattcttttgcggggggccacaatcagtgacaccctgactcgcaagcctcaatca

SEQ ID NO: 45245 - DNA, 30 bp, Homo sapiens
  misc_feature 1..30: note = chr17:78152480-78152510
  misc_feature 1..30: note = hypo
  source 1..30: mol_type = genomic DNA
tgggacggcttctggcgctgctcctgcaca

SEQ ID NO: 45246 - DNA, 45 bp, Homo sapiens
  misc_feature 1..45: note = chr17:78447074-78447119
  misc_feature 1..45: note = hypo
  source 1..45: mol_type = genomic DNA
agcgtaggagaagggcgtgcccacacctggcgtggcgctggactt

SEQ ID NO: 45247 - DNA, 32 bp, Homo sapiens
  misc_feature 1..32: note = chr17:78599596-78599628
  misc_feature 1..32: note = hypo
  source 1..32: mol_type = genomic DNA
agtatgcctccctcacgcgctgccacaaaggc

SEQ ID NO: 45248 - DNA, 144 bp, Homo sapiens; identical to SEQ ID NO: 16261
  misc_feature 1..144: note = chr17:78667900-78668044
  misc_feature 1..144: note = hypo
  source 1..144: mol_type = genomic DNA

SEQ ID NO: 45249 - DNA, 30 bp, Homo sapiens
  misc_feature 1..30: note = chr17:78820077-78820107
  misc_feature 1..30: note = hypo
  source 1..30: mol_type = genomic DNA
tcccttcgtgcaccccgcaggctctccctc

SEQ ID NO: 45250 - DNA, 76 bp, Homo sapiens
  misc_feature 1..76: note = chr17:78872638-78872714
  misc_feature 1..76: note = hypo
  source 1..76: mol_type = genomic DNA
ggttcctggggatggcggtccagccacaatgacagcagcgcatgacaggagcccaaagacccgaaacagacgcagg

SEQ ID NO: 45251 - DNA, 101 bp, Homo sapiens
  misc_feature 1..101: note = chr17:78975561-78975662
  misc_feature 1..101: note = hypo
  source 1..101: mol_type = genomic DNA
aggctgcagacacttcgctggaaggcacacttgccacggggcaggcagtgtggcagtcagaaatgtgtgggatggaatgggcgcggtggctcacgcctgta

SEQ ID NO: 45252 - DNA, 30 bp, Homo sapiens
  misc_feature 1..30: note = chr17:79001034-79001064
  misc_feature 1..30: note = hypo
  source 1..30: mol_type = genomic DNA
ccagcagcatggagacgtctgggtcctccc

SEQ ID NO: 45253 - DNA, 30 bp, Homo sapiens
  misc_feature 1..30: note = chr17:79066768-79066798
  misc_feature 1..30: note = hypo
  source 1..30: mol_type = genomic DNA
ccagcctgtgcccaccgctcgggggcaggg

SEQ ID NO: 45254 - DNA, 514 bp, Homo sapiens
  misc_feature 1..514: note = chr17:79093967-79094481
  misc_feature 1..514: note = hypo
  source 1..514: mol_type = genomic DNA
gccccgggcagaccccgggtggcggcggcccacctggtcaaagaggtagacggtgacgtcgtcgaagaaggacacggccttcttcttgcgttccaggtcctcgcagaaggtctcggacagcaggctgggcatcttgagcaggctgcgcaggttgcgcgcgctctggctctcagccaccaccacgggcaccgccggcgcctcctcttcgctgtcctcgctaggctcctggacgctgtagcagcggagctcctcgtcagactcgtcgctgtcctcactgtcctcctcctcctcctccggccggccctccaaggccgcagggaggccgggcagagccaggcggagtggggctctgggggtgcctgggccccccatccgcttttgtggggccggccctgacaacagtcctgggggcccctggaactcagagctgttgccttctgatctcagcggaaccggggtcagcaggaaaaactgggagcagctggggctgggcccaggccgcaccttggctggg

SEQ ID NO: 45255 - DNA, 46 bp, Homo sapiens
  misc_feature 1..46: note = chr17:79094742-79094788
  misc_feature 1..46: note = hypo
  source 1..46: mol_type = genomic DNA
aagtaggcagagtctcggtagggattcttctcgttgaggccactga

SEQ ID NO: 45256 - DNA, 35 bp, Homo sapiens; identical to SEQ ID NO: 16262
  misc_feature 1..35: note = chr17:79096981-79097016
  misc_feature 1..35: note = hypo
  source 1..35: mol_type = genomic DNA

SEQ ID NO: 45257 - DNA, 48 bp, Homo sapiens
  misc_feature 1..48: note = chr17:79098155-79098203
  misc_feature 1..48: note = hypo
  source 1..48: mol_type = genomic DNA
cccctctgcctggcacggcccgacctacgctcccgtgaaggcagccaa

SEQ ID NO: 45258 - DNA, 47 bp, Homo sapiens
  misc_feature 1..47: note = chr17:79099761-79099808
  misc_feature 1..47: note = hypo
  source 1..47: mol_type = genomic DNA
ggcgtctggggctgacggggccacgtgtccttcgccacttcttccag

SEQ ID NO: 45259 - DNA, 75 bp, Homo sapiens
  misc_feature 1..75: note = chr17:79100184-79100259
  misc_feature 1..75: note = hypo
  source 1..75: mol_type = genomic DNA
tggcctagggcttcccggccgctggcccgcgcccgccctcacctgtgcacgaaattgttgcgatgaaggtgcagg

SEQ ID NO: 45260 - DNA, 120 bp, Homo sapiens
  misc_feature 1..120: note = chr17:79104885-79105005
  misc_feature 1..120: note = hypo
  source 1..120: mol_type = genomic DNA
gggcaaggagacctccgtgagtggcaggacgtacacgtcgggcccgttctgtgctgccgtggccggggagccctgcgccaggtcggctgcgtactcgtccccctccgcattctcaaactc

SEQ ID NO: 45261 - DNA, 30 bp, Homo sapiens; identical to SEQ ID NO: 16265
  misc_feature 1..30: note = chr17:79107633-79107663
  misc_feature 1..30: note = hypo
  source 1..30: mol_type = genomic DNA

SEQ ID NO: 45262 - DNA, 149 bp, Homo sapiens
  misc_feature 1..149: note = chr17:79158112-79158261
  misc_feature 1..149: note = hypo
  source 1..149: mol_type = genomic DNA
ctcctgatgcagccacgtggcccccttgcctcctcagccaggcgccaccttgccctggggcctttgcacctccagccctcagcctggcatgctcttccctagacatccggctgcaagacagactctctcttcttcgatgttttctgcaa

SEQ ID NO: 45263 - DNA, 125 bp, Homo sapiens
  misc_feature 1..125: note = chr17:79211706-79211831
  misc_feature 1..125: note = hypo
  source 1..125: mol_type = genomic DNA
cgtgactagctccatcgctccccgagaaccgactgatgtcgtgtgttttacgttcgcttagcgcagacgtacttatttgtttcatgcttacttactggcacaaagatgtacggtttatagggatg

SEQ ID NO: 45264 - DNA, 30 bp, Homo sapiens
  misc_feature 1..30: note = chr17:79226304-79226334
  misc_feature 1..30: note = hypo
  source 1..30: mol_type = genomic DNA
tgagtcgggcagaggcggcgccatctggcc

SEQ ID NO: 45265 - DNA, 17 bp, Homo sapiens
  misc_feature 1..17: note = chr17:79292579-79292596
  misc_feature 1..17: note = hypo
  source 1..17: mol_type = genomic DNA
ggccgggcatggtggcg

SEQ ID NO: 45266 - DNA, 30 bp, Homo sapiens
  misc_feature 1..30: note = chr17:79505417-79505447
  misc_feature 1..30: note = hypo
  source 1..30: mol_type = genomic DNA
ggccacaccgtggtccgcaggctccccgag

SEQ ID NO: 45267 - DNA, 30 bp, Homo sapiens
  misc_feature 1..30: note = chr17:79544264-79544294
  misc_feature 1..30: note = hypo
  source 1..30: mol_type = genomic DNA
tcactgtgtagtcctcgccagactgcctgt

SEQ ID NO: 45268 - DNA, 48 bp, Homo sapiens; identical to SEQ ID NO: 16267
  misc_feature 1..48: note = chr17:79609256-79609304
  misc_feature 1..48: note = hypo
  source 1..48: mol_type = genomic DNA

SEQ ID NO: 45269 - DNA, 161 bp, Homo sapiens
  misc_feature 1..161: note = chr17:79619136-79619297
  misc_feature 1..161: note = hypo
  source 1..161: mol_type = genomic DNA
tgagtggacactcctcggtgcgttgatgggagcgcggtgcctgtgtgcgcacacgagtgagtggacactcctcggtgcactgatgggagcgagatgcccgtgtgtgcgcatgtgtgagtggacactcctcggtgcattgtgccatggctgtccctgggtgg

SEQ ID NO: 45270 - DNA, 102 bp, Homo sapiens
  misc_feature 1..102: note = chr17:79626311-79626413
  misc_feature 1..102: note = hypo
  source 1..102: mol_type = genomic DNA
acctgggtgacagagcgagacctcaactctgaaatagtaaaataggccaggcatggtggctcatccctgtacttttggaggacgaggtggctggaccacctg

SEQ ID NO: 45271 - DNA, 30 bp, Homo sapiens
  misc_feature 1..30: note = chr17:79643888-79643918
  misc_feature 1..30: note = hypo
  source 1..30: mol_type = genomic DNA
gacactgtgtgccagcgaagtggggacctg

SEQ ID NO: 45272 - DNA, 145 bp, Homo sapiens
  misc_feature 1..145: note = chr17:79668589-79668734
  misc_feature 1..145: note = hypo
  source 1..145: mol_type = genomic DNA
cgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctg

SEQ ID NO: 45273 - DNA, 22 bp, Homo sapiens
  misc_feature 1..22: note = chr17:79695451-79695473
  misc_feature 1..22: note = hypo
  source 1..22: mol_type = genomic DNA
gagccaccgcacctggccagct

SEQ ID NO: 45274 - DNA, 329 bp, Homo sapiens
  misc_feature 1..329: note = chr17:79769364-79769693
  misc_feature 1..329: note = hypo
  source 1..329: mol_type = genomic DNA
gggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtg

SEQ ID NO: 45275 - DNA, 30 bp, Homo sapiens; identical to SEQ ID NO: 16269
  misc_feature 1..30: note = chr17:79774960-79774990
  misc_feature 1..30: note = hypo
  source 1..30: mol_type = genomic DNA

SEQ ID NO: 45276 - DNA, 30 bp, Homo sapiens; identical to SEQ ID NO: 16270
  misc_feature 1..30: note = chr17:79847763-79847793
  misc_feature 1..30: note = hypo
  source 1..30: mol_type = genomic DNA

SEQ ID NO: 45277 - DNA, 86 bp, Homo sapiens
  misc_feature 1..86: note = chr17:79870436-79870522
  misc_feature 1..86: note = hypo
  source 1..86: mol_type = genomic DNA
ccttcttcaccagcacgcaggggagtcgccagtgagaaaatgggatcctgccacctgccaaaaagggaaagcggcatcaggcgggc

SEQ ID NO: 45278 - DNA, 173 bp, Homo sapiens; identical to SEQ ID NO: 16272
  misc_feature 1..173: note = chr17:79874854-79875027
  misc_feature 1..173: note = hypo
  source 1..173: mol_type = genomic DNA

SEQ ID NO: 45279 - DNA, 195 bp, Homo sapiens
  misc_feature 1..195: note = chr17:79887606-79887801
  misc_feature 1..195: note = hypo
  source 1..195: mol_type = genomic DNA
gaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcag

SEQ ID NO: 45280 - DNA, 23 bp, Homo sapiens
  misc_feature 1..23: note = chr17:79913143-79913166
  misc_feature 1..23: note = hypo
  source 1..23: mol_type = genomic DNA
actgcgcccggcctacaagacct

SEQ ID NO: 45281 - DNA, 30 bp, Homo sapiens
  misc_feature 1..30: note = chr17:80163670-80163700
  misc_feature 1..30: note = hypo
  source 1..30: mol_type = genomic DNA
gcccagcatctccagcgctttatccatcac

SEQ ID NO: 45282 - DNA, 30 bp, Homo sapiens
  misc_feature 1..30: note = chr17:80201941-80201971
  misc_feature 1..30: note = hypo
  source 1..30: mol_type = genomic DNA
caggcatgtcaattacgggaggagggaggg

SEQ ID NO: 45283 - DNA, 44 bp, Homo sapiens
  misc_feature 1..44: note = chr17:80229940-80229984
  misc_feature 1..44: note = hypo
  source 1..44: mol_type = genomic DNA
caaacttgggccaggcgcggtggcttcccagcacttcgggaggc

SEQ ID NO: 45284 - DNA, 82 bp, Homo sapiens
  misc_feature 1..82: note = chr17:80251922-80252004
  misc_feature 1..82: note = hypo
  source 1..82: mol_type = genomic DNA
catggggggaatcctcgtaaggcaagaacgtgctgcacattctggggactgggacaggataagcacacgagtagatctaagt

SEQ ID NO: 45285 - DNA, 79 bp, Homo sapiens
  misc_feature 1..79: note = chr17:80254257-80254336
  misc_feature 1..79: note = hypo
  source 1..79: mol_type = genomic DNA
ctgcgggacagacccggcattcttcgttatccattcattcgttgacggacacttaggcgagttccgtaccttgattgca

SEQ ID NO: 45286 - DNA, 49 bp, Homo sapiens
  misc_feature 1..49: note = chr17:80281082-80281131
  misc_feature 1..49: note = hypo
  source 1..49: mol_type = genomic DNA
gaaggagacccagagcgcaggtgtgtcggggcagcgagggaaacatcta

SEQ ID NO: 45287 - DNA, 187 bp, Homo sapiens
  misc_feature 1..187: note = chr17:80289234-80289421
  misc_feature 1..187: note = hypo
  source 1..187: mol_type = genomic DNA
ggcagcaggtgtcagcgactttgggttgctgtgggaatttgctccgtttatcagaagaaaacgcaccctggcaacacaggcccctctcaggtcaccaggcacatctggtcacatctgagtctcagataaacaaccaatgatgtcctggtgaaagcttgtcccgtgggacactcgggacacacttata

SEQ ID NO: 45288 - DNA, 29 bp, Homo sapiens
  misc_feature 1..29: note = chr17:80294426-80294455
  misc_feature 1..29: note = hypo
  source 1..29: mol_type = genomic DNA
gctgggattacaggcgtgagccactgtgc

SEQ ID NO: 45289 - DNA, 135 bp, Homo sapiens
  misc_feature 1..135: note = chr17:80300182-80300317
  misc_feature 1..135: note = hypo
  source 1..135: mol_type = genomic DNA
acaattttggtggcccgtgtggggaacgttgtgtgctttggggggcccaagcctgcccatctggtttctgttgggcagggcgtaggttcacctgtgagttccagctgctcctggctgctgcgcctgtggctggaa

SEQ ID NO: 45290 - DNA, 151 bp, Homo sapiens
  misc_feature 1..151: note = chr17:80338743-80338894
  misc_feature 1..151: note = hypo
  source 1..151: mol_type = genomic DNA
cgtctccaaaaaaaaaagcagcagaaaggttattgaaagattattgaaagtatgacctagacacggtgagaaatgtgatttcaggagtcagaattccgatgcagaaaggacaactcaacaccaaatgcagaaaccgcgcaggatggagccc

SEQ ID NO: 45291 - DNA, 34 bp, Homo sapiens
  misc_feature 1..34: note = chr17:80448159-80448193
  misc_feature 1..34: note = hypo
  source 1..34: mol_type = genomic DNA
gggattggattaactcgagcgatggccttcccag

SEQ ID NO: 45292 - DNA, 180 bp, Homo sapiens
  misc_feature 1..180: note = chr17:80479355-80479535
  misc_feature 1..180: note = hypo
  source 1..180: mol_type = genomic DNA
ggaatttttaacgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttcaggccgggcgc

SEQ ID NO: 45293 - DNA, 209 bp, Homo sapiens
  misc_feature 1..209: note = chr17:80518148-80518357
  misc_feature 1..209: note = hypo
  source 1..209: mol_type = genomic DNA
cctggaattacaggcatgaaccactgcgcccggcccttctcgctgttatttaagggaagcggtctcactgtgtggcacaggctggtctcaaactatcctcctgtttggcttcccaaagtgctaggattacaggagtgggccaccgtgcccggccctcctcgctgttatttaagggaagcggtctcactgtgtggcgcaggctggctttg

SEQ ID NO: 45294 - DNA, 160 bp, Homo sapiens
  misc_feature 1..160: note = chr17:80654983-80655143
  misc_feature 1..160: note = hypo
  source 1..160: mol_type = genomic DNA
cctctgggtgctggtcgtgagcccaagcccatctcagctgctcccccaaactctgcccattcctcaccccgtcccctaagctgaggtgtggccgggcacctgagtcccaccccacgctccacagtctcaggccaccccctccagccgtgccacactccct

SEQ ID NO: 45295 - DNA, 16 bp, Homo sapiens
  misc_feature 1..16: note = chr17:80692834-80692850
  misc_feature 1..16: note = hypo
  source 1..16: mol_type = genomic DNA
gcgccactgcactgca

SEQ ID NO: 45296 - DNA, 30 bp, Homo sapiens
  misc_feature 1..30: note = chr17:80747022-80747052
  misc_feature 1..30: note = hypo
  source 1..30: mol_type = genomic DNA
agcatttgggtgaaacgaggtaccccaggc

SEQ ID NO: 45297 - DNA, 40 bp, Homo sapiens
  misc_feature 1..40: note = chr17:80772901-80772941
  misc_feature 1..40: note = hypo
  source 1..40: mol_type = genomic DNA
tgagtagctgaagcacggtcagctgcgtcaccaggctgtc

SEQ ID NO: 45298 - DNA, 1028 bp, Homo sapiens
  misc_feature 1..1028: note = chr17:80797692-80798720
  misc_feature 1..1028: note = hypo
  source 1..1028: mol_type = genomic DNA
aaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgg

SEQ ID NO: 45299 - DNA, 317 bp, Homo sapiens
  misc_feature 1..317: note = chr17:80832479-80832796
  misc_feature 1..317: note = hypo
  source 1..317: mol_type = genomic DNA
gtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaa

SEQ ID NO: 45300 - DNA, 30 bp, Homo sapiens
  misc_feature 1..30: note = chr17:80882906-80882936
  misc_feature 1..30: note = hypo
  source 1..30: mol_type = genomic DNA
ttccttctgaaaggccggctccagcaggtg

SEQ ID NO: 45301 - DNA, 50 bp, Homo sapiens
  misc_feature 1..50: note = chr17:80972320-80972370
  misc_feature 1..50: note = hypo
  source 1..50: mol_type = genomic DNA
agtacttacgctcgacgggtgctgaacggcagcctcgtgttgcagcctca

SEQ ID NO: 45302 - DNA, 267 bp, Homo sapiens
  misc_feature 1..267: note = chr17:81008618-81008885
  misc_feature 1..267: note = hypo
  source 1..267: mol_type = genomic DNA
caggtttttagggcacgtgtttggggtaagtgtgctgggcacacaggcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgaggttgtgtgggg

SEQ ID NO: 45303 - DNA, 166 bp, Homo sapiens
  misc_feature 1..166: note = chr17:81015300-81015466
  misc_feature 1..166: note = hypo
  source 1..166: mol_type = genomic DNA
ctcacctccaggggacggccccgcaagccggagctgccctcctgcacactcagcactcaaggtggatttggaggtgacctaagcccacagctctccaagtcttggggaaatctacagtggatggcaggtgcctgcggacgccgagtgggtgcggccccagttatgc

SEQ ID NO: 45304 - DNA, 30 bp, Homo sapiens
  misc_feature 1..30: note = chr17:81015900-81015930
  misc_feature 1..30: note = hypo
  source 1..30: mol_type = genomic DNA
cacatctggacagtgcgtgaagccagtcca

SEQ ID NO: 45305 - DNA, 30 bp, Homo sapiens
  misc_feature 1..30: note = chr17:81021226-81021256
  misc_feature 1..30: note = hypo
  source 1..30: mol_type = genomic DNA
ggcaggctgcgtgtccgggcagtcccagcc

SEQ ID NO: 45306 - DNA, 30 bp, Homo sapiens
  misc_feature 1..30: note = chr17:81024242-81024272
  misc_feature 1..30: note = hypo
  source 1..30: mol_type = genomic DNA
tgaagagctccagatcgcagacaccgtgcc

SEQ ID NO: 45307 - DNA, 30 bp, Homo sapiens
  misc_feature 1..30: note = chr17:81033487-81033517
  misc_feature 1..30: note = hypo
  source 1..30: mol_type = genomic DNA
ggcctgggagggaaacgggtggcaaatgac

SEQ ID NO: 45308 - DNA, 98 bp, Homo sapiens
  misc_feature 1..98: note = chr17:81043026-81043124
  misc_feature 1..98: note = hypo
  source 1..98: mol_type = genomic DNA
actgctggtaccagacggggacggcaggcccggccgggtgcagtgttttggcctggagcagggcggcctgttcgtggaggccacgccgcagcaggata

SEQ ID NO: 45309 - DNA, 32 bp, Homo sapiens
  misc_feature 1..32: note = chr17:81047925-81047957
  misc_feature 1..32: note = hypo
  source 1..32: mol_type = genomic DNA
gcttgcataccctcacgcgcccaggccccggg

SEQ ID NO: 45310 - DNA, 58 bp, Homo sapiens; identical to SEQ ID NO: 16285
  misc_feature 1..58: note = chr17:81048783-81048841
  misc_feature 1..58: note = hypo
  source 1..58: mol_type = genomic DNA

SEQ ID NO: 45311 - DNA, 147 bp, Homo sapiens
  misc_feature 1..147: note = chr17:81050193-81050340
  misc_feature 1..147: note = hypo
  source 1..147: mol_type = genomic DNA
cctccttttgggtgccgctgccgtcgcgacccagggaagtgggcagcagagctgtggggagtgtctgcccttcgaggaagctgggaaatgagggtggtcccggcgccgtgggccgtggaggtgggttgggggcgactctgggaggtg

SEQ ID NO: 45312 - DNA, 48 bp, Homo sapiens
  misc_feature 1..48: note = chr17:81050936-81050984
  misc_feature 1..48: note = hypo
  source 1..48: mol_type = genomic DNA
cgaggtgctcctagccgtctgcaccagcgacttcggtgagtgtctgct

SEQ ID NO: 45313 - DNA, 69 bp, Homo sapiens
  misc_feature 1..69: note = chr17:81062099-81062168
  misc_feature 1..69: note = hypo
  source 1..69: mol_type = genomic DNA
gagaggaaaggatcacgcgaccatgggtacgttggccacctgaaggttgagtcccgcagcctagagact

SEQ ID NO: 45314 - DNA, 55 bp, Homo sapiens
  misc_feature 1..55: note = chr17:81065766-81065821
  misc_feature 1..55: note = hypo
  source 1..55: mol_type = genomic DNA
tgcacgatccttcctcgctgcaggatccttcctcgctgcacgatcattcctggtt

SEQ ID NO: 45315 - DNA, 30 bp, Homo sapiens
  misc_feature 1..30: note = chr17:81068659-81068689
  misc_feature 1..30: note = hypo
  source 1..30: mol_type = genomic DNA
cagggctgacgggcgcgaaactgggagcgt

SEQ ID NO: 45316 - DNA, 82 bp, Homo sapiens
  misc_feature 1..82: note = chr17:81076347-81076429
  misc_feature 1..82: note = hypo
  source 1..82: mol_type = genomic DNA
ggcagatcctggagccgggaagggatttgggggagggcccctgacgccctgtgggctgaccgttccccggtgccactcagga

SEQ ID NO: 45317 - DNA, 23 bp, Homo sapiens
  misc_feature 1..23: note = chr17:81081890-81081913
  misc_feature 1..23: note = hypo
  source 1..23: mol_type = genomic DNA
gggcgacgctcagggcggccgtg

SEQ ID NO: 45318 - DNA, 38 bp, Homo sapiens
  misc_feature 1..38: note = chr17:81087525-81087563
  misc_feature 1..38: note = hypo
  source 1..38: mol_type = genomic DNA
tgttctcctgagggccgcgggtcccgactggctgtttg

SEQ ID NO: 45319 - DNA, 78 bp, Homo sapiens
  misc_feature 1..78: note = chr18:597381-597459
  misc_feature 1..78: note = hypo
  source 1..78: mol_type = genomic DNA
aggaggaggtagaggcggggagacacaccatccctgcaaaactactggcaaaaactaagcggagccgggtgtggtggc

SEQ ID NO: 45320 - DNA, 19 bp, Homo sapiens
  misc_feature 1..19: note = chr18:1522199-1522218
  misc_feature 1..19: note = hypo
  source 1..19: mol_type = genomic DNA
agaccggagctgttcctat

SEQ ID NO: 45321 - DNA, 41 bp, Homo sapiens; identical to SEQ ID NO: 16292
  misc_feature 1..41: note = chr18:2755837-2755878
  misc_feature 1..41: note = hypo
  source 1..41: mol_type = genomic DNA

SEQ ID NO: 45322 - DNA, 122 bp, Homo sapiens
  misc_feature 1..122: note = chr18:3616285-3616407
  misc_feature 1..122: note = hypo
  source 1..122: mol_type = genomic DNA
gatgtgtggatcattcgctgtctgacctgactactctatcactgtggcacagccctgggcgatgtgtacatgtacagccttgtttgtgtttgagaggtgagcccattcggtggtctgagggc

SEQ ID NO: 45323 - DNA, 86 bp, Homo sapiens
  misc_feature 1..86: note = chr18:3930506-3930592
  misc_feature 1..86: note = hypo
  source 1..86: mol_type = genomic DNA
ttgtgcggatctgagcgtgtcctgcaataggaagggtgccgggtcccagcctgaaggtacatgtactcagtcgctaccctggacgc

SEQ ID NO: 45324 - DNA, 50 bp, Homo sapiens
  misc_feature 1..50: note = chr18:5133182-5133232
  misc_feature 1..50: note = hypo
  source 1..50: mol_type = genomic DNA
cagctccaccaccaccgaccacgatggctgcgccccgggccgcgaggaag

SEQ ID NO: 45325 - DNA, 30 bp, Homo sapiens
  misc_feature 1..30: note = chr18:6929750-6929780
  misc_feature 1..30: note = hypo
  source 1..30: mol_type = genomic DNA
ccagccacactgtcccggcagacgctctca

SEQ ID NO: 45326 - DNA, 97 bp, Homo sapiens
  misc_feature 1..97: note = chr18:8570976-8571073
  misc_feature 1..97: note = hypo
  source 1..97: mol_type = genomic DNA
caatgtatgatttttttaaactcaacaatgtgcaggcattgctttcacatccattccctgcccgtgacggtccatccctgcccgtgatggacactgt

SEQ ID NO: 45327 - DNA, 30 bp, Homo sapiens
  misc_feature 1..30: note = chr18:8612252-8612282
  misc_feature 1..30: note = hypo
  source 1..30: mol_type = genomic DNA
cagagaaggcttcctcgtcattggaatgtt

SEQ ID NO: 45328 - DNA, 40 bp, Homo sapiens; identical to SEQ ID NO: 16294
  misc_feature 1..40: note = chr18:8845133-8845173
  misc_feature 1..40: note = hypo
  source 1..40: mol_type = genomic DNA

SEQ ID NO: 45329 - DNA, 30 bp, Homo sapiens
  misc_feature 1..30: note = chr18:9333406-9333436
  misc_feature 1..30: note = hypo
  source 1..30: mol_type = genomic DNA
ggtggtaggcatttacgatttaccagcata

SEQ ID NO: 45330 - DNA, 143 bp, Homo sapiens
  misc_feature 1..143: note = chr18:9364378-9364521
  misc_feature 1..143: note = hypo
  source 1..143: mol_type = genomic DNA
tcccatgagttccgacggtgaaagtctgatccctttgtgataaaggtccccatcagcctttcacctggtgatttcaccccttcttgatgaccattgcctgagtcagctacttcattagaagctgtaaaacagccaggtgtggt

SEQ ID NO: 45331 - DNA, 30 bp, Homo sapiens
  misc_feature 1..30: note = chr18:9547786-9547816
  misc_feature 1..30: note = hypo
  source 1..30: mol_type = genomic DNA
ctagtaggttgaggacgctgtgctcatggc

SEQ ID NO: 45332 - DNA, 30 bp, Homo sapiens
  misc_feature 1..30: note = chr18:9737972-9738002
  misc_feature 1..30: note = hypo
  source 1..30: mol_type = genomic DNA
aggcagccagccggccggcatttaaatgat

SEQ ID NO: 45333 - DNA, 76 bp, Homo sapiens
  misc_feature 1..76: note = chr18:9797320-9797396
  misc_feature 1..76: note = hypo
  source 1..76: mol_type = genomic DNA
aataagtcaattttgcgaatcgctggcttaatgtcagcgatgcttctgcttctcctgctggcggacgttccctgat

SEQ ID NO: 45334 - DNA, 534 bp, Homo sapiens
  misc_feature 1..534: note = chr18:10589046-10589580
  misc_feature 1..534: note = hypo
  source 1..534: mol_type = genomic DNA
gtttctcgtgtgctccgggagtgtgagccccagcttctgctttcactgaattctgctgccagccacgtccttgatactttgtgggtgatttatttcattggctcgctattacttggcagcggcggtggctcctcaagccagcgtgggctccaggtggccccgggccgggaggcgatggccccgggccaggaggcgtggccacggccgctcgccggcgtccgtccccaggaacggccagcactggggcagcggaggaggcagcggtggtggtggcaccgggtagaaggcggtggcactgggtagaaggcaccgccgccgcccgccgcgggaggcttccgcggagactcagggctgcagagccagcggaggctgaaggaagagaaaggtaattttcctactcgcatatattaatttcagtaaacagataaaacaattagtaaatcaaacatataaaacagaatttttaaagaaaataatctcccaaaatatataaaagtagaatagttaaaaaaacagaaccgaatattttaatgt

SEQ ID NO: 45335 - DNA, 30 bp, Homo sapiens
  misc_feature 1..30: note = chr18:10664802-10664832
  misc_feature 1..30: note = hypo
  source 1..30: mol_type = genomic DNA
ggatgagatcatgtacgtacagcacttagc

SEQ ID NO: 45336 - DNA, 36 bp, Homo sapiens
  misc_feature 1..36: note = chr18:10696324-10696360
  misc_feature 1..36: note = hypo
  source 1..36: mol_type = genomic DNA
attcatggcaggaagcgccatcgccatgggtcaggg

SEQ ID NO: 45337 - DNA, 30 bp, Homo sapiens
  misc_feature 1..30: note = chr18:10832633-10832663
  misc_feature 1..30: note = hypo
  source 1..30: mol_type = genomic DNA
taatgactgaacaaacgcaggaaagaacta

SEQ ID NO: 45338 - DNA, 25 bp, Homo sapiens
  misc_feature 1..25: note = chr18:10906877-10906902
  misc_feature 1..25: note = hypo
  source 1..25: mol_type = genomic DNA
tgtcttttgtcgccttcctgagccc

SEQ ID NO: 45339 - DNA, 86 bp, Homo sapiens
  misc_feature 1..86: note = chr18:11009583-11009669
  misc_feature 1..86: note = hypo
  source 1..86: mol_type = genomic DNA
ttctttggtatcatacgaagtaataatatatgtgggcactataaagataaatgtcttgttatgggttaaatcgtgtccccttcata

SEQ ID NO: 45340 - DNA, 17 bp, Homo sapiens
  misc_feature 1..17: note = chr18:11014809-11014826
  misc_feature 1..17: note = hypo
  source 1..17: mol_type = genomic DNA
tccggggccccctcatt

SEQ ID NO: 45341 - DNA, 30 bp, Homo sapiens
  misc_feature 1..30: note = chr18:11533320-11533350
  misc_feature 1..30: note = hypo
  source 1..30: mol_type = genomic DNA
ggagagggttgggggcgctatccggggctg

SEQ ID NO: 45342 - DNA, 30 bp, Homo sapiens; identical to SEQ ID NO: 16298
  misc_feature 1..30: note = chr18:11979044-11979074
  misc_feature 1..30: note = hypo
  source 1..30: mol_type = genomic DNA

SEQ ID NO: 45343 - DNA, 15 bp, Homo sapiens
  misc_feature 1..15: note = chr18:11979861-11979876
  misc_feature 1..15: note = hypo
  source 1..15: mol_type = genomic DNA
cggcctctgtcttaa

SEQ ID NO: 45344 - DNA, 30 bp, Homo sapiens
  misc_feature 1..30: note = chr18:11989410-11989440
  misc_feature 1..30: note = hypo
  source 1..30: mol_type = genomic DNA
cctacgtgagaaattcgaaaactcaacaac

SEQ ID NO: 45345 - DNA, 30 bp, Homo sapiens
  misc_feature 1..30: note = chr18:12076093-12076123
  misc_feature 1..30: note = hypo
  source 1..30: mol_type = genomic DNA
tggaattccaaagaccgtaatgaggaaaga

SEQ ID NO: 45346 - DNA, 120 bp, Homo sapiens
  misc_feature 1..120: note = chr18:12375353-12375473
  misc_feature 1..120: note = hypo
  source 1..120: mol_type = genomic DNA
cgccttggccccccgagttgctgggactatagtcataagtcactgagcccaggtaagaaaaaaaaaaaaaaaacaatttgtagaggccaggagctgtggctcaggtctgtaattccaaca

SEQ ID NO: 45347 - DNA, 38 bp, Homo sapiens
  misc_feature 1..38: note = chr18:12376123-12376161
  misc_feature 1..38: note = hypo
  source 1..38: mol_type = genomic DNA
cctatctccccttacagtgaagacgttgagctgactac

SEQ ID NO: 45348 - DNA, 30 bp, Homo sapiens; identical to SEQ ID NO: 16300
  misc_feature 1..30: note = chr18:12701811-12701841
  misc_feature 1..30: note = hypo
  source 1..30: mol_type = genomic DNA

SEQ ID NO: 45349 - DNA, 26 bp, Homo sapiens
  misc_feature 1..26: note = chr18:12949149-12949175
  misc_feature 1..26: note = hypo
  source 1..26: mol_type = genomic DNA
gccaccgcgcccggcctacaagcaga

SEQ ID NO: 45350 - DNA, 88 bp, Homo sapiens
  misc_feature 1..88: note = chr18:13231230-13231318
  misc_feature 1..88: note = hypo
  source 1..88: mol_type = genomic DNA
aagaggggtctggaccggttttgcttgagaagaaatggcagtggacacatggctcgtgtgaaaggtgggtgcacgcagacaggccaga

SEQ ID NO: 45351 - DNA, 30 bp, Homo sapiens
  misc_feature 1..30: note = chr18:13295972-13296002
  misc_feature 1..30: note = hypo
  source 1..30: mol_type = genomic DNA
gaagacctgaggctgcgaggcggggtgcct

SEQ ID NO: 45352 - DNA, 61 bp, Homo sapiens
  misc_feature 1..61: note = chr18:13319261-13319322
  misc_feature 1..61: note = hypo
  source 1..61: mol_type = genomic DNA
acggcgggtatgattcgtcccagttcacgggcgagtaacagaggtgcgcagtggcggggca

SEQ ID NO: 45353 - DNA, 30 bp, Homo sapiens
  misc_feature 1..30: note = chr18:13430352-13430382
  misc_feature 1..30: note = hypo
  source 1..30: mol_type = genomic DNA
atgcgaggttagtcccgatgagggtgtatt

SEQ ID NO: 45354 - DNA, 30 bp, Homo sapiens
  misc_feature 1..30: note = chr18:13452326-13452356
  misc_feature 1..30: note = hypo
  source 1..30: mol_type = genomic DNA
gcttggaggatgcagcgggtgcagactggg

SEQ ID NO: 45355 - DNA, 111 bp, Homo sapiens
  misc_feature 1..111: note = chr18:13452723-13452834
  misc_feature 1..111: note = hypo
  source 1..111: mol_type = genomic DNA
acaattccaccaggtcgcgtgtttactaattgctaagtgctttacttgagtcatctcatttaattgttagaacaaccatatgtgataagaactcatcggacccctccttag

SEQ ID NO: 45356 - DNA, 283 bp, Homo sapiens
  misc_feature 1..283: note = chr18:13461100-13461383
  misc_feature 1..283: note = hypo
  source 1..283: mol_type = genomic DNA
ccgtgggaactgaggcgggctggccttgtctccccagcgcctgctcacagaaggtgccccatgatgtctgtcgtgcagatgaatgtgtccacgcgtgctgggctagtacagaagatcggtaggcaggggtcttcgtggccagggcctgaggaggaccgatagccttggggactgcatgggttttgagagtctgggggaaccagggggaagtaggaggacatagtaaacaaaggtcaagaagagcgaggaagacgtggggatggggacacgtacctgactgagg

SEQ ID NO: 45357 - DNA, 32 bp, Homo sapiens
  misc_feature 1..32: note = chr18:13486501-13486533
  misc_feature 1..32: note = hypo
  source 1..32: mol_type = genomic DNA
ctccaccagggagaacgcggagcagcagagtc

SEQ ID NO: 45358 - DNA, 30 bp, Homo sapiens
  misc_feature 1..30: note = chr18:13486818-13486848
  misc_feature 1..30: note = hypo
  source 1..30: mol_type = genomic DNA
gaactcaagcagccccgcagagcccccttg

SEQ ID NO: 45359 - DNA, 85 bp, Homo sapiens
  misc_feature 1..85: note = chr18:13583740-13583825
  misc_feature 1..85: note = hypo
  source 1..85: mol_type = genomic DNA
gcctgcttgagtcaccgagccagggcgctgcggctccccactgctggcggagtcttattgttgtgtctctcgctttgcctttcac

SEQ ID NO: 45360 - DNA, 30 bp, Homo sapiens
  misc_feature 1..30: note = chr18:13603756-13603786
  misc_feature 1..30: note = hypo
  source 1..30: mol_type = genomic DNA
cgctgctgggtgccacgccaagtttcacag

SEQ ID NO: 45361 - DNA, 67 bp, Homo sapiens
  misc_feature 1..67: note = chr18:13621659-13621726
  misc_feature 1..67: note = hypo
  source 1..67: mol_type = genomic DNA
gtcctggaggtgctgcggggacaaatcacgcgctcatcgtcactaaacgtgccggcagcacatgggt

SEQ ID NO: 45362 - DNA, 237 bp, Homo sapiens
  misc_feature 1..237: note = chr18:13621998-13622235
  misc_feature 1..237: note = hypo
  source 1..237: mol_type = genomic DNA
gagcggtgagttcagcgagcgtataaatccttggcttccgtgatgggcagcgaggccgagtctccacagtgtggagccctgcggtatgctgagcacaggagccggtccttacggagcatccctcttcaggaacagggctgtgcagttccggctcccaccctgacttacagagcctgtccagggtatggggtgcagctgtccaggtgggtttcctggggtggccgctggccctgggac

SEQ ID NO: 45363 - DNA, 203 bp, Homo sapiens
  misc_feature 1..203: note = chr18:13826333-13826536
  misc_feature 1..203: note = hypo
  source 1..203: mol_type = genomic DNA
catctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatc

SEQ ID NO: 45364 - DNA, 180 bp, Homo sapiens
  misc_feature 1..180: note = chr18:13836794-13836974
  misc_feature 1..180: note = hypo
  source 1..180: mol_type = genomic DNA
agcgggcagactccccgccctgggctctgtcctgcccttcttgtgcctggcctctttctagggagccatggaaacagtgctcctaggatccgccctccagtcctgctctcagtgagaactcagcgcagggctccggacacgggcagacgccgcgctttgtcttcccgtcttcccctcacc

SEQ ID NO: 45365 - DNA, 59 bp, Homo sapiens; identical to SEQ ID NO: 16304
  misc_feature 1..59: note = chr18:13940522-13940581
  misc_feature 1..59: note = hypo
  source 1..59: mol_type = genomic DNA

SEQ ID NO: 45366 - DNA, 30 bp, Homo sapiens
  misc_feature 1..30: note = chr18:19243727-19243757
  misc_feature 1..30: note = hypo
  source 1..30: mol_type = genomic DNA
agttcagcttcagaacgcagctccagggat

SEQ ID NO: 45367 - DNA, 227 bp, Homo sapiens
  misc_feature 1..227: note = chr18:20911344-20911571
  misc_feature 1..227: note = hypo
  source 1..227: mol_type = genomic DNA
gtgaaacctgccccccgccaccacctgtagtacaggagacaccacaaagcaagaggccccagggctctgctcgggaagctgccgggcctgtttttcctcccagtggccaacaaacaggagggcaggttcagcacgttgggctctgctttctgagcgccgcaccattacagcatccacatccgatttttaaaactgaagtataacataaataccgtgtagtgtaggag

SEQ ID NO: 45368 - DNA, 25 bp, Homo sapiens
  misc_feature 1..25: note = chr18:21168944-21168969
  misc_feature 1..25: note = hypo
  source 1..25: mol_type = genomic DNA
gctcccagcccgcttttcttttcgg

SEQ ID NO: 45369 - DNA, 40 bp, Homo sapiens
  misc_feature 1..40: note = chr18:23841433-23841473
  misc_feature 1..40: note = hypo
  source 1..40: mol_type = genomic DNA
gattacaggcgtgagccactgcgcccggccagcactgtca

SEQ ID NO: 45370 - DNA, 30 bp, Homo sapiens
  misc_feature 1..30: note = chr18:24465773-24465803
  misc_feature 1..30: note = hypo
  source 1..30: mol_type = genomic DNA
tgtgtacagcacttgcgatattgagagtaa

SEQ ID NO: 45371 - DNA, 36 bp, Homo sapiens
  misc_feature 1..36: note = chr18:25089977-25090013
  misc_feature 1..36: note = hypo
  source 1..36: mol_type = genomic DNA
aggagccaagatggccgaataggaacagctctggtc

SEQ ID NO: 45372 - DNA, 30 bp, Homo sapiens
  misc_feature 1..30: note = chr18:43254053-43254083
  misc_feature 1..30: note = hypo
  source 1..30: mol_type = genomic DNA
ttacgtcttctacagcgattcaccttaagc

SEQ ID NO: 45373 - DNA, 45 bp, Homo sapiens
  misc_feature 1..45: note = chr18:44140380-44140425
  misc_feature 1..45: note = hypo
  source 1..45: mol_type = genomic DNA
gtgaggtccacctcccgcaccaccaggtgccgcagccacacggtg

SEQ ID NO: 45374 - DNA, 81 bp, Homo sapiens
  misc_feature 1..81: note = chr18:47344091-47344172
  misc_feature 1..81: note = hypo
  source 1..81: mol_type = genomic DNA
attgatacattggtacggttctaggccttgcattacttcttccgatttttcccttggggtgggctgtcggcatgctcagtg

SEQ ID NO: 45375 - DNA, 145 bp, Homo sapiens
  misc_feature 1..145: note = chr18:48493743-48493888
  misc_feature 1..145: note = hypo
  source 1..145: mol_type = genomic DNA
tgaccacctcaagtacgctgagcacgaaatcagtgcatctggcagtacacaggagcttgaaatactttttttaaaagttgttattcaaactgaaggagtttttccctgtggtctgtaatcgccacgtgcccgttctgtatacagc

SEQ ID NO: 45376 - DNA, 44 bp, Homo sapiens
  misc_feature 1..44: note = chr18:52627111-52627155
  misc_feature 1..44: note = hypo
  source 1..44: mol_type = genomic DNA
acattgggccaggtgcggtggctcacgccttggtaatctcagca

SEQ ID NO: 45377 - DNA, 103 bp, Homo sapiens
  misc_feature 1..103: note = chr18:52961793-52961896
  misc_feature 1..103: note = hypo
  source 1..103: mol_type = genomic DNA
tccataggtgttgtgcgtggggtgaacttctggccttgtaccaggaagaagatatcatatggagatgacccagatgtgaaaggtatcacgctgcaattccaca

SEQ ID NO: 45378 - DNA, 180 bp, Homo sapiens
  misc_feature 1..180: note = chr18:53074296-53074476
  misc_feature 1..180: note = hypo
  source 1..180: mol_type = genomic DNA
aagatggggttggtgcggggggcggggggagattctgaaatatataccagaaacaaatcttgtcaggcatttgattcatttttatacctaaaaggaccaaatgttaaattttgctgctggtgacgatttgccgtgcatgaaatgaatatgacctaatggagtacacgaagggctgaatga

SEQ ID NO: 45379 - DNA, 181 bp, Homo sapiens; identical to SEQ ID NO: 16306
  misc_feature 1..181: note = chr18:53968903-53969084
  misc_feature 1..181: note = hypo
  source 1..181: mol_type = genomic DNA

SEQ ID NO: 45380 - DNA, 47 bp, Homo sapiens
  misc_feature 1..47: note = chr18:54483265-54483312
  misc_feature 1..47: note = hypo
  source 1..47: mol_type = genomic DNA
agtcacatcagaagccgcgcagactatcaccacggctcctgatgcct

SEQ ID NO: 45381 - DNA, 72 bp, Homo sapiens; identical to SEQ ID NO: 5215
  misc_feature 1..72: note = chr18:55850845-55850917
  misc_feature 1..72: note = hypo
  source 1..72: mol_type = genomic DNA

SEQ ID NO: 45382 - DNA, 30 bp, Homo sapiens
  misc_feature 1..30: note = chr18:56483562-56483592
  misc_feature 1..30: note = hypo
  source 1..30: mol_type = genomic DNA
aagacaatttttccacggaccaggggtggg

SEQ ID NO: 45383 - DNA, 25 bp, Homo sapiens
  misc_feature 1..25: note = chr18:56483918-56483943
  misc_feature 1..25: note = hypo
  source 1..25: mol_type = genomic DNA
aagtttgaaattccccggccgggcg

SEQ ID NO: 45384 - DNA, 23 bp, Homo sapiens
  misc_feature 1..23: note = chr18:56816117-56816140
  misc_feature 1..23: note = hypo
  source 1..23: mol_type = genomic DNA
attacaggcgtgagccactgtgc

SEQ ID NO: 45385 - DNA, 170 bp, Homo sapiens
  misc_feature 1..170: note = chr18:57652629-57652799
  misc_feature 1..170: note = hypo
  source 1..170: mol_type = genomic DNA
gcgtgattgtgaccacgtaagtcatcatgggcatgttagctattaagatgatttaaaaatgatcacatcttagttcttgcaattttacactgaaattactataagtaagcttctcctcacgtggaagtcattagctttacctgtaaatatgattgcggcatctgcctatg

SEQ ID NO: 45386 - DNA, 30 bp, Homo sapiens
  misc_feature 1..30: note = chr18:59137607-59137637
  misc_feature 1..30: note = hypo
  source 1..30: mol_type = genomic DNA
aaaaaggaaaggaaccgataagcctgagct

SEQ ID NO: 45387 - DNA, 30 bp, Homo sapiens
  misc_feature 1..30: note = chr18:60056441-60056471
  misc_feature 1..30: note = hypo
  source 1..30: mol_type = genomic DNA
atgctctgctccaagcgccagaggaggctt

SEQ ID NO: 45388 - DNA, 30 bp, Homo sapiens
  misc_feature 1..30: note = chr18:60557827-60557857
  misc_feature 1..30: note = hypo
  source 1..30: mol_type = genomic DNA
attttcctcattcagcgtattgctgctttc

SEQ ID NO: 45389 - DNA, 27 bp, Homo sapiens
  misc_feature 1..27: note = chr18:60759984-60760011
  misc_feature 1..27: note = hypo
  source 1..27: mol_type = genomic DNA
acagctgccccccatcgctcacatgac

SEQ ID NO: 45390 - DNA, 31 bp, Homo sapiens
  misc_feature 1..31: note = chr18:62165289-62165320
  misc_feature 1..31: note = hypo
  source 1..31: mol_type = genomic DNA
atcaccattgaggcccggcgcattggctcac

SEQ ID NO: 45391 - DNA, 35 bp, Homo sapiens
  misc_feature 1..35: note = chr18:68051409-68051444
  misc_feature 1..35: note = hypo
  source 1..35: mol_type = genomic DNA
gatgtggggagtctctgggccgatgcatgtaaagc

SEQ ID NO: 45392 - DNA, 19 bp, Homo sapiens
  misc_feature 1..19: note = chr18:68699219-68699238
  misc_feature 1..19: note = hypo
  source 1..19: mol_type = genomic DNA
ccaccggccgctcccagtg

SEQ ID NO: 45393 - DNA, 17 bp, Homo sapiens
  misc_feature 1..17: note = chr18:72263664-72263681
  misc_feature 1..17: note = hypo
  source 1..17: mol_type = genomic DNA
atgatttttttgagacg

SEQ ID NO: 45394 - DNA, 17 bp, Homo sapiens
  misc_feature 1..17: note = chr18:72263921-72263938
  misc_feature 1..17: note = hypo
  source 1..17: mol_type = genomic DNA
ggcgtaagccaccccgc

SEQ ID NO: 45395 - DNA, 30 bp, Homo sapiens
  misc_feature 1..30: note = chr18:72347499-72347529
  misc_feature 1..30: note = hypo
  source 1..30: mol_type = genomic DNA
catgaggaattgctgcgggaggtgaataag

SEQ ID NO: 45396 - DNA, 45 bp, Homo sapiens
  misc_feature 1..45: note = chr18:72896219-72896264
  misc_feature 1..45: note = hypo
  source 1..45: mol_type = genomic DNA
aggggaggttgaggacgtccctgcactccccgccctgtaagcatc

SEQ ID NO: 45397 - DNA, 41 bp, Homo sapiens
  misc_feature 1..41: note = chr18:74062274-74062315
  misc_feature 1..41: note = hypo
  source 1..41: mol_type = genomic DNA
gacagctggggccaccgccttcccggcgcaaggtgggccag

SEQ ID NO: 45398 - DNA, 88 bp, Homo sapiens
  misc_feature 1..88: note = chr18:74107215-74107303
  misc_feature 1..88: note = hypo
  source 1..88: mol_type = genomic DNA
cacaaggctgcaccccgtcctaaacgagcatctcccagacaccaagaaagcaaaccttgtttcacagctttatcgccactatctagcg

SEQ ID NO: 45399 - DNA, 38 bp, Homo sapiens
  misc_feature 1..38: note = chr18:74113912-74113950
  misc_feature 1..38: note = hypo
  source 1..38: mol_type = genomic DNA
ctgcacatgcatgtgcgtgcctatgtgcatgtgtgtac

SEQ ID NO: 45400 - DNA, 158 bp, Homo sapiens
  misc_feature 1..158: note = chr18:74114010-74114168
  misc_feature 1..158: note = hypo
  source 1..158: mol_type = genomic DNA
tggtctctgcatcccacagggaggggagggcttctctgaaaagaaattgtatatgcacaagccttagccccgcgccttctatttgctgaagacatcgcctcggtcaacaccaatgaattcatttactctgtgaatacaaatcccgccagtggccacaa

SEQ ID NO: 45401 - DNA, 37 bp, Homo sapiens
  misc_feature 1..37: note = chr18:74396499-74396536
  misc_feature 1..37: note = hypo
  source 1..37: mol_type = genomic DNA
tcaggtgattgactccgtgcagcgatctccacgggtc

SEQ ID NO: 45402 - DNA, 30 bp, Homo sapiens
  misc_feature 1..30: note = chr18:74497491-74497521
  misc_feature 1..30: note = hypo
  source 1..30: mol_type = genomic DNA
agatgccactccacacgtatgagagtggct

SEQ ID NO: 45403 - DNA, 76 bp, Homo sapiens
  misc_feature 1..76: note = chr18:74501216-74501292
  misc_feature 1..76: note = hypo
  source 1..76: mol_type = genomic DNA
ctctcccgccctacacggagatgagaaaaaggttgatagaataaattacattaggccgggtgaggtggctcacgcc

SEQ ID NO: 45404 - DNA, 30 bp, Homo sapiens
  misc_feature 1..30: note = chr18:74504480-74504510
  misc_feature 1..30: note = hypo
  source 1..30: mol_type = genomic DNA
agtcctgggggtgggcgaggagagcacact

SEQ ID NO: 45405 - DNA, 30 bp, Homo sapiens
  misc_feature 1..30: note = chr18:74695927-74695957
  misc_feature 1..30: note = hypo
  source 1..30: mol_type = genomic DNA
ggatgaaaatgcaaacgcaggtgcctgggg

SEQ ID NO: 45406 - DNA, 30 bp, Homo sapiens
  misc_feature 1..30: note = chr18:74755472-74755502
  misc_feature 1..30: note = hypo
  source 1..30: mol_type = genomic DNA
ctgctgcaggcaccccggggacctgctggt

SEQ ID NO: 45407 - DNA, 32 bp, Homo sapiens
  misc_feature 1..32: note = chr18:74877184-74877216
  misc_feature 1..32: note = hypo
  source 1..32: mol_type = genomic DNA
atgccgtgaggattgcgcgagctcatattctg

SEQ ID NO: 45408 - DNA, 143 bp, Homo sapiens; identical to SEQ ID NO: 16311
  misc_feature 1..143: note = chr18:75229713-75229856
  misc_feature 1..143: note = hypo
  source 1..143: mol_type = genomic DNA

SEQ ID NO: 45409 - DNA, 176 bp, Homo sapiens
  misc_feature 1..176: note = chr18:75230687-75230863
  misc_feature 1..176: note = hypo
  source 1..176: mol_type = genomic DNA
aactgaagtctagctcgtgcttctgaaatgacgcataaataattcaagcttgagagggaagaactggccacactttggaggcgccgagctggggaacctggtgtccgaagccaagctctgctcgggcccaggaggacgcagggacatcgcactgtcccccacgcctggcctgtgct

SEQ ID NO: 45410 - DNA, 46 bp, Homo sapiens
  misc_feature 1..46: note = chr18:75617810-75617856
  misc_feature 1..46: note = hypo
  source 1..46: mol_type = genomic DNA
cacaaaccacctgctcgctgctgcccagcgccgcctgggcactcct

SEQ ID NO: 45411 - DNA, 30 bp, Homo sapiens
  misc_feature 1..30: note = chr18:75631688-75631718
  misc_feature 1..30: note = hypo
  source 1..30: mol_type = genomic DNA
ttcttgcgcaaactccgtgttcatgtagag

SEQ ID NO: 45412 - DNA, 395 bp, Homo sapiens
  misc_feature 1..395: note = chr18:75998625-75999020
  misc_feature 1..395: note = hypo
  source 1..395: mol_type = genomic DNA
cgtggtgtgtgtgtgtgtcgtgtgtcgtgtggcgtgtgccgtgcgtgtgcgcaccgtgggcgggaggcgagaggaagcgcagtgggagccgcgggcaggcggtcgcagaggggcctggggaggcgaagcagcccgggtgggggcgttcgctggaaacggggcccctctgaagggcgtgggcagccggtgcctgcagagcgtggagagctgcggccgcctcacctgacacaattgggcagcgatttctcaggtccaaagagcggaccccgtgggcactttcctgacggaggactcggctcctgggagctccggcaacatcagcgacagtggagcccggtctcaaaagaccgacccggcggcctgagaagaaggaaggaggccgaggcgccgcaggg

SEQ ID NO: 45413 - DNA, 93 bp, Homo sapiens
  misc_feature 1..93: note = chr18:76073259-76073352
  misc_feature 1..93: note = hypo
  source 1..93: mol_type = genomic DNA
ccaggctcctggggacggcgtgtgtcctggctccaccctctgctggcggtgagaccatgcacaccgcaaaaccatggacgtcacaagaccacg

SEQ ID NO: 45414 - DNA, 174 bp, Homo sapiens
  misc_feature 1..174: note = chr18:76123720-76123894
  misc_feature 1..174: note = hypo
  source 1..174: mol_type = genomic DNA
ggggcgcacaccctccgggatgaagacggcacgcctgctgcgcacggtggctgtgctgtgctttccagagacaccaaagatccagcaagccccggtttgtgtcgagtgtcacgggaatggagatgccttaaggctccggcttggacggcctgttgttcgcgtgctgagtgcact

SEQ ID NO: 45415 - DNA, 172 bp, Homo sapiens
  misc_feature 1..172: note = chr18:76161408-76161580
  misc_feature 1..172: note = hypo
  source 1..172: mol_type = genomic DNA
tgttcgcggcgttcccgctaaaaccagaaaaaaaaaaaaaaaggagatgaagaagatggagcctggggcaagggagcttgcttggagaatattttccatggaagccaagggagcatccctctcccttttggaggcacgtcgaggccaattgacttgacgatgatttgctgtt

SEQ ID NO: 45416 - DNA, 49 bp, Homo sapiens
  misc_feature 1..49: note = chr18:76189823-76189872
  misc_feature 1..49: note = hypo
  source 1..49: mol_type = genomic DNA
gcgctgggaccccagcgaggcgacccggggccaccgggcaggcccaaga

SEQ ID NO: 45417 - DNA, 141 bp, Homo sapiens
  misc_feature 1..141: note = chr18:76239475-76239616
  misc_feature 1..141: note = hypo
  source 1..141: mol_type = genomic DNA
gggttaaccagagtccggagtcagagaaataatttggtgtttcagggtcgcctgctgcagggcaatctccacacctgactgcggggtcacctgctgctgggcaatctccacacctgactgcggggtcgcctgctgcagggc

SEQ ID NO: 45418 - DNA, 43 bp, Homo sapiens
  misc_feature 1..43: note = chr18:76412736-76412779
  misc_feature 1..43: note = hypo
  source 1..43: mol_type = genomic DNA
gactttcctgggttgcgcactgaaagtcccagtcccaggaaac

SEQ ID NO: 45419 - DNA, 94 bp, Homo sapiens
  misc_feature 1..94: note = chr18:76415372-76415466
  misc_feature 1..94: note = hypo
  source 1..94: mol_type = genomic DNA
gggaaccccctcagtcccaggaaacccctcagtcccaggcaaatggtggagagcagggcaggtgtgttttgggtgccaccgtgggggatggggc

SEQ ID NO: 45420 - DNA, 158 bp, Homo sapiens
  misc_feature 1..158: note = chr18:76477472-76477630
  misc_feature 1..158: note = hypo
  source 1..158: mol_type = genomic DNA
tcccaagcccatgaccgataccctgggtctccacctcctgggcccatgaccgacaccgagggtctgcacctccagagcccatgaccgacgctgcgggtctccacctcccgagcccatgaccgacaccgcgggtctgcacctcccgagcctatgactga

SEQ ID NO: 45421 - DNA, 74 bp, Homo sapiens
  misc_feature 1..74: note = chr18:76486799-76486873
  misc_feature 1..74: note = hypo
  source 1..74: mol_type = genomic DNA
acgtggagactccctcggagacctctgcgcacatggagacccgcgcgcacgtggagactcgcgcgcaaaaggag

SEQ ID NO: 45422 - DNA, 215 bp, Homo sapiens
  misc_feature 1..215: note = chr18:76501459-76501674
  misc_feature 1..215: note = hypo
  source 1..215: mol_type = genomic DNA
agagctcaggaagtgcggctctcagtctatggatccgctggacgacccatccgctgttctcaactcaccgaatgacagtaaaatcaaagccttgtatcatattcagaagattcagcgccaagactcagcatgtggcggtgtcttctttaggacgcagcagtgcgatggagaaggtagagggtaactctggcagggtgcatcggtaaccagcaaga

SEQ ID NO: 45423 - DNA, 36 bp, Homo sapiens
  misc_feature 1..36: note = chr18:76540366-76540402
  misc_feature 1..36: note = hypo
  source 1..36: mol_type = genomic DNA
gtccgaggccaggcacggtgtcgggtggccctggcc

SEQ ID NO: 45424 - DNA, 36 bp, Homo sapiens
  misc_feature 1..36: note = chr18:76541554-76541590
  misc_feature 1..36: note = hypo
  source 1..36: mol_type = genomic DNA
gtcctctgggtgaggcggagccgctcctgaaggatc

SEQ ID NO: 45425 - DNA, 33 bp, Homo sapiens
  misc_feature 1..33: note = chr18:76564667-76564700
  misc_feature 1..33: note = hypo
  source 1..33: mol_type = genomic DNA
ctgcagggggctggccgccggcctgacgaggct

SEQ ID NO: 45426 - DNA, 16 bp, Homo sapiens
  misc_feature 1..16: note = chr18:76571588-76571604
  misc_feature 1..16: note = hypo
  source 1..16: mol_type = genomic DNA
ccgctcatctcctgct

SEQ ID NO: 45427 - DNA, 159 bp, Homo sapiens
  misc_feature 1..159: note = chr18:76626246-76626405
  misc_feature 1..159: note = hypo
  source 1..159: mol_type = genomic DNA
cataaaggacagccgcggctgaacatgccaagctggctagagggagggtgacagccgcagccgaacctcagagctggctagagggagggtgacagccgcggacaaacctgcagacctggctagagggagggtgacagccgcggccgaacctgcagtgct

SEQ ID NO: 45428 - DNA, 30 bp, Homo sapiens; identical to SEQ ID NO: 16321
  misc_feature 1..30: note = chr18:76686197-76686227
  misc_feature 1..30: note = hypo
  source 1..30: mol_type = genomic DNA

SEQ ID NO: 45429 - DNA, 98 bp, Homo sapiens
  misc_feature 1..98: note = chr18:77167756-77167854
  misc_feature 1..98: note = hypo
  source 1..98: mol_type = genomic DNA
tattgacattactgttctctctccggtgcaggagactgcgtggctcccgtcctcttgagggcatttctttacgatggggaaggcgggactggggcctg

SEQ ID NO: 45430 - DNA, 53 bp, Homo sapiens
  misc_feature 1..53: note = chr18:77176557-77176610
  misc_feature 1..53: note = hypo
  source 1..53: mol_type = genomic DNA
gtgtaaggtggtagccgtggggtcttccccgagcttcccgctgccatcacctc

SEQ ID NO: 45431 - DNA, 157 bp, Homo sapiens
  misc_feature 1..157: note = chr18:77181269-77181426
  misc_feature 1..157: note = hypo
  source 1..157: mol_type = genomic DNA
actgttcccagaactcgagggttccctgacaccaagatgacatgtggcacagacctggaatcacgaggaaatgcccgtcctcctcccacgggcagacaggtcgagtgtgtttccagagaccgggccgtccgtggggcagtagcgcctggatgacgtc

SEQ ID NO: 45432 - DNA, 30 bp, Homo sapiens
  misc_feature 1..30: note = chr18:77181779-77181809
  misc_feature 1..30: note = hypo
  source 1..30: mol_type = genomic DNA
agctcttggcagtgccgccaccatgggctg

SEQ ID NO: 45433 - DNA, 30 bp, Homo sapiens; identical to SEQ ID NO: 16324
  misc_feature 1..30: note = chr18:77194948-77194978
  misc_feature 1..30: note = hypo
  source 1..30: mol_type = genomic DNA

SEQ ID NO: 45434 - DNA, 290 bp, Homo sapiens
  misc_feature 1..290: note = chr18:77201979-77202269
  misc_feature 1..290: note = hypo
  source 1..290: mol_type = genomic DNA
cccctgcaccctccacgtcagtgccctggctccgtggccctgtcggtgctctggtgagtctggggttcgtgccgagcgccattgcctccaggtcgaggtgggaagcgcgctggtggggcaaggtggtccctgcatggcacaggttgggagagcagccgggagggcagcgggccgaggcggtgggggagggcaccagttctccacggcaagcacggcctctggggctgctcttccggagagacgtggagacccgcgtgcacgtgtggagactggcacgtgtgaggggccca

SEQ ID NO: 45435 - DNA, 40 bp, Homo sapiens
  misc_feature 1..40: note = chr18:77203641-77203681
  misc_feature 1..40: note = hypo
  source 1..40: mol_type = genomic DNA
gcccagcctctgcctcggttcctgccgggcacatggacgc

SEQ ID NO: 45436 - DNA, 167 bp, Homo sapiens
  misc_feature 1..167: note = chr18:77209978-77210145
  misc_feature 1..167: note = hypo
  source 1..167: mol_type = genomic DNA
tccctgagtttgcctcgagagctgtaatccaagtttcccgcagacagggcacagtcaggtgcgttccacagccgtagtaaacgtcctggcttcgctggcggctgcgttcaccccaccatgatgtggggcagaaagggtggccgggagacgcccgcagccaggaccgc

SEQ ID NO: 45437 - DNA, 63 bp, Homo sapiens
  misc_feature 1..63: note = chr18:77229435-77229498
  misc_feature 1..63: note = hypo
  source 1..63: mol_type = genomic DNA
ggcggcccccaggaccgtggccacagcatgaagccggtggggctgagccgctcctgctacctc

SEQ ID NO: 45438 - DNA, 30 bp, Homo sapiens
  misc_feature 1..30: note = chr18:77230030-77230060
  misc_feature 1..30: note = hypo
  source 1..30: mol_type = genomic DNA
tccgtcccgcgtgcccgctgcacttcctgc

SEQ ID NO: 45439 - DNA, 59 bp, Homo sapiens
  misc_feature 1..59: note = chr18:77236179-77236238
  misc_feature 1..59: note = hypo
  source 1..59: mol_type = genomic DNA
gcgccctgagcttggcgacgccagccgcgcgcctgggagggatccgcctgtccacgtgc

SEQ ID NO: 45440 - DNA, 135 bp, Homo sapiens
  misc_feature 1..135: note = chr18:77236516-77236651
  misc_feature 1..135: note = hypo
  source 1..135: mol_type = genomic DNA
acttgcgcttcccctcgctgccgtgctgtcctggccccgtcgctgccacctgagacccccatcaagtacctgagctctgcgtctgttttcacgcttctgtatgtgtaggaagccccccaccgatgttgctcgggg

SEQ ID NO: 45441 - DNA, 91 bp, Homo sapiens
  misc_feature 1..91: note = chr18:77246511-77246602
  misc_feature 1..91: note = hypo
  source 1..91: mol_type = genomic DNA
gtcacctcggactcccgcagccggccggagaggcccccgccgtccaggacgtgcccaggccagtggccacgcaccccggctcgcccgggca

SEQ ID NO: 45442 - DNA, 38 bp, Homo sapiens
  misc_feature 1..38: note = chr18:77247301-77247339
  misc_feature 1..38: note = hypo
  source 1..38: mol_type = genomic DNA
accggcctctgcagtcggggcatcgtgggtgccgcctg

SEQ ID NO: 45443 - DNA, 38 bp, Homo sapiens
  misc_feature 1..38: note = chr18:77271051-77271089
  misc_feature 1..38: note = hypo
  source 1..38: mol_type = genomic DNA
gccctgggccagccccgctgattcgatttagagctaac

SEQ ID NO: 45444 - DNA, 78 bp, Homo sapiens
  misc_feature 1..78: note = chr18:77272049-77272127
  misc_feature 1..78: note = hypo
  source 1..78: mol_type = genomic DNA
atggctccttgtctccggcccaagcgacccctggcatggcggacagagaggcccaggaggagccggcctcagggagga

SEQ ID NO: 45445 - DNA, 39 bp, Homo sapiens
  misc_feature 1..39: note = chr18:77272999-77273038
  misc_feature 1..39: note = hypo
  source 1..39: mol_type = genomic DNA
cctggcagagaatttcgctagagacgcagggagttgtat

SEQ ID NO: 45446 - DNA, 244 bp, Homo sapiens
  misc_feature 1..244: note = chr18:77285870-77286114
  misc_feature 1..244: note = hypo
  source 1..244: mol_type = genomic DNA
gcaaggctgaaccagcgcagtgggaaaggagttaactggtctcgaattctggggcatccctgtctcgtgccacagatgccaagcacagcagggcacggagctcctgggggccgctgcactcagcagcacagtgggcgggaggccgctgagcaaccagcagcctagggcatttgggtggggacgtgcgacccccacacagaacagagccgtctttctctctgcgttgtgccgaggccccgcagcg

SEQ ID NO: 45447 - DNA, 55 bp, Homo sapiens
  misc_feature 1..55: note = chr18:77288237-77288292
  misc_feature 1..55: note = hypo
  source 1..55: mol_type = genomic DNA
tcatagtcgcatgctcgcatctttgtttttaatctggcttcgaacatagcacaag

SEQ ID NO: 45448 - DNA, 30 bp, Homo sapiens
  misc_feature 1..30: note = chr18:77290969-77290999
  misc_feature 1..30: note = hypo
  source 1..30: mol_type = genomic DNA
ctggcaagggcatctcgttatatggacagc

SEQ ID NO: 45449 - DNA, 48 bp, Homo sapiens
  misc_feature 1..48: note = chr18:77308327-77308375
  misc_feature 1..48: note = hypo
  source 1..48: mol_type = genomic DNA
tgcccggcaggaccacgagacgtccgctgagcacgatgtctacctggc

SEQ ID NO: 45450 - DNA, 84 bp, Homo sapiens
  misc_feature 1..84: note = chr18:77313917-77314001
  misc_feature 1..84: note = hypo
  source 1..84: mol_type = genomic DNA
tggctgattgtggcacgcgtgccttccgagcccagatgtcccttcctgacacgccggcagcagccaccgcggattgttggcctc

SEQ ID NO: 45451 - DNA, 188 bp, Homo sapiens
  misc_feature 1..188: note = chr18:77320324-77320512
  misc_feature 1..188: note = hypo
  source 1..188: mol_type = genomic DNA
cacgtatgatcatcccgggaccacattctcacagcaaggagagggaagaacacaatattccctgccgagaataagatgcctcttcatgatggcaagcctggtaacttggcaattaatcctcggtgccaggaatcctcatgccgagagggacagatgctcctttgtttggctcccggcactcagtcgac

SEQ ID NO: 45452 - DNA, 290 bp, Homo sapiens
  misc_feature 1..290: note = chr18:77329727-77330017
  misc_feature 1..290: note = hypo
  source 1..290: mol_type = genomic DNA
cagtacaacaggacacgctctcaccttcaccatctgggtacagcaagacacgccctcacctttaccgtctcagtacagcaggacacactctcaccttcaccgtctcagcgcagcgggacacgccatcaccttcaccgtctgagtgcagcaggacacgccctcaccttcaccgtctcagtacagcaggacacactctcaccttcactgtctcagtatagcggtccacgccctcaccttcaccgtctcagtacagccaaacacgccctcaccttcaccgtctcagtacagca

SEQ ID NO: 45453 - DNA, 100 bp, Homo sapiens
  misc_feature 1..100: note = chr18:77357908-77358008
  misc_feature 1..100: note = hypo
  source 1..100: mol_type = genomic DNA
cagtgaacccagcatcgcctccatggcctgtcatcatcgggactctgccgcaagtgaagacgtgcttgtgtcccagggtacaagccgccaaagccccaga

SEQ ID NO: 45454 - DNA, 261 bp, Homo sapiens
  misc_feature 1..261: note = chr18:77364366-77364627
  misc_feature 1..261: note = hypo
  source 1..261: mol_type = genomic DNA
aaactaaggtgcctccgaaggctccaggggaggatccttcctgcgtcttccagtgtccccaggcgttccgggcttgtggctgcgtcattctgccctctgccccctgggcacgcagctgactcccctgtatgggcccatctctccgaattcacatgaccgtccttcggtaaagacaccagcaccagtccctgactccgggccttccctaacccagtgtggcctcatcttaactaaagatgtctgcatcgaccctatttccaa

SEQ ID NO: 45455 - DNA, 77 bp, Homo sapiens
  misc_feature 1..77: note = chr18:77365747-77365824
  misc_feature 1..77: note = hypo
  source 1..77: mol_type = genomic DNA
ccagtctgcgttccccgccaggtctacgttccccgccaggtctgcgttccctgccaggtctacgttccctgccaggt

SEQ ID NO: 45456 - DNA, 30 bp, Homo sapiens; identical to SEQ ID NO: 16334
  misc_feature 1..30: note = chr18:77410108-77410138
  misc_feature 1..30: note = hypo
  source 1..30: mol_type = genomic DNA

SEQ ID NO: 45457 - DNA, 80 bp, Homo sapiens
  misc_feature 1..80: note = chr18:77509599-77509679
  misc_feature 1..80: note = hypo
  source 1..80: mol_type = genomic DNA
tgactgccccctccccgaggtcagcgccatgcactgctctgggggcctgaaacaccgcctctgttcgcaagggtctcctg

SEQ ID NO: 45458 - DNA, 69 bp, Homo sapiens
  misc_feature 1..69: note = chr18:77533378-77533447
  misc_feature 1..69: note = hypo
  source 1..69: mol_type = genomic DNA
ctgcaggcgacatcacgtgtaaaacgcattcgtttttggttttgatgaacccttcggctgtccttttcc

SEQ ID NO: 45459 - DNA, 30 bp, Homo sapiens
  misc_feature 1..30: note = chr18:77534970-77535000
  misc_feature 1..30: note = hypo
  source 1..30: mol_type = genomic DNA
cgtcgcatgatctcacgcgtggagtcaaca

SEQ ID NO: 45460 - DNA, 46 bp, Homo sapiens
  misc_feature 1..46: note = chr18:77542905-77542951
  misc_feature 1..46: note = hypo
  source 1..46: mol_type = genomic DNA
tcccctttcaaaacacgtacagcgaatgactcgggcttcagagcca

SEQ ID NO: 45461 - DNA, 141 bp, Homo sapiens
  misc_feature 1..141: note = chr18:77543230-77543371
  misc_feature 1..141: note = hypo
  source 1..141: mol_type = genomic DNA
catccccgtgagctccgcctggccctgctgctcccgcccggaaagctcagacccataacccagcccacttggcagcagcgtgccgcctgatcggcaaggtttactccctttgaaaatctctgttgggtggccgggcgcggt

SEQ ID NO: 45462 - DNA, 60 bp, Homo sapiens
  misc_feature 1..60: note = chr18:77543700-77543760
  misc_feature 1..60: note = hypo
  source 1..60: mol_type = genomic DNA
ttgggcacatctaaacgcacccaagcttcctaccgcacgtctctgcgaggagccgggtct

SEQ ID NO: 45463 - DNA, 80 bp, Homo sapiens
  misc_feature 1..80: note = chr18:77544682-77544762
  misc_feature 1..80: note = hypo
  source 1..80: mol_type = genomic DNA
ggtgtggatgacagacgcagccctgcccttggctgctgtgcacgccatgcctccctgcgtggtcacgcctgtcacctgtc

SEQ ID NO: 45464 - DNA, 334 bp, Homo sapiens
  misc_feature 1..334: note = chr18:77550096-77550430
  misc_feature 1..334: note = hypo
  source 1..334: mol_type = genomic DNA
gttcaccctgggccccggagactagtgatcccgctccccagcagagcaccgccaaaagccccgggtgccggagctgtcctgcaagaatgaacgggcaggagacacaagagcgtggcggggccttccgaggatgcggtgcaagggcgctgttagcacccacgcgaggcggcagcgcatggaggaagcctcccatcgtaagcgcgtttctgcctgaaatgcacgtgtccttataggcagcggtcttgccactcatggacggagaggcagcatatgtttaaaagatgagcacacaaaggactgtgcacctgccgcggagtggcgtcctctgggagaa

SEQ ID NO: 45465 - DNA, 177 bp, Homo sapiens
  misc_feature 1..177: note = chr18:77577013-77577190
  misc_feature 1..177: note = hypo
  source 1..177: mol_type = genomic DNA
gccacacggttgtcacgcagctgccacatggatgttacacggctgtcatacagctgtcacacggctgccactcacatgcctgtcacgtttgtcacacggctgccacatggctgtcacgcagctgccacatggatgttacacggctgtcatacagctgtcacacggctgccactcaca

SEQ ID NO: 45466 - DNA, 30 bp, Homo sapiens
  misc_feature 1..30: note = chr18:77609629-77609659
  misc_feature 1..30: note = hypo
  source 1..30: mol_type = genomic DNA
agggcccagcgcggacgcttgcctttctct

SEQ ID NO: 45467 - DNA, 40 bp, Homo sapiens
  misc_feature 1..40: note = chr18:77612204-77612244
  misc_feature 1..40: note = hypo
  source 1..40: mol_type = genomic DNA
ccagtgaccttgtttcggggaagcgcgctcccatttccca

SEQ ID NO: 45468 - DNA, 30 bp, Homo sapiens
  misc_feature 1..30: note = chr18:77622551-77622581
  misc_feature 1..30: note = hypo
  source 1..30: mol_type = genomic DNA
ttctcgggtttttcccggcatgtgcgcagc

SEQ ID NO: 45469 - DNA, 30 bp, Homo sapiens
  misc_feature 1..30: note = chr18:77627798-77627828
  misc_feature 1..30: note = hypo
  source 1..30: mol_type = genomic DNA
ggcctccctggactgcgtggagacccctcc

SEQ ID NO: 45470 - DNA, 49 bp, Homo sapiens
  misc_feature 1..49: note = chr18:77628385-77628434
  misc_feature 1..49: note = hypo
  source 1..49: mol_type = genomic DNA
tgacccgtgtccaagcgtccggttaagaagcagtcgccctctgcatggg

SEQ ID NO: 45471 - DNA, 30 bp, Homo sapiens
  misc_feature 1..30: note = chr18:77628965-77628995
  misc_feature 1..30: note = hypo
  source 1..30: mol_type = genomic DNA
ctgatgggatgtgtgcgggaggctgagtcc

SEQ ID NO: 45472 - DNA, 71 bp, Homo sapiens
  misc_feature 1..71: note = chr18:77631844-77631915
  misc_feature 1..71: note = hypo
  source 1..71: mol_type = genomic DNA
ggtgccagtcagcagcgtctgccactgcgacattggcagcaaattcctgccagcaccgagtgaggacccgc

SEQ ID NO: 45473 - DNA, 40 bp, Homo sapiens
  misc_feature 1..40: note = chr18:77636150-77636190
  misc_feature 1..40: note = hypo
  source 1..40: mol_type = genomic DNA
ccaggacccatctcccgcctggtgccgctgccatcacagt

SEQ ID NO: 45474 - DNA, 208 bp, Homo sapiens
  misc_feature 1..208: note = chr18:77636591-77636799
  misc_feature 1..208: note = hypo
  source 1..208: mol_type = genomic DNA
cagtggtgccctctgcgagcagcttgctcacctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccgggccaccaactccgtgtccttcttgca

SEQ ID NO: 45475 - DNA, 36 bp, Homo sapiens
  misc_feature 1..36: note = chr18:77644664-77644700
  misc_feature 1..36: note = hypo
  source 1..36: mol_type = genomic DNA
ggtttccaaagagaccggacacgcccaaggcccaca

SEQ ID NO: 45476 - DNA, 30 bp, Homo sapiens
  misc_feature 1..30: note = chr18:77713124-77713154
  misc_feature 1..30: note = hypo
  source 1..30: mol_type = genomic DNA
gcccctgctcagccgcgccctagcctgagc

SEQ ID NO: 45477 - DNA, 115 bp, Homo sapiens
  misc_feature 1..115: note = chr19:292109-292224
  misc_feature 1..115: note = hypo
  source 1..115: mol_type = genomic DNA
tcggcacccaccttgcgacggcgtagggtgtccaggcgcagccctgtgcccaggcaccgttcctatcagcgcacttgctgtcccatttcacagaagagcacgggggcgccaggag

SEQ ID NO: 45478 - DNA, 26 bp, Homo sapiens
  misc_feature 1..26: note = chr19:349162-349188
  misc_feature 1..26: note = hypo
  source 1..26: mol_type = genomic DNA
ataaagcaccacggatgaggtagttt

SEQ ID NO: 45479 - DNA, 118 bp, Homo sapiens
  misc_feature 1..118: note = chr19:400972-401090
  misc_feature 1..118: note = hypo
  source 1..118: mol_type = genomic DNA
ccaggctcaccctcacgcttgatgatttgcgaggacgcacggaactcccagcaagctgtcctcgtcacaggtagggtttgtcacagtgccggggtgcaggtgccgtgggctggggaag

SEQ ID NO: 45480 - DNA, 30 bp, Homo sapiens
  misc_feature 1..30: note = chr19:401481-401511
  misc_feature 1..30: note = hypo
  source 1..30: mol_type = genomic DNA
gcagcagggctcagccggtgaccaggactg

SEQ ID NO: 45481 - DNA, 442 bp, Homo sapiens
  misc_feature 1..442: note = chr19:403367-403809
  misc_feature 1..442: note = hypo
  source 1..442: mol_type = genomic DNA
agacctgaggcagggcgagacaccacgcaggcgcagaatccctggatgacgcccacttggaagtggaggggggagggcatgggcagctgcagctcccagacaccagcacacacaaacgcacacacaagtgcacaccagcagcgacacaggcacacacaagcgcacacagggtcacacatgcatacacggctcacgtgcttacacgtgcacacgccagcacacaggcagctatactcgagtgcctgcaggcgctcacctggcactgtcacatacgcccaacagatgagcacggtaacggcacacgcagtcacactgcacacacatgcggaagcacatggcgacgtgtgtgcacctacctggcacgcacacgcacacacccgtgcagcctagcgatgagtggctggggctgaagaggctacaaggcgcccgtagccctgtcaac

SEQ ID NO: 45482 - DNA, 546 bp, Homo sapiens
  misc_feature 1..546: note = chr19:407124-407670
  misc_feature 1..546: note = hypo
  source 1..546: mol_type = genomic DNA
gcagctccttctccccgagcagcgtgtcccgcttgaggctgctgcccttgttcaccaccttgatcctgagggccagtttccggacgctggcgggccccaggccgtcgaagaagaaatcctcgttgaagacggggcggcggctgttcttcacgatggtgctgcgctgcttctgcagcttgcccggcaccaggcacaggcccacgcagcagttgatgctgcgggcgtcgcacaggcggtcgtagaggccctcggcggccagcaggtgcacccgcaggcgggcctggccggcctcgtactcggccagcagccgcacgctgccccgagggcccacgtggaccgtgtgctccccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcaccttggcctggctgtcctgggcgaaacctttgagcagagacacggagcgggacagca

SEQ ID NO: 45483 - DNA, 30 bp, Homo sapiens
  misc_feature 1..30: note = chr19:413211-413241
  misc_feature 1..30: note = hypo
  source 1..30: mol_type = genomic DNA
gcaccagctgattcccggggcatcctggcc

SEQ ID NO: 45484 - DNA, 119 bp, Homo sapiens
  misc_feature 1..119: note = chr19:426860-426979
  misc_feature 1..119: note = hypo
  source 1..119: mol_type = genomic DNA
tccggggagggaggacgacagtgcgagacgcaggcgggtggaggaatccctggaccctggacccgcgctatgggcacatttgtaggagttcttggccagagaatcgggaagggcatgag

SEQ ID NO: 45485 - DNA, 68 bp, Homo sapiens
  misc_feature 1..68: note = chr19:468719-468787
  misc_feature 1..68: note = hypo
  source 1..68: mol_type = genomic DNA
cacggccccacagaccgtctgtgcacacatgctgtacatgtggcagtgagccacgggtgagggaggaa

SEQ ID NO: 45486 - DNA, 272 bp, Homo sapiens
  misc_feature 1..272: note = chr19:470863-471135
  misc_feature 1..272: note = hypo
  source 1..272: mol_type = genomic DNA
ggagctgcttcactgcgcccgttctagacaggagcaggcaccatggggcaaggccaccagcctgtggcacagcgagccggtgcaccccatgcctgccctcccgcaggcagccgggaatgtccacagagatacaccacagccctgtgagacgggccaggcccggggagcccccaccttcatggtggagaaactggggctcagggctcagcctcacacccgacagcacacgtttactgagcacttactattttttctttttcttaaatttgttt

SEQ ID NO: 45487 - DNA, 229 bp, Homo sapiens; identical to SEQ ID NO: 16347
  misc_feature 1..229: note = chr19:485165-485394
  misc_feature 1..229: note = hypo
  source 1..229: mol_type = genomic DNA

SEQ ID NO: 45488 - DNA, 216 bp, Homo sapiens
  misc_feature 1..216: note = chr19:491311-491527
  misc_feature 1..216: note = hypo
  source 1..216: mol_type = genomic DNA
cctttatggtgtttgcgacgtcgtgtaaacaccagctctctagtctcaaacccggcgagggcggttcatagacaatttcagtctctcgacgcgacgccgtgtggcttgtgcccttctagccacctagaccctcgggagaggcctgtgcggctcctggctgggcccccgtcttcaaagcagcttttgagtggccctttgacccgtgagacagggccg

SEQ ID NO: 45489 - DNA, 30 bp, Homo sapiens
  misc_feature 1..30: note = chr19:499792-499822
  misc_feature 1..30: note = hypo
  source 1..30: mol_type = genomic DNA
gggccggtgccctggcggtgctcccttcac

SEQ ID NO: 45490 - DNA, 41 bp, Homo sapiens
  misc_feature 1..41: note = chr19:508329-508370
  misc_feature 1..41: note = hypo
  source 1..41: mol_type = genomic DNA
cctggaagagcctggcgatgtgcgggcgggttgcagggaag

SEQ ID NO: 45491 - DNA, 176 bp, Homo sapiens
  misc_feature 1..176: note = chr19:524057-524233
  misc_feature 1..176: note = hypo
  source 1..176: mol_type = genomic DNA
taaatcctggacacccggacagggacgcagggcacggaggcttccaggagtgaccaatcagaggacaccaaagctggtcccagggtgcacctcacactccgccccggtcccttgaggccaaggccgaccgaagcccacctcccctgccccgcccagctccccggggcctcccctga

SEQ ID NO: 45492 - DNA, 224 bp, Homo sapiens
  misc_feature 1..224: note = chr19:530256-530480
  misc_feature 1..224: note = hypo
  source 1..224: mol_type = genomic DNA
tgcagctgtgtgtacccagggcatagcaacaatgccactggcacagtccgagggcagggccacccgtcacgggcacgactcaggggaggctgggctgccccgtcctcaccacggccagttctcccgaccaagcttcacagcaaggagcatgtgggtgtctgggcagccactgagccaggtcagaagtcaggtggggtcacagtgatgcccggaatcagctgggg

SEQ ID NO: 45493 - DNA, 206 bp, Homo sapiens
  misc_feature 1..206: note = chr19:548497-548703
  misc_feature 1..206: note = hypo
  source 1..206: mol_type = genomic DNA
cacgccgggccaggccgcagcaccctgattccctctgtccccaggatggcccagctgaggctggtgctggggctccacaccctggacagccccggtctcaccttccacatcaaggcagccatccagcaccctcgctacaagcccgtccctgccctggagaacgacctcgcgctgcttcaggtgtgcagggacgggacagggagaac

SEQ ID NO: 45494 - DNA, 366 bp, Homo sapiens
  misc_feature 1..366: note = chr19:549314-549680
  misc_feature 1..366: note = hypo
  source 1..366: mol_type = genomic DNA
cactggcaggggtcccgtttctcaggtgcagaaactgaggctcagacaggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccaga

SEQ ID NO: 45495 - DNA, 111 bp, Homo sapiens; identical to SEQ ID NO: 16352
  misc_feature 1..111: note = chr19:550388-550499
  misc_feature 1..111: note = hypo
  source 1..111: mol_type = genomic DNA

SEQ ID NO: 45496 - DNA, 37 bp, Homo sapiens
  misc_feature 1..37: note = chr19:557261-557298
  misc_feature 1..37: note = hypo
  source 1..37: mol_type = genomic DNA
caaagcgcagaggcacgatggtcgctgacaaagtggg

SEQ ID NO: 45497 - DNA, 24 bp, Homo sapiens
  misc_feature 1..24: note = chr19:558037-558061
  misc_feature 1..24: note = hypo
  source 1..24: mol_type = genomic DNA
gatgccaaggtcaggcgccgtcgc

SEQ ID NO: 45498 - DNA, 30 bp, Homo sapiens
  misc_feature 1..30: note = chr19:559762-559792
  misc_feature 1..30: note = hypo
  source 1..30: mol_type = genomic DNA
tccttctgtgtctggcgtctctcactgagt

SEQ ID NO: 45499 - DNA, 218 bp, Homo sapiens
  misc_feature 1..218: note = chr19:593150-593368
  misc_feature 1..218: note = hypo
  source 1..218: mol_type = genomic DNA
agtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcggctcacgcctgagatcccag

SEQ ID NO: 45500 - DNA, 248 bp, Homo sapiens
  misc_feature 1..248: note = chr19:599192-599440
  misc_feature 1..248: note = hypo
  source 1..248: mol_type = genomic DNA
ctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtgggg

SEQ ID NO: 45501 - DNA, 46 bp, Homo sapiens
  misc_feature 1..46: note = chr19:601680-601726
  misc_feature 1..46: note = hypo
  source 1..46: mol_type = genomic DNA
ttttaaggagccacccgtgtttgctccgagtcgttttgattttcat

SEQ ID NO: 45502 - DNA, 30 bp, Homo sapiens
  misc_feature 1..30: note = chr19:602546-602576
  misc_feature 1..30: note = hypo
  source 1..30: mol_type = genomic DNA
ggcgtgagctgagcacggttcatttcccac

SEQ ID NO: 45503 - DNA, 34 bp, Homo sapiens
  misc_feature 1..34: note = chr19:623991-624025
  misc_feature 1..34: note = hypo
  source 1..34: mol_type = genomic DNA
tttgagaatcaaagacgcacgtccacataaaagc

SEQ ID NO: 45504 - DNA, 84 bp, Homo sapiens
  misc_feature 1..84: note = chr19:634304-634388
  misc_feature 1..84: note = hypo
  source 1..84: mol_type = genomic DNA
gaatgaaataaacctcggagcctagagcctgccctggtctccgcgtgatcctgcctaggaggagcagggcgggagctttagaat

SEQ ID NO: 45505 - DNA, 30 bp, Homo sapiens
  misc_feature 1..30: note = chr19:638382-638412
  misc_feature 1..30: note = hypo
  source 1..30: mol_type = genomic DNA
tggggccagtctcaccgctgtgggtcccat

SEQ ID NO: 45506 - DNA, 58 bp, Homo sapiens
  misc_feature 1..58: note = chr19:640949-641007
  misc_feature 1..58: note = hypo
  source 1..58: mol_type = genomic DNA
ggggactggctgggccggtccatccatggcgggcatggccaggcggggtggcctcggg

SEQ ID NO: 45507 - DNA, 85 bp, Homo sapiens
  misc_feature 1..85: note = chr19:690838-690923
  misc_feature 1..85: note = hypo
  source 1..85: mol_type = genomic DNA
tacaccgtccctggcaaggtgacaggccgctgcggctctgcgctggtgtgcctgatccccgtgtccggggcgctggcatcgtctg

SEQ ID NO: 45508 - DNA, 30 bp, Homo sapiens
  misc_feature 1..30: note = chr19:696867-696897
  misc_feature 1..30: note = hypo
  source 1..30: mol_type = genomic DNA
tggcaaagttcaggtcgtaaattgcagctc

SEQ ID NO: 45509 - DNA, 33 bp, Homo sapiens
  misc_feature 1..33: note = chr19:727028-727061
  misc_feature 1..33: note = hypo
  source 1..33: mol_type = genomic DNA
gagatcgagaacaagcgccggcagctggaggac

SEQ ID NO: 45510 - DNA, 30 bp, Homo sapiens
  misc_feature 1..30: note = chr19:748479-748509
  misc_feature 1..30: note = hypo
  source 1..30: mol_type = genomic DNA
tggggtggtgggaggcgctggaatccccac

SEQ ID NO: 45511 - DNA, 285 bp, Homo sapiens
  misc_feature 1..285: note = chr19:752081-752366
  misc_feature 1..285: note = hypo
  source 1..285: mol_type = genomic DNA
cacttgctctgtcatcgctgtgtgacctcagatgagcaggttctcctctctgggtcccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttggccgacacagtgaaaccccatctctactaaaaa

SEQ ID NO: 45512 - DNA, 39 bp, Homo sapiens
  misc_feature 1..39: note = chr19:793780-793819
  misc_feature 1..39: note = hypo
  source 1..39: mol_type = genomic DNA
taaccagcaaaccaacgtgattctcgcacaaaggcaagg

SEQ ID NO: 45513 - DNA, 87 bp, Homo sapiens
  misc_feature 1..87: note = chr19:814462-814549
  misc_feature 1..87: note = hypo
  source 1..87: mol_type = genomic DNA
ggaagccggcatacacgtccacagggtggctgcggtactgcgtgatctgcgtgagcccgcatacgcccgcggcgatggcaaaggcga

SEQ ID NO: 45514 - DNA, 30 bp, Homo sapiens
  misc_feature 1..30: note = chr19:850011-850041
  misc_feature 1..30: note = hypo
  source 1..30: mol_type = genomic DNA
taagaactttatgaacgtgaatttatttca

SEQ ID NO: 45515 - DNA, 632 bp, Homo sapiens; identical to SEQ ID NO: 1629
  misc_feature 1..632: note = chr19:883582-884214
  misc_feature 1..632: note = hypo
  source 1..632: mol_type = genomic DNA

SEQ ID NO: 45516 - DNA, 30 bp, Homo sapiens
  misc_feature 1..30: note = chr19:885082-885112
  misc_feature 1..30: note = hypo
  source 1..30: mol_type = genomic DNA
gggaccctggggccacgcactgctgggcct

SEQ ID NO: 45517 - DNA, 145 bp, Homo sapiens
  misc_feature 1..145: note = chr19:891516-891661
  misc_feature 1..145: note = hypo
  source 1..145: mol_type = genomic DNA
acactagctctctcccgaaggaagagcccgcagacaggcaagcggtggggcggctccctgtagccgaggcggggctgagtgacagggaacacctgtggccgaggcggggctgagtgacagggaacacctgtggccgaggcggggg

SEQ ID NO: 45518 - DNA, 41 bp, Homo sapiens
  misc_feature 1..41: note = chr19:893910-893951
  misc_feature 1..41: note = hypo
  source 1..41: mol_type = genomic DNA
atgtccaagagtggggaaactgtaagcgaagtcaccgaccc

SEQ ID NO: 45519 - DNA, 228 bp, Homo sapiens
  misc_feature 1..228: note = chr19:900821-901049
  misc_feature 1..228: note = hypo
  source 1..228: mol_type = genomic DNA
cccgcacctctcctccggtcctccccacggccagggcccctcctccgcgccttgctcctgccctcatcctccaggtagcgaagaacccgctcctgctcctccccggagcggttcatgaaatcgttccagacctggaagagaggcagggaggcaggcttgccatgaaacactggggctgcgctgacatccccgggcaaatgggcacggtaaggccgccaagcacgtgga

SEQ ID NO: 45520 - DNA, 113 bp, Homo sapiens
  misc_feature 1..113: note = chr19:945999-946112
  misc_feature 1..113: note = hypo
  source 1..113: mol_type = genomic DNA
agtgcttggaccctgcggttactccgagcccatttctcagcagggaaaaatgaggctcgcggaggcaggggcccggcgtccaggtgggagcatgagggcgtattgtgggtggg

SEQ ID NO: 45521 - DNA, 833 bp, Homo sapiens
  misc_feature 1..833: note = chr19:955719-956552
  misc_feature 1..833: note = hypo
  source 1..833: mol_type = genomic DNA
aggcagggtagaccccgtaataccgggtcagaatctcagaggagaggaccttccgctcgccctggaagggcccaaggtgtgctggcctctacgtgcggttcttagccggggggctgcgtaacgaaggacctcaaaccgcgggcgtaaaacaaacgaaacctgttctccctccgtcctggagcccagagtccaaaatcgaggcgtccgcagggctgcgctccctccaggggctgcaggaggagccttccgcctctcccagctcctgggggctccaggagtcccttgacatgtggccggcctctgtctctgtgcgaccgtctccagtgcccaccggccttcactgtgactttttctcaatttgatcacgtctgcaaaggccctttttccaaataacgtctcgttctgaggttctgggccgatgtgaatttgggtgggggatggcgttcaccccaggacagccccagcggtgaagtcctccccattccagtacctgctgcctcaggcgtttccctggcaagctcgtcctgtccccctctccgccctgtccccctctccgccctgcccggctcacttttgcagctgagaaaatcaaggttcaagtaacgagcatttattaggcaactgctgtgtgctcggctgattccagactctgggaacaaaacagactaaaccccagatacactcctagatccgtgactcggtgatggacggggtctcggaggaagaacgtggaggggagggggcggcagccgggccggggtcagaggacgaggccgggcgtgtggccatgtgtgcgtgcctgtgctcatgggacccaccggcccggccagccg

SEQ ID NO: 45522 - DNA, 230 bp, Homo sapiens
  misc_feature 1..230: note = chr19:957171-957401
  misc_feature 1..230: note = hypo
  source 1..230: mol_type = genomic DNA
ctctggaagacgttccggggcctggtgatcttcttcctccccagccaccaccctggcaggcagaggcggtcggtggctcatttcatagctggaggctgagactccaggctccaggtgcggggaagccagcaggagacaggaggaccgggatgggaagcagggcggggctctgggccaagtccccagcagcccccaggctctggtcccgcactcgccgctgtgtctcagtt

SEQ ID NO: 45523 - DNA, 32 bp, Homo sapiens
  misc_feature 1..32: note = chr19:959587-959619
  misc_feature 1..32: note = hypo
  source 1..32: mol_type = genomic DNA
tctgggctccgggaccgcgggagaatagattt

SEQ ID NO: 45524 - DNA, 65 bp, Homo sapiens
  misc_feature 1..65: note = chr19:963980-964045
  misc_feature 1..65: note = hypo
  source 1..65: mol_type = genomic DNA
tcctcccgagggctgcgctgtccctaagcccaggttactggtggataaaccgaggcagagctgcc

SEQ ID NO: 45525 - DNA, 625 bp, Homo sapiens
  misc_feature 1..625: note = chr19:1003177-1003802
  misc_feature 1..625: note = hypo
  source 1..625: mol_type = genomic DNA
tggatgtgctggtggcggtgctgcaggcgcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaactgcggggacctgcagccggccgggcccgagtccccggggcgcttcttggcacggtgagtggggaccctgcttcccttaggagggtgtccaggccactgagtctgcactgctcatggatcacaaaaggcaacgtg

SEQ ID NO: 45526 - DNA, 666 bp, Homo sapiens
  misc_feature 1..666: note = chr19:1004775-1005441
  misc_feature 1..666: note = hypo
  source 1..666: mol_type = genomic DNA
ccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccctgcgcaagtgctgctacggctactgcattgacctgctggagcggctggcggaggacacgcccttcgacttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatcatggtgcgggcacgggacacggcctcacccatcggtgcctttatgtggcccctgcactggtccacgtggctgggcgtctttgcggccctgcacctcaccgcgctcttcctcaccgtgtacgagtggcgtagcccctacggcctcacgccacgtggccgcaaccgcagcaccgtcttctcctactcctcagccctcaacctgtgctacgccatcctcttcagacgcaccgtgtccagcaagacgcccaagtgccccacgggccgcctgctcatgaac

SEQ ID NO: 45527 - DNA, 133 bp, Homo sapiens
  misc_feature 1..133: note = chr19:1030092-1030225
  misc_feature 1..133: note = hypo
  source 1..133: mol_type = genomic DNA
cctcagtgctgtctccgcggtcactagtggctggatagggacactcgaggtccccactggtgcacacccactgcccaggagcacacagcccattccccacggcggtgtctcagagcaccgaaggccaagaaag

SEQ ID NO: 45528 - DNA, 56 bp, Homo sapiens
  misc_feature 1..56: note = chr19:1042258-1042314
  misc_feature 1..56: note = hypo
  source 1..56: mol_type = genomic DNA
ggtgcctcagaccaacgtccccccagccccatgctcccgtgcgctcctcccccagc

SEQ ID NO: 45529 - DNA, 25 bp, Homo sapiens
  misc_feature 1..25: note = chr19:1047890-1047915
  misc_feature 1..25: note = hypo
  source 1..25: mol_type = genomic DNA
agaagctggcacagtcgccgggcgc

SEQ ID NO: 45530 - DNA, 178 bp, Homo sapiens
  misc_feature 1..178: note = chr19:1051366-1051544
  misc_feature 1..178: note = hypo
  source 1..178: mol_type = genomic DNA
gggtactgaggtccacgtgggtaggcaaccttgcccaaggctgggtgtgacacactgaggtcccttccccatctctaccaggtgggatgcaacggaagctgtccgtggccattgcctttgtgggcggctcccaagttgttatcctggacgagcctacggctggcgtggatcctgcttc

SEQ ID NO: 45531 - DNA, 32 bp, Homo sapiens
  misc_feature 1..32: note = chr19:1083719-1083751
  misc_feature 1..32: note = hypo
  source 1..32: mol_type = genomic DNA
gcgaggtcaattccccgcttcagattttcttt

SEQ ID NO: 45532 - DNA, 118 bp, Homo sapiens
  misc_feature 1..118: note = chr19:1085976-1086094
  misc_feature 1..118: note = hypo
  source 1..118: mol_type = genomic DNA
gcagggaaaggcagccggaattcgtgtgagctggggtggggctgggaccacaggtggcttctctcttgcctgctcctgtccctccagcacgtcccctgcaccacggcatagcttaggt

SEQ ID NO: 45533 - DNA, 186 bp, Homo sapiens
  misc_feature 1..186: note = chr19:1105541-1105727
  misc_feature 1..186: note = hypo
  source 1..186: mol_type = genomic DNA
cgggtgggtgggggtcggggtgggctccagcctggagagggcctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaa

SEQ ID NO: 45534 - DNA, 158 bp, Homo sapiens
  misc_feature 1..158: note = chr19:1112603-1112761
  misc_feature 1..158: note = hypo
  source 1..158: mol_type = genomic DNA
cacccactaggcccccgctccaggtcaccaggacgtcccggggcagcgagaggcctgcggggcgcggacaccacccgccacacggccactcgcgcccgcacctggcacacacacactccagaagtgcgcgggtccacagtccccggggacccttgggc

SEQ ID NO: 45535 - DNA, 25 bp, Homo sapiens
  misc_feature 1..25: note = chr19:1128398-1128423
  misc_feature 1..25: note = hypo
  source 1..25: mol_type = genomic DNA
tttttttttttgagacggattctta

SEQ ID NO: 45536 - DNA, 56 bp, Homo sapiens
  misc_feature 1..56: note = chr19:1156227-1156283
  misc_feature 1..56: note = hypo
  source 1..56: mol_type = genomic DNA
gacgccccttccaggcggcaaccccaggaggctcaggggaccgggttcttcaaggg

SEQ ID NO: 45537 - DNA, 60 bp, Homo sapiens
  misc_feature 1..60: note = chr19:1156568-1156628
  misc_feature 1..60: note = hypo
  source 1..60: mol_type = genomic DNA
ctcacaacagccacccgaggaagcagcccagtgtccacggataggcgagtggaccagcat

SEQ ID NO: 45538 - DNA, 30 bp, Homo sapiens
  misc_feature 1..30: note = chr19:1167293-1167323
  misc_feature 1..30: note = hypo
  source 1..30: mol_type = genomic DNA
tgacaacgacacccacgcgccctctctggg

SEQ ID NO: 45539 - DNA, 354 bp, Homo sapiens
  misc_feature 1..354: note = chr19:1171068-1171422
  misc_feature 1..354: note = hypo
  source 1..354: mol_type = genomic DNA
cacacaacacaaacacgggtgcacaggcacacacaacacacaaacacggatgcacagacacgcacacaatgtgcacccataaaacacacgcgtatgaaacacacgagcaacacacacatgcacaggagcacacagccacaggcacgcacattcacacacacacaacgcacccacatccgtacaacacacacacagaacgcgcacacgtccgtacgacgcacacacagaatgcacgtgcgtacgtacaatgcacacaaagaatacacacatccatacaacacacaggcacacaacacacatgtgcatgcacatggcgcaacatacagatacacaaagacacgtgtacacacacat

SEQ ID NO: 45540 - DNA, 30 bp, Homo sapiens
  misc_feature 1..30: note = chr19:1208940-1208970
  misc_feature 1..30: note = hypo
  source 1..30: mol_type = genomic DNA
gcaggctgtgacatgcggaaaccaggggca

SEQ ID NO: 45541 - DNA, 121 bp, Homo sapiens
  misc_feature 1..121: note = chr19:1220427-1220548
  misc_feature 1..121: note = hypo
  source 1..121: mol_type = genomic DNA
acaaggacatcaagccggggaacctgctgctcaccaccggtggcaccctcaaaatctccgacctgggcgtggccgaggtaggcacgtgctagggggggccctggggcgccccctcccgggc

SEQ ID NO: 45542 - DNA, 92 bp, Homo sapiens
  misc_feature 1..92: note = chr19:1227516-1227608
  misc_feature 1..92: note = hypo
  source 1..92: mol_type = genomic DNA
atcctcccaggggcccgcgggaggcggagaaccggtgcccaggctgacctcttccgtcttccttccaccctgcagcccgtgtccaggagccc

SEQ ID NO: 45543 - DNA, 30 bp, Homo sapiens
  misc_feature 1..30: note = chr19:1234905-1234935
  misc_feature 1..30: note = hypo
  source 1..30: mol_type = genomic DNA
ggtccctgcagcctccgcacccagctcctc

SEQ ID NO: 45544 - DNA, 30 bp, Homo sapiens; identical to SEQ ID NO: 16369
  misc_feature 1..30: note = chr19:1236238-1236268
  misc_feature 1..30: note = hypo
  source 1..30: mol_type = genomic DNA

SEQ ID NO: 45545 - DNA, 60 bp, Homo sapiens
  misc_feature 1..60: note = chr19:1236474-1236534
  misc_feature 1..60: note = hypo
  source 1..60: mol_type = genomic DNA
ccaaggcggtgcagccggctcgagaaggactccagacgccctgtccgccccatcacgggg

SEQ ID NO: 45546 - DNA, 30 bp, Homo sapiens
  misc_feature 1..30: note = chr19:1257622-1257652
  misc_feature 1..30: note = hypo
  source 1..30: mol_type = genomic DNA
ggagagtgaaggagacggagaaacgcgccc

SEQ ID NO: 45547 - DNA, 30 bp, Homo sapiens
  misc_feature 1..30: note = chr19:1274097-1274127
  misc_feature 1..30: note = hypo
  source 1..30: mol_type = genomic DNA
tagctccatcccatacgggtagctggctcc

SEQ ID NO: 45548 - DNA, 101 bp, Homo sapiens
  misc_feature 1..101: note = chr19:1274693-1274794
  misc_feature 1..101: note = hypo
  source 1..101: mol_type = genomic DNA
ctggagcacgggctgcggtgcgccggcagcttacggggcggccagtccttgcccacaacgatgtggagccctgtgaaagtcggattcgaataaagggccac

SEQ ID NO: 45549 - DNA, 48 bp, Homo sapiens
  misc_feature 1..48: note = chr19:1289247-1289295
  misc_feature 1..48: note = hypo
  source 1..48: mol_type = genomic DNA
gtgcgtgcccttgcacgggatgtctgcagtgtccgaggtccctgtgcg

SEQ ID NO: 45550 - DNA, 32 bp, Homo sapiens
  misc_feature 1..32: note = chr19:1301313-1301345
  misc_feature 1..32: note = hypo
  source 1..32: mol_type = genomic DNA
gtcggcggggcgggccgcgttgccaggcctgg

SEQ ID NO: 45551 - DNA, 168 bp, Homo sapiens
  misc_feature 1..168: note = chr19:1308177-1308345
  misc_feature 1..168: note = hypo
  source 1..168: mol_type = genomic DNA
cacttgagtctggaacgtctcagaccggacccctccctttacagcctgagagagggagagaccctgcccaggcctcccaggggcctgcccacccgacagctcctgactcccccaccctcattggtccagaaatggaaggcttcggcccaggagcgatcaatgcaccct

SEQ ID NO: 45552 - DNA, 80 bp, Homo sapiens
  misc_feature 1..80: note = chr19:1311273-1311353
  misc_feature 1..80: note = hypo
  source 1..80: mol_type = genomic DNA
ggcacttttgccagccgctcctgcctttgtcgcaaacccaggggtattttcccacaaggtggactcggtgggtttgaaag

SEQ ID NO: 45553 - DNA, 30 bp, Homo sapiens; identical to SEQ ID NO: 16373
  misc_feature 1..30: note = chr19:1325942-1325972
  misc_feature 1..30: note = hypo
  source 1..30: mol_type = genomic DNA

SEQ ID NO: 45554 - DNA, 35 bp, Homo sapiens
  misc_feature 1..35: note = chr19:1329520-1329555
  misc_feature 1..35: note = hypo
  source 1..35: mol_type = genomic DNA
atacgattccagtcacgacccggcatgtgtcgggt

SEQ ID NO: 45555 - DNA, 40 bp, Homo sapiens
  misc_feature 1..40: note = chr19:1409921-1409961
  misc_feature 1..40: note = hypo
  source 1..40: mol_type = genomic DNA
ggaggcaggagatcccgccggaccccgcttggagggctgg

SEQ ID NO: 45556 - DNA, 39 bp, Homo sapiens
  misc_feature 1..39: note = chr19:1424255-1424294
  misc_feature 1..39: note = hypo
  source 1..39: mol_type = genomic DNA
gtcttctccatcctgcgctcctctcgctgtgtgccttgc

SEQ ID NO: 45557 - DNA, 30 bp, Homo sapiens
  misc_feature 1..30: note = chr19:1437261-1437291
  misc_feature 1..30: note = hypo
  source 1..30: mol_type = genomic DNA
aagcataagccaccacgcccagccaggtgc

SEQ ID NO: 45558 - DNA, 30 bp, Homo sapiens
  misc_feature 1..30: note = chr19:1440112-1440142
  misc_feature 1..30: note = hypo
  source 1..30: mol_type = genomic DNA
aggccaagaaggaggcgccgcccatggaga

SEQ ID NO: 45559 - DNA, 149 bp, Homo sapiens
  misc_feature 1..149: note = chr19:1481985-1482134
  misc_feature 1..149: note = hypo
  source 1..149: mol_type = genomic DNA
ctgctgctggtccagcgtggaggatgggggacaggaggtgcagtccctcggggagccgccgcggcaggtgtagcaggaggcatggcagctggagcagaccctcagcgcgggcgccgccgtgtgcccaggcccagcggtcaccagccttg

SEQ ID NO: 45560 - DNA, 198 bp, Homo sapiens
  misc_feature 1..198: note = chr19:1482359-1482557
  misc_feature 1..198: note = hypo
  source 1..198: mol_type = genomic DNA
agcccctctgtgtcccgctgcacacacgcgctgctggtcacctgggggcctgtaggccgcgctgtcatgtcctcggccgtcccatagagcagcagcgtgtagcggtacaacgtccctggacaggggtcgcgggtgggcacaggaggaaaaggaggctctcggcagcctggtcctggtagtccccgggctccctcccct

SEQ ID NO: 45561 - DNA, 30 bp, Homo sapiens
  misc_feature 1..30: note = chr19:1495370-1495400
  misc_feature 1..30: note = hypo
  source 1..30: mol_type = genomic DNA
accccgcatatgcctcgtgagtgcacggct

SEQ ID NO: 45562 - DNA, 307 bp, Homo sapiens
  misc_feature 1..307: note = chr19:1496387-1496694
  misc_feature 1..307: note = hypo
  source 1..307: mol_type = genomic DNA
agacagaatcatgaacgacctcagcgggcgagccctggacgcggcggccggaataaccaggaacggtgggtgctcgcaggcgcctggctgcctcaggccatctcccgggtctggacctgtctctctccaccttgcctccctttctgactttggccgccccctctcactgtccgcctctctctctcacgcttccgggaaccagtcttgcaggtcctggcccgtagccgggcaggcatcaccccggtggctgtggccgggccctccactcccctggaagctgaccgtacgtaaccgctgtggggagata

SEQ ID NO: 45563 - DNA, 210 bp, Homo sapiens
  misc_feature 1..210: note = chr19:1525771-1525981
  misc_feature 1..210: note = hypo
  source 1..210: mol_type = genomic DNA
tgtccatctgcacctcgccgctgccccccgtaccatcctgtgtgccctctgctgtccattcgccagcgcttcttacgcctacgtagggccaattgtgtccatcctttactcacctgggcacacccaggctctcttgatccacctgggcccagcttacgctgtgctcatcaggcccgtctcagactcacctgtgaccgcctgggcccatca

SEQ ID NO: 45564 - DNA, 43 bp, Homo sapiens
  misc_feature 1..43: note = chr19:1526480-1526523
  misc_feature 1..43: note = hypo
  source 1..43: mol_type = genomic DNA
acagtctttggcccacgtgctgagggcgcggcagatcctgacg

SEQ ID NO: 45565 - DNA, 61 bp, Homo sapiens
  misc_feature 1..61: note = chr19:1527227-1527288
  misc_feature 1..61: note = hypo
  source 1..61: mol_type = genomic DNA
acaggcaggtcagggcgtatgtgtacagggatacagcgtgtgtgggcgcagggcaggtgtg

SEQ ID NO: 45566 - DNA, 33 bp, Homo sapiens
  misc_feature 1..33: note = chr19:1528123-1528156
  misc_feature 1..33: note = hypo
  source 1..33: mol_type = genomic DNA
cttcacacaggtgggcggcggtcctcggcgtgg

SEQ ID NO: 45567 - DNA, 30 bp, Homo sapiens; identical to SEQ ID NO: 16379
  misc_feature 1..30: note = chr19:1533726-1533756
  misc_feature 1..30: note = hypo
  source 1..30: mol_type = genomic DNA

SEQ ID NO: 45568 - DNA, 49 bp, Homo sapiens
  misc_feature 1..49: note = chr19:1654563-1654612
  misc_feature 1..49: note = hypo
  source 1..49: mol_type = genomic DNA
gacctcaggcaagttcgtgctactctccgggcctcggtttctccatctg

SEQ ID NO: 45569 - DNA, 46 bp, Homo sapiens
  misc_feature 1..46: note = chr19:1672993-1673039
  misc_feature 1..46: note = hypo
  source 1..46: mol_type = genomic DNA
cggggcatgcttatgcgtgttctcgcatgctcgtgtgcattctagc

SEQ ID NO: 45570 - DNA, 46 bp, Homo sapiens
  misc_feature 1..46: note = chr19:1729230-1729276
  misc_feature 1..46: note = hypo
  source 1..46: mol_type = genomic DNA
gtgttgtggggtacacgtgtgtatgtgagctcgtgagggtgtgcaa

SEQ ID NO: 45571 - DNA, 48 bp, Homo sapiens; identical to SEQ ID NO: 16380
  misc_feature 1..48: note = chr19:1799852-1799900
  misc_feature 1..48: note = hypo
  source 1..48: mol_type = genomic DNA

SEQ ID NO: 45572 - DNA, 64 bp, Homo sapiens
  misc_feature 1..64: note = chr19:1802584-1802648
  misc_feature 1..64: note = hypo
  source 1..64: mol_type = genomic DNA
attccaggcaccccacgaagtggtgcatccgactgttaggcgcctcacacgtcactgtgcctgt

SEQ ID NO: 45573 - DNA, 30 bp, Homo sapiens
  misc_feature 1..30: note = chr19:1807179-1807209
  misc_feature 1..30: note = hypo
  source 1..30: mol_type = genomic DNA
aggtcccgggtggcacggatgaagaggagg

SEQ ID NO: 45574 - DNA, 320 bp, Homo sapiens
  misc_feature 1..320: note = chr19:1808120-1808440
  misc_feature 1..320: note = hypo
  source 1..320: mol_type = genomic DNA
ctgtggggagtgggacgtgaacccacccatcacacagacaaacacatcgatgctgccaggtggctaggggggacttcctggaggaggcaacacgcctcacctgcaggatgatgatgatgaggaagaacaggttggacacgcggtggaactgctcgtacaggttcagcggcaggaacgagtagaagttgtacttggccgtgcggatgacattggtctggaacgagagccgcgggctgcctggcagaggggtgccatccaggccaggggatgggggtgcccgaggccagacctgcctcacttggcctcgcccagcatcctct

SEQ ID NO: 45575 - DNA, 377 bp, Homo sapiens; identical to SEQ ID NO: 16382
  misc_feature 1..377: note = chr19:1809512-1809889
  misc_feature 1..377: note = hypo
  source 1..377: mol_type = genomic DNA

SEQ ID NO: 45576 - DNA, 141 bp, Homo sapiens
  misc_feature 1..141: note = chr19:1810575-1810716
  misc_feature 1..141: note = hypo
  source 1..141: mol_type = genomic DNA
ataatccctcccacctgcaccgccccctctgcccaggatcagcacctgagttcctgtcctcatcttggagatcttctctctggccgaggctgcccatgctggtggggctgtgggagagaagggccccgggtcacagcagtg

SEQ ID NO: 45577 - DNA, 78 bp, Homo sapiens
  misc_feature 1..78: note = chr19:1896317-1896395
  misc_feature 1..78: note = hypo
  source 1..78: mol_type = genomic DNA
gcctggctgtaattgcctcttaaagagaaacaagtcagattggatttgggcgcaccctcaggacgtcatttgaaccta

SEQ ID NO: 45578 - DNA, 51 bp, Homo sapiens
  misc_feature 1..51: note = chr19:1908389-1908440
  misc_feature 1..51: note = hypo
  source 1..51: mol_type = genomic DNA
ccccggcggctgaggcgtggaccaggcagtgcatgtcgaggagtagcaccc

SEQ ID NO: 45579 - DNA, 37 bp, Homo sapiens; identical to SEQ ID NO: 16383
  misc_feature 1..37: note = chr19:1912092-1912129
  misc_feature 1..37: note = hypo
  source 1..37: mol_type = genomic DNA

SEQ ID NO: 45580 - DNA, 48 bp, Homo sapiens
  misc_feature 1..48: note = chr19:1912374-1912422
  misc_feature 1..48: note = hypo
  source 1..48: mol_type = genomic DNA
tttgcctggctgggccggcctcgggcccgcgctcgctggctgagctcc

SEQ ID NO: 45581 - DNA, 150 bp, Homo sapiens
  misc_feature 1..150: note = chr19:1969956-1970106
  misc_feature 1..150: note = hypo
  source 1..150: mol_type = genomic DNA
aggtgaggccctgctcggtggtaggtggggtcgggaggctgctggcagggccgccccgagtcaccggagcctctggtggggccgcccggggtcactggagcctctggcggggccgccccatgtcactggcaggtgcgttgaatcatcagt

SEQ ID NO: 45582 - DNA, 99 bp, Homo sapiens
  misc_feature 1..99: note = chr19:1970425-1970524
  misc_feature 1..99: note = hypo
  source 1..99: mol_type = genomic DNA
caccatgtaaaaggccgcacctggcccacctggctccgtcccttctgctcacaccaacctctcccgggtcggggtctgattgcccgggcaggcgtgagg

SEQ ID NO: 45583 - DNA, 30 bp, Homo sapiens
  misc_feature 1..30: note = chr19:1970740-1970770
  misc_feature 1..30: note = hypo
  source 1..30: mol_type = genomic DNA
gttgctggggttgtccggggaacccaggtg

SEQ ID NO: 45584 - DNA, 649 bp, Homo sapiens
  misc_feature 1..649: note = chr19:1978313-1978962
  misc_feature 1..649: note = hypo
  source 1..649: mol_type = genomic DNA
ctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctggtgcgcggcgggcggggcggggcggggctcggagggaagagggtggccctggaggggagcgcgtgggacggggaggggcccggccgacaccgccgtgcccccctgcagatcacgcgcatggagtatgtgcacaccaagagcctaatctaccgggacgtgaagcccgagaacttcctggtgggccgcccggggaccaagcggcagcatgccatc

SEQ ID NO: 45585 - DNA, 385 bp, Homo sapiens
  misc_feature 1..385: note = chr19:1992849-1993234
  misc_feature 1..385: note = hypo
  source 1..385: mol_type = genomic DNA
cgtgagcaaccacgcccggcccaaaacacattttactaccaggcaggagcctgctgcctcccgggcccgcccccggccccgcctccgcctccagcctcggtccgccccaccccggccccgcctccagccaggcctggccccgcccccgcctcgtaccggccccgcccacctgcgtgagcagcatgaaggcgttgtcggctcgcaggttcttcttcaggaactccacgcaatgggcctcgagcgctggcaccgcgtacttcttggcggtgtatagcgtggtcatcaccgtctccgggccaatctgcacctcgtccgagtagagaaacctgcagaagcaacgcgggtggccgtgaggtgggaccgccatgcccgcccccaggggaga

SEQ ID NO: 45586 - DNA, 44 bp, Homo sapiens
  misc_feature 1..44: note = chr19:2191591-2191635
  misc_feature 1..44: note = hypo
  source 1..44: mol_type = genomic DNA
cccgggccccacccacggctgcagcctgccgcagtccttccctg

SEQ ID NO: 45587 - DNA, 30 bp, Homo sapiens
  misc_feature 1..30: note = chr19:2214092-2214122
  misc_feature 1..30: note = hypo
  source 1..30: mol_type = genomic DNA
gggtttgttcccagacgaattgcgccacct

SEQ ID NO: 45588 - DNA, 56 bp, Homo sapiens
  misc_feature 1..56: note = chr19:2243515-2243571
  misc_feature 1..56: note = hypo
  source 1..56: mol_type = genomic DNA
ggccctggagaccatcgacatcaacaaggtgggccagccaccgtgcagctgcctgt

SEQ ID NO: 45589 - DNA, 55 bp, Homo sapiens; identical to SEQ ID NO: 16388
  misc_feature 1..55: note = chr19:2274600-2274655
  misc_feature 1..55: note = hypo
  source 1..55: mol_type = genomic DNA

SEQ ID NO: 45590 - DNA, 197 bp, Homo sapiens
  misc_feature 1..197: note = chr19:2275743-2275940
  misc_feature 1..197: note = hypo
  source 1..197: mol_type = genomic DNA
aacacagccagtcctcgaggctgggagcttccccacctgcggcccgctctgctaggcgcaggaccagcagcccgcggcgcacccgcagccagggcccgagcgctcggagccagggaccaagcggtgctccgcggccgcgcagctcaggcccgggcccccagagcagcgcctgcagcgcgccccgcgtccgggacgcc

SEQ ID NO: 45591 - DNA, 170 bp, Homo sapiens
  misc_feature 1..170: note = chr19:2331273-2331443
  misc_feature 1..170: note = hypo
  source 1..170: mol_type = genomic DNA
acagtcacttggaagcggggtttctaagcctagtagtttctgaacctgtgtgcggttgcaaagcgtttgtgctgcaattgtgaaggatttggaggtcgaggcttgggctttgagcctgtccttgtagcctgagctttttctgctcctccaaatttcggtgggcctgtcta

SEQ ID NO: 45592 - DNA, 125 bp, Homo sapiens
  misc_feature 1..125: note = chr19:2331903-2332028
  misc_feature 1..125: note = hypo
  source 1..125: mol_type = genomic DNA
acacagaaggtgggccggactgtggattcttggcctctgccgtgacccataacatccctcctggaggaggggttctggggggctgtgttggaaggggcaccctccgggctcggcaccggggccag

SEQ ID NO: 45593 - DNA, 204 bp, Homo sapiens
  misc_feature 1..204: note = chr19:2358959-2359163
  misc_feature 1..204: note = hypo
  source 1..204: mol_type = genomic DNA
cgtggcagcgggtggcgcgtcaaaactgaggccacccagtctgaccatgagggagaaaagcaccagacaaacccacttgaggcgtgtcctgcaaaacacctgacctgccttccccaggagcgggcagggtgtcagaaataggaatgtctgggaaactgcgacagcccagagagatccgaggaggcgtgacgcctaaatgccacg

SEQ ID NO: 45594 - DNA, 99 bp, Homo sapiens
  misc_feature 1..99: note = chr19:2360711-2360810
  misc_feature 1..99: note = hypo
  source 1..99: mol_type = genomic DNA
cgggggttatgtggacgcaggtgtggcgtgtggatgcggccggggttgtgtggactcaggtgtggtgtgtagatgcacgtagggttgtgtggacgcagc

SEQ ID NO: 45595 - DNA, 127 bp, Homo sapiens
  misc_feature 1..127: note = chr19:2363057-2363184
  misc_feature 1..127: note = hypo
  source 1..127: mol_type = genomic DNA
ccctgcagagcctcacgccgcctgcttgtcctgccacgcggaatgggagtccgtgtgtgccccgctgcccacagcgtgtgaacgtgagttggggaccatgtggcccactgcgcgctgggtcccgtcc

SEQ ID NO: 45596 - DNA, 42 bp, Homo sapiens
  misc_feature 1..42: note = chr19:2471261-2471303
  misc_feature 1..42: note = hypo
  source 1..42: mol_type = genomic DNA
acttcaaagcccccccgcaacaccgtgcccagcctgcagtac

SEQ ID NO: 45597 - DNA, 29 bp, Homo sapiens
  misc_feature 1..29: note = chr19:2471700-2471729
  misc_feature 1..29: note = hypo
  source 1..29: mol_type = genomic DNA
aaatacggtgactcacgcctgtaattcca

SEQ ID NO: 45598 - DNA, 294 bp, Homo sapiens
  misc_feature 1..294: note = chr19:2513200-2513494
  misc_feature 1..294: note = hypo
  source 1..294: mol_type = genomic DNA
ccaagcagggatccccgcctcacgggcctgcacggaggacctgggcggccgtccaggaaccctctcggcacgggttcttagacgcctgtctccactggggccggagggacaggactaggctagttttattctactacttgcttctaggccagccccgtggagggggtcggggcggccaggcctcctgcgatcagggctgcgtggggtccatctcaggtgtggccgcaggtgatgccggcaggccctggaagatgtggctgcacctgctcccgtccgtgccgcagaggaggacgc

SEQ ID NO: 45599 - DNA, 60 bp, Homo sapiens
  misc_feature 1..60: note = chr19:2518493-2518553
  misc_feature 1..60: note = hypo
  source 1..60: mol_type = genomic DNA
cccggccagcagcagcgtgatggggtctgggagggctcagagctgcgctggagggagact

SEQ ID NO: 45600 - DNA, 124 bp, Homo sapiens
  misc_feature 1..124: note = chr19:2524811-2524935
  misc_feature 1..124: note = hypo
  source 1..124: mol_type = genomic DNA
gtgcatgcgtgttggcgtgtgtgtacgtcactgtaggtgcgtggatatgtgcgtgcgtgggtgtgtacatgtgtctgcatgtgtacatgcgtgtgcgtgtgtgtgcgcacgggagtgcatgtgg

SEQ ID NO: 45601 - DNA, 150 bp, Homo sapiens
  misc_feature 1..150: note = chr19:2683891-2684041
  misc_feature 1..150: note = hypo
  source 1..150: mol_type = genomic DNA
gctggtggacagcatcggccagaggagctcaaatccgccctcagccccagggggccgagctgcaaaagcgacgtcaaatggacaaaaatcccaccgggcacagaagtgcgaccagcaagtctatgggtttaaaaataaatgatggggccg

SEQ ID NO: 45602 - DNA, 30 bp, Homo sapiens
  misc_feature 1..30: note = chr19:2895788-2895818
  misc_feature 1..30: note = hypo
  source 1..30: mol_type = genomic DNA
aaaaaaaaaaagtaccgacgttgacatggg

SEQ ID NO: 45603 - DNA, 22 bp, Homo sapiens
  misc_feature 1..22: note = chr19:2899962-2899984
  misc_feature 1..22: note = hypo
  source 1..22: mol_type = genomic DNA
caggaggctgggaaacgtttgg

SEQ ID NO: 45604 - DNA, 22 bp, Homo sapiens
  misc_feature 1..22: note = chr19:3050735-3050757
  misc_feature 1..22: note = hypo
  source 1..22: mol_type = genomic DNA
gggcgcggtggctcacgcctgt

SEQ ID NO: 45605 - DNA, 148 bp, Homo sapiens
  misc_feature 1..148: note = chr19:3219506-3219654
  misc_feature 1..148: note = hypo
  source 1..148: mol_type = genomic DNA
gctgggattacaggtgtgagtcgccgcgccctgccactcccacgcgctttacttcctcagtaacatccatggcacgggcatcctgcagtgaccgatgcccaccagactgcatccgctaacaagacagggagaccggcctgtggtaccc

SEQ ID NO: 45606 - DNA, 97 bp, Homo sapiens
  misc_feature 1..97: note = chr19:3296598-3296695
  misc_feature 1..97: note = hypo
  source 1..97: mol_type = genomic DNA
catgccaatctgcctcgagggggcctcacccgtgtccgcggcgcccgccgaggcccccgagggcctgcttgggagtgtgtgccggtgtgcagttgta

SEQ ID NO: 45607 - DNA, 30 bp, Homo sapiens
  misc_feature 1..30: note = chr19:3308117-3308147
  misc_feature 1..30: note = hypo
  source 1..30: mol_type = genomic DNA
atcagcaggtcctgtcgcccctgccctcac

SEQ ID NO: 45608 - DNA, 122 bp, Homo sapiens
  misc_feature 1..122: note = chr19:3344938-3345060
  misc_feature 1..122: note = hypo
  source 1..122: mol_type = genomic DNA
cccgtgtggctgcagcggagggaggagagggagagagggaggaggcgagggcagggagggacagggtgggtcaggcagggctttgtagccctcggggaggactctgtcgcctggagggcagt

SEQ ID NO: 45609 - DNA, 32 bp, Homo sapiens
  misc_feature 1..32: note = chr19:3456167-3456199
  misc_feature 1..32: note = hypo
  source 1..32: mol_type = genomic DNA
ataattcatgcaccccgcgcggaggcagccct

SEQ ID NO: 45610 - DNA, 360 bp, Homo sapiens
  misc_feature 1..360: note = chr19:3562248-3562608
  misc_feature 1..360: note = hypo
  source 1..360: mol_type = genomic DNA
cccagcccttcatgcctcttttacagataaggaaactgagtttcacaaagacgggcatgggcatgggactgtggcgggcatgggactaacaagaggcagatgtgggatttgaactcagctccacgtgacctctttatgtgctggctgcggaatgccacctgagtgtggaggaacaggtgcctcactgtccactgctttttcagcctcctttgtaggtcgagaatcaggcacaatcccgcctccctttggagaagatccagcggaggaggcagggtgtggttaaagcgccaacacatctctgcattcttgtccttttgctgttgtggtggttgttgtttgagactgagtcttgctctgtcg

SEQ ID NO: 45611 - DNA, 32 bp, Homo sapiens
  misc_feature 1..32: note = chr19:3570187-3570219
  misc_feature 1..32: note = hypo
  source 1..32: mol_type = genomic DNA
aacaaacaaaaaggccgggcgcagtggcccac

SEQ ID NO: 45612 - DNA, 88 bp, Homo sapiens
  misc_feature 1..88: note = chr19:3571371-3571459
  misc_feature 1..88: note = hypo
  source 1..88: mol_type = genomic DNA
gcgcccggcccatggcggataatattctgttgtaaggatatatcccgtcatcgatccatgcatcattagcagacgtttgagttgtttt

SEQ ID NO: 45613 - DNA, 75 bp, Homo sapiens; identical to SEQ ID NO: 16400
  misc_feature 1..75: note = chr19:3578148-3578223
  misc_feature 1..75: note = hypo
  source 1..75: mol_type = genomic DNA

SEQ ID NO: 45614 - DNA, 30 bp, Homo sapiens
  misc_feature 1..30: note = chr19:3747990-3748020
  misc_feature 1..30: note = hypo
  source 1..30: mol_type = genomic DNA
ccctggcccggtcctcggagcccgtgcagg

SEQ ID NO: 45615 - DNA, 40 bp, Homo sapiens
  misc_feature 1..40: note = chr19:3760214-3760254
  misc_feature 1..40: note = hypo
  source 1..40: mol_type = genomic DNA
catggctggaggccccgaaggggatcgggaaattgtgggg

SEQ ID NO: 45616 - DNA, 217 bp, Homo sapiens
  misc_feature 1..217: note = chr19:3778200-3778417
  misc_feature 1..217: note = hypo
  source 1..217: mol_type = genomic DNA
gcgaggtggagccgtcggcgtcctgccctgagacggaggctggggcacctgcactgcgtagctcccgggccagcttctcggccagtttgcggaagggtggccggcgggcgggctctgcctcccagcagctgctcatgaggacgtgcacggggcctggacagccctcggggggttccatgcggtaccccttctccacggcctccgacacctctttcag

SEQ ID NO: 45617 - DNA, 432 bp, Homo sapiens
  misc_feature 1..432: note = chr19:3779009-3779441
  misc_feature 1..432: note = hypo
  source 1..432: mol_type = genomic DNA
gcgccgtccacttgacgggcagccggcttgagtctagccccttccgctcggctttggccaggccaaagtcgctgaccttggccaccaggtcctctgagaccaggatgttgcgggcggccaggtcgcggtgcacaagcttcttgctctccaggtactccatgccctcggccacgtgcctgggggtagtagggggcagtgggggctcaggtgccaggatgcccacattcagggctcagaaagctcggggtgcctggggccacaagctcacaaagcctccctgccccgtgcctcagtttccccttgatggatcttggaatctgcgccccgacgaccccagtgccgcagcaccctgagagtcccacttacagagaaaactgcaggagctgagcggtgttcacgagggctcgaccccgggtccgcagaaagttcacc

SEQ ID NO: 45618 - DNA, 243 bp, Homo sapiens
  misc_feature 1..243: note = chr19:3821011-3821254
  misc_feature 1..243: note = hypo
  source 1..243: mol_type = genomic DNA
agggacaccgggggtcgggggacacaggtcacaaggcacctctgcagccgtgtggtccagcgagttggccggcagtgtccctgcgtctacggaggccctggagcccacgtgtcaggtccgcacgccactgtgcccttgcccgtctgctctggaaccctctcacgctcccacaccaggacgtgcccactgcccgggcacccgtctccccccactgctcgagagctcacacggaggagctccgta

SEQ ID NO: 45619 - DNA, 246 bp, Homo sapiens
  misc_feature 1..246: note = chr19:3855407-3855653
  misc_feature 1..246: note = hypo
  source 1..246: mol_type = genomic DNA
aagtgaaagcagtcccgggcgatccggcggcagattcattgagtcattggataaatacttcctgggtgctagtggggaccagctgctgtcatgggcgctgtcacagcagcggggaataaccagaccaaagtcccgtcctccaggagggtgctgcgcgatagtccagggagacacggggtcagcaaaataattcaacgcgatctgatggttctcatgccgccgggaaggacgcggcaagggggtgtg

SEQ ID NO: 45620 - DNA, 120 bp, Homo sapiens
  misc_feature 1..120: note = chr19:3907807-3907927
  misc_feature 1..120: note = hypo
  source 1..120: mol_type = genomic DNA
cggcagcgccgccaacgggcgcctgtggcggacagtgatcatcggggagcaagagcaccgtatagacctgcacatgatccggccttacatgaaagtggtcacccacggaggtgagacccg

SEQ ID NO: 45621 - DNA, 105 bp, Homo sapiens
  misc_feature 1..105: note = chr19:3982749-3982854
  misc_feature 1..105: note = hypo
  source 1..105: mol_type = genomic DNA
ggctcctgcagatcccgctgcggcaagcccaccacccagctagggagggccgtaccatgatgttgcccatggggccgctctcgccctcgccgtaggtggagatga

SEQ ID NO: 45622 - DNA, 34 bp, Homo sapiens
  misc_feature 1..34: note = chr19:4043284-4043318
  misc_feature 1..34: note = hypo
  source 1..34: mol_type = genomic DNA
cgactgaggcggcagcggtcgtaacaggctgcgt

SEQ ID NO: 45623 - DNA, 206 bp, Homo sapiens
  misc_feature 1..206: note = chr19:4053834-4054040
  misc_feature 1..206: note = hypo
  source 1..206: mol_type = genomic DNA
gtgtgcacgtgcgtgtatgtgtgcgtctgcgtgcatgtgtgcgtgcggtgcagggagagaggcgggaggggtcgtgagcggcggatgctggggcagagagcaggacggcgcctcccccgcggcgggcagctcacctggtgaagcggaccttgcagatgttgcactcgtagggcttctcgcccgtgtgggtgcggatgtgtcgcggc

SEQ ID NO: 45624 - DNA, 34 bp, Homo sapiens
  misc_feature 1..34: note = chr19:4054641-4054675
  misc_feature 1..34: note = hypo
  source 1..34: mol_type = genomic DNA
catccaggtcatcatcggacgccccaaaggcgga

SEQ ID NO: 45625 - DNA, 41 bp, Homo sapiens
  misc_feature 1..41: note = chr19:4096416-4096457
  misc_feature 1..41: note = hypo
  source 1..41: mol_type = genomic DNA
cccagggaggtggcccggcctggtcacgtggccaacaggac

SEQ ID NO: 45626 - DNA, 37 bp, Homo sapiens
  misc_feature 1..37: note = chr19:4131483-4131520
  misc_feature 1..37: note = hypo
  source 1..37: mol_type = genomic DNA
aagaaaagaaaaaggcgggctgggcgcggtggctcac

SEQ ID NO: 45627 - DNA, 188 bp, Homo sapiens
  misc_feature 1..188: note = chr19:4212361-4212549
  misc_feature 1..188: note = hypo
  source 1..188: mol_type = genomic DNA
gttgcacgtggaatgcgtgaatgtgcatggaatggaggctatgaagcaggaggtggggcagggaggcctcttgcccagatccaaacccctgtccctgtttctcccgtcagtccccggaggccagctccctgcacatcctggagagacaggtaggtgggaaggtggggaggagccggtcctcctgctgc

SEQ ID NO: 45628 - DNA, 30 bp, Homo sapiens
  misc_feature 1..30: note = chr19:4290546-4290576
  misc_feature 1..30: note = hypo
  source 1..30: mol_type = genomic DNA
ctccactacagttcacgcccactgccggtg

SEQ ID NO: 45629 - DNA, 30 bp, Homo sapiens
  misc_feature 1..30: note = chr19:4305764-4305794
  misc_feature 1..30: note = hypo
  source 1..30: mol_type = genomic DNA
ggctcacctgcctgccgtgtgtgtgtgcgc

SEQ ID NO: 45630 - DNA, 131 bp, Homo sapiens
  misc_feature 1..131: note = chr19:4361539-4361670
  misc_feature 1..131: note = hypo
  source 1..131: mol_type = genomic DNA
cccagcagggggtgccggccagtgtggacggaggggcggggcggggacacgggtgagtcactgcggcaggggcacaagcacctccacgtagctgagcgggaagaagcccgactggccgtccagcatgccct

SEQ ID NO: 45631 - DNA, 30 bp, Homo sapiens
  misc_feature 1..30: note = chr19:4363376-4363406
  misc_feature 1..30: note = hypo
  source 1..30: mol_type = genomic DNA
gcttctccgccagctcgtccaggatctgca

SEQ ID NO: 45632 - DNA, 48 bp, Homo sapiens
  misc_feature 1..48: note = chr19:4512122-4512170
  misc_feature 1..48: note = hypo
  source 1..48: mol_type = genomic DNA
ggacggtccctttggcgacattcactgcccccacgagcccagtagtca

SEQ ID NO: 45633 - DNA, 392 bp, Homo sapiens
  misc_feature 1..392: note = chr19:4547998-4548390
  misc_feature 1..392: note = hypo
  source 1..392: mol_type = genomic DNA
cttgcttcccgcccacggctggcctggggtggacactcacttcatacaccccgagtactgctggcagcgagccacaggcactcggaccacgcagcgggggaaggcagccagcaggccccccgaagctgcgtccagctccaagctcagcagccgctgccctgtctcgccaccgccgggccgtccacacctggggacaagcagagtggtgaggctgagcgcatctcagcccatctcccctcctgctggcgaccccttcccacctttgcccagacttacctgtccggccggtaggtctcaaactcctccaggaagacactgagcccagacgtccctgaggtgctggcattgggccggacgaggaacttgaggaccgtccccgcctcagaacccag

SEQ ID NO: 45634 - DNA, 114 bp, Homo sapiens
  misc_feature 1..114: note = chr19:4550904-4551018
  misc_feature 1..114: note = hypo
  source 1..114: mol_type = genomic DNA
gtgtcaggtcaaaggcgcagacagccgagccagggatgctgaggggttgggatgaaagagtttggtgagcccggtgggaggccccatctcggacaagtgcgtgcaggagcctct

SEQ ID NO: 45635 - DNA, 166 bp, Homo sapiens
  misc_feature 1..166: note = chr19:4554076-4554242
  misc_feature 1..166: note = hypo
  source 1..166: mol_type = genomic DNA
gggtgagcaggtagacggatggacaggggatgaaggatggataagtgattgtggctgggtgggtgggtggacaggtgaacagcaacagcaccaggtgtatctgacttccaactcaagtccctcgtcagggctgagtgctccacggctgctccgtagatgtcttcag

SEQ ID NO: 45636 - DNA, 62 bp, Homo sapiens
  misc_feature 1..62: note = chr19:4554999-4555061
  misc_feature 1..62: note = hypo
  source 1..62: mol_type = genomic DNA
tggagtcatgtttcacggtgcgcagggtgggcctgtccccgaggctgcggtagatgacagca

SEQ ID NO: 45637 - DNA, 260 bp, Homo sapiens
  misc_feature 1..260: note = chr19:4555896-4556156
  misc_feature 1..260: note = hypo
  source 1..260: mol_type = genomic DNA
ctggaggaggtgacacggcctggggaaaagccatggccagcggaggtcgggcgagcagaggcctggaggttggacctggggcgcagggagtctgaagactcacgctgtagttggcgcacaccgggttgaaggcgttggaaccgcacacaaagagcgtggactcgtcccgaaggagcagcacctttacgaagtttcgacactcgccctgaggtggggacaggaggaagcggggagcgcgatgtgggcgtggtcatggtgat

SEQ ID NO: 45638 - DNA, 408 bp, Homo sapiens
  misc_feature 1..408: note = chr19:4556928-4557336
  misc_feature 1..408: note = hypo
  source 1..408: mol_type = genomic DNA
cgcaggggccgggaccgagccagggccaactcacctcctgtttgcccttcatccgacacacgtttatgtcgctggggttagatctccaggtcagcttctgcagacagagagagctggtgagggggtaacgggtcccagcagccctgagtgaccccgccgtgctgggccgaatccacccagctccccggcgcagtgccgcgtccccctggccctacccctccactcccacctgcaccccttcctcaccctctggtaccgcagctccgtggacgtggggggctccagctctacgcggtagaggttgtccctgggggaggggcatagttagtgagaactgggggctccgccaccctctcccgttccatccttcccactgccaatgtggtgtgcacacgggggcatgcaggg

SEQ ID NO: 45639 - DNA, 42 bp, Homo sapiens
  misc_feature 1..42: note = chr19:4572555-4572597
  misc_feature 1..42: note = hypo
  source 1..42: mol_type = genomic DNA
gggatcacaggcgtgagccaccgcgcccggcctcccctccac

SEQ ID NO: 45640 - DNA, 142 bp, Homo sapiens
  misc_feature 1..142: note = chr19:4670725-4670867
  misc_feature 1..142: note = hypo
  source 1..142: mol_type = genomic DNA
aaggtcaccattaggcgaacttctcataatcgttgcagccaagatgtgtgtgcatcgatattcaaaattagcagagggaaagtaggatgagaagcaggatgcttgcttttgtttccctcttgttgcccaggctggagggcag

SEQ ID NO: 45641 - DNA, 50 bp, Homo sapiens
  misc_feature 1..50: note = chr19:4672854-4672904
  misc_feature 1..50: note = hypo
  source 1..50: mol_type = genomic DNA
tcaccatgaaggattcgatgcatggccgagctctgcggctaacaaggaat

SEQ ID NO: 45642 - DNA, 40 bp, Homo sapiens
  misc_feature 1..40: note = chr19:4725551-4725591
  misc_feature 1..40: note = hypo
  source 1..40: mol_type = genomic DNA
tatgtgtttaccttccgatggagttttgctcctgttgccc

SEQ ID NO: 45643 - DNA, 78 bp, Homo sapiens
  misc_feature 1..78: note = chr19:4789954-4790032
  misc_feature 1..78: note = hypo
  source 1..78: mol_type = genomic DNA
gctgggattacaggcgtgagacaccgcgcccggccggcatgagataacaattctgaatgaagacgctgttgaacatct

SEQ ID NO: 45644 - DNA, 194 bp, Homo sapiens
  misc_feature 1..194: note = chr19:4792866-4793060
  misc_feature 1..194: note = hypo
  source 1..194: mol_type = genomic DNA
agtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgcc

SEQ ID NO: 45645 - DNA, 30 bp, Homo sapiens
  misc_feature 1..30: note = chr19:4794081-4794111
  misc_feature 1..30: note = hypo
  source 1..30: mol_type = genomic DNA
aggacagtctttctccgggagcccgctcac

SEQ ID NO: 45646 - DNA, 30 bp, Homo sapiens
  misc_feature 1..30: note = chr19:4795123-4795153
  misc_feature 1..30: note = hypo
  source 1..30: mol_type = genomic DNA
aaagtctcaggttcccgtgactcagggtaa

SEQ ID NO: 45647 - DNA, 35 bp, Homo sapiens
  misc_feature 1..35: note = chr19:4798716-4798751
  misc_feature 1..35: note = hypo
  source 1..35: mol_type = genomic DNA
tgctgattctccatccgggacgccagacacatgga

SEQ ID NO: 45648 - DNA, 30 bp, Homo sapiens; identical to SEQ ID NO: 16414
  misc_feature 1..30: note = chr19:4800545-4800575
  misc_feature 1..30: note = hypo
  source 1..30: mol_type = genomic DNA

SEQ ID NO: 45649 - DNA, 30 bp, Homo sapiens
  misc_feature 1..30: note = chr19:4835700-4835730
  misc_feature 1..30: note = hypo
  source 1..30: mol_type = genomic DNA
ttttcctttttaattcgcataggccagagt

SEQ ID NO: 45650 - DNA, 30 bp, Homo sapiens
  misc_feature 1..30: note = chr19:5041081-5041111
  misc_feature 1..30: note = hypo
  source 1..30: mol_type = genomic DNA
gctgagggtgggctgcgtagcacccaggcc

SEQ ID NO: 45651 - DNA, 200 bp, Homo sapiens
  misc_feature 1..200: note = chr19:5046161-5046361
  misc_feature 1..200: note = hypo
  source 1..200: mol_type = genomic DNA
gagggactctgcagccgcacgcaggctgtgccagcccaggccgacctgccacaggtgccaggggaagcttcagggcttccttgccatgtgtttgccatgcctagcctatgcactagcctacttttacagcgggggaaacagcccacagcagagaagcgacttgctgtggtcccaggatgaatttgcgcccagctcagcct

SEQ ID NO: 45652 - DNA, 236 bp, Homo sapiens
  misc_feature 1..236: note = chr19:5155177-5155413
  misc_feature 1..236: note = hypo
  source 1..236: mol_type = genomic DNA
agctggcagaggggccgtggcaggagcaggtggtgcctgcagcgtcctttccattgttctccaaaacgctctaaaacgggaaggctatttgggacaggctgttgctgtctgccgagcagagtaaagatgagtggataggtccccaaaagtgtcaccgtgcggagccgatgaggtctgcactcgggccggggtgggtgccccgatgccgaggtctcgtatctcggggcagtgtgtga

SEQ ID NO: 45653 - DNA, 229 bp, Homo sapiens
  misc_feature 1..229: note = chr19:5587354-5587583
  misc_feature 1..229: note = hypo
  source 1..229: mol_type = genomic DNA
cgccacctggcaccacgtggccctgggaatgtccaccttgtgcaaagccgcctcgcctaggaacaaagtcagacaatttttttccccttgaagtgctcagcgttttcatcgtaacatgggttcagtaacggtcccgcagcctttagagcgcttgggttttttttccaggtgagaaaaatcatcatcgcacattgtattccaggtaactcaagagcgttatttgcataaa

SEQ ID NO: 45654 - DNA, 362 bp, Homo sapiens
  misc_feature 1..362: note = chr19:5587840-5588202
  misc_feature 1..362: note = hypo
  source 1..362: mol_type = genomic DNA
ggccacagccaccctcgtccctggagccagccccgtaccttgccacctggcgtgctcccggctagccgcgcctgcgtccatggcaccctgccaggcgcgtgcctggtgctcctctagccgctggttgtgctctccccagtcacggccacccctttgccaaaagaaaaagacatgcagccatctaatgagcctccagggttgtgtcggcagcaggcgcacccaccctgacctcagctgcatggtgggtcatgccacacaacaagggctgcatgtcaagtgggcaaatcaagggaagggacatttccccaaagacagatgtgctagtaagcacgtgagaaggtgctcaacgccacccagaaatg

SEQ ID NO: 45655 - DNA, 103 bp, Homo sapiens
  misc_feature 1..103: note = chr19:5676808-5676911
  misc_feature 1..103: note = hypo
  source 1..103: mol_type = genomic DNA
gctgcaggacccggccgcctggatggaggggaggggccagaaagcagctgctcactggcctcgtccagtccttcccctctaacagtgacggtaacaggtgtga

SEQ ID NO: 45656 - DNA, 30 bp, Homo sapiens
  misc_feature 1..30: note = chr19:5688079-5688109
  misc_feature 1..30: note = hypo
  source 1..30: mol_type = genomic DNA
acagaaaagcaaaaccgagaaaaacgacgg

SEQ ID NO: 45657 - DNA, 39 bp, Homo sapiens
  misc_feature 1..39: note = chr19:5759751-5759790
  misc_feature 1..39: note = hypo
  source 1..39: mol_type = genomic DNA
ggtccatccgcacatcgcaatatgactcagacttaagaa

SEQ ID NO: 45658 - DNA, 30 bp, Homo sapiens; identical to SEQ ID NO: 16417
  misc_feature 1..30: note = chr19:5789897-5789927
  misc_feature 1..30: note = hypo
  source 1..30: mol_type = genomic DNA

SEQ ID NO: 45659 - DNA, 37 bp, Homo sapiens; identical to SEQ ID NO: 16418
  misc_feature 1..37: note = chr19:5790176-5790213
  misc_feature 1..37: note = hypo
  source 1..37: mol_type = genomic DNA

SEQ ID NO: 45660 - DNA, 34 bp, Homo sapiens
  misc_feature 1..34: note = chr19:5825328-5825362
  misc_feature 1..34: note = hypo
  source 1..34: mol_type = genomic DNA
acgcacatgtccatgcgtgcgcctgcgcgggcat

SEQ ID NO: 45661 - DNA, 17 bp, Homo sapiens
  misc_feature 1..17: note = chr19:5857648-5857665
  misc_feature 1..17: note = hypo
  source 1..17: mol_type = genomic DNA
accgacgtgcgtgacac

SEQ ID NO: 45662 - DNA, 36 bp, Homo sapiens
  misc_feature 1..36: note = chr19:5897722-5897758
  misc_feature 1..36: note = hypo
  source 1..36: mol_type = genomic DNA
atgaggagcttgggccggggccgggcccagaactca

SEQ ID NO: 45663 - DNA, 33 bp, Homo sapiens
  misc_feature 1..33: note = chr19:5905436-5905469
  misc_feature 1..33: note = hypo
  source 1..33: mol_type = genomic DNA
attatttttttgagacggagtttcgctcttgtc

SEQ ID NO: 45664 - DNA, 29 bp, Homo sapiens
  misc_feature 1..29: note = chr19:5910435-5910464
  misc_feature 1..29: note = hypo
  source 1..29: mol_type = genomic DNA
gggcgcggtgtctcacgcctgtaatccca

SEQ ID NO: 45665 - DNA, 164 bp, Homo sapiens
  misc_feature 1..164: note = chr19:5914953-5915117
  misc_feature 1..164: note = hypo
  source 1..164: mol_type = genomic DNA
cccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccg

SEQ ID NO: 45666 - DNA, 87 bp, Homo sapiens
  misc_feature 1..87: note = chr19:5915421-5915508
  misc_feature 1..87: note = hypo
  source 1..87: mol_type = genomic DNA
agccacaccacagagcggggaggggcaggtgggggaatggaggctgcaggactggctagaccaggtccctgccggtccaccaggcgg

SEQ ID NO: 45667 - DNA, 30 bp, Homo sapiens; identical to SEQ ID NO: 16422
  misc_feature 1..30: note = chr19:5915925-5915955
  misc_feature 1..30: note = hypo
  source 1..30: mol_type = genomic DNA

SEQ ID NO: 45668 - DNA, 30 bp, Homo sapiens
  misc_feature 1..30: note = chr19:6333625-6333655
  misc_feature 1..30: note = hypo
  source 1..30: mol_type = genomic DNA
tgggccctgatgaggcggggagaggacagc

SEQ ID NO: 45669 - DNA, 45 bp, Homo sapiens
  misc_feature 1..45: note = chr19:6351083-6351128
  misc_feature 1..45: note = hypo
  source 1..45: mol_type = genomic DNA
atatgagttataggccgggtgtggtggctcacgcctgtaatctca

SEQ ID NO: 45670 - DNA, 215 bp, Homo sapiens
  misc_feature 1..215: note = chr19:6358251-6358466
  misc_feature 1..215: note = hypo
  source 1..215: mol_type = genomic DNA
tctgagcccaaatgccggctttccaccgtgaggccctgcctgccagcgctggctgccatgtgggctttctgctttgcggacctgcaaggtattctcctaactctgtcaccttcaactccctccctctgtcttactcctgattctacaaaactgggagtgtctgtgtccccttctatctccccatcggactgcagtcccctcgaggttacagaggg

SEQ ID NO: 45671 - DNA, 21 bp, Homo sapiens
  misc_feature 1..21: note = chr19:6623980-6624001
  misc_feature 1..21: note = hypo
  source 1..21: mol_type = genomic DNA
accctaagggccaggcgtggt

SEQ ID NO: 45672 - DNA, 32 bp, Homo sapiens
  misc_feature 1..32: note = chr19:6779828-6779860
  misc_feature 1..32: note = hypo
  source 1..32: mol_type = genomic DNA
aaaataataaaaggccgggcacggtgactcac

SEQ ID NO: 45673 - DNA, 38 bp, Homo sapiens
  misc_feature 1..38: note = chr19:7168432-7168470
  misc_feature 1..38: note = hypo
  source 1..38: mol_type = genomic DNA
tttgtcctgacacaacgttgtctcgcatatggacttgt

SEQ ID NO: 45674 - DNA, 38 bp, Homo sapiens
  misc_feature 1..38: note = chr19:7184325-7184363
  misc_feature 1..38: note = hypo
  source 1..38: mol_type = genomic DNA
cttgctggaattcatcgtgtacccggagggacactcag

SEQ ID NO: 45675 - DNA, 104 bp, Homo sapiens
  misc_feature 1..104: note = chr19:7542252-7542356
  misc_feature 1..104: note = hypo
  source 1..104: mol_type = genomic DNA
gctgagaagtgacagcgcctccgactgcatctgcgcctccatggccctccgcttgccccggggcagcgggctgtggggcagagaggggccgcttacactcacgc

SEQ ID NO: 45676 - DNA, 30 bp, Homo sapiens
  misc_feature 1..30: note = chr19:7543713-7543743
  misc_feature 1..30: note = hypo
  source 1..30: mol_type = genomic DNA
cctgcacacacaccccggacattggctgga

SEQ ID NO: 45677 - DNA, 99 bp, Homo sapiens
  misc_feature 1..99: note = chr19:7627750-7627849
  misc_feature 1..99: note = hypo
  source 1..99: mol_type = genomic DNA
ccttggctagatgcccgggagtggaattgttgggttacatggagattctgtgttgaattgaagaaacgccaaacttttccatagcggctgcaccatttt

SEQ ID NO: 45678 - DNA, 43 bp, Homo sapiens
  misc_feature 1..43: note = chr19:7706504-7706547
  misc_feature 1..43: note = hypo
  source 1..43: mol_type = genomic DNA
aggaggtgcaggtggcggcagcgggaagcggggcaggtgtgca

SEQ ID NO: 45679 - DNA, 127 bp, Homo sapiens
  misc_feature 1..127: note = chr19:7727784-7727911
  misc_feature 1..127: note = hypo
  source 1..127: mol_type = genomic DNA
tgacaagggccaactcgtcccgggcaagggcagcatccctctgcttcttagtgtatgcatggtgtttaacacagcatatggaacataatagttgctcaataaatattgcctgcgctttgaacctgtg

SEQ ID NO: 45680 - DNA, 38 bp, Homo sapiens
  misc_feature 1..38: note = chr19:7752437-7752475
  misc_feature 1..38: note = hypo
  source 1..38: mol_type = genomic DNA
ccatgagtcaactcacgccctcccggcctcagggtgat

SEQ ID NO: 45681 - DNA, 84 bp, Homo sapiens
  misc_feature 1..84: note = chr19:7914950-7915034
  misc_feature 1..84: note = hypo
  source 1..84: mol_type = genomic DNA
caaacccagcatggccgagctcgggctctgcatctatcagttcgagtacatgctgcaggtgagcagggccgcaggagagcaggg

SEQ ID NO: 45682 - DNA, 48 bp, Homo sapiens
  misc_feature 1..48: note = chr19:7970450-7970498
  misc_feature 1..48: note = hypo
  source 1..48: mol_type = genomic DNA
gcagagctaggaggccggtggcaggcaggcccccgaggagtcccctcc

SEQ ID NO: 45683 - DNA, 56 bp, Homo sapiens
  misc_feature 1..56: note = chr19:8009581-8009637
  misc_feature 1..56: note = hypo
  source 1..56: mol_type = genomic DNA
gaggcagcttggccccggagagcatgcattcctggcttctgcgatggatagacttg

SEQ ID NO: 45684 - DNA, 30 bp, Homo sapiens
  misc_feature 1..30: note = chr19:8091663-8091693
  misc_feature 1..30: note = hypo
  source 1..30: mol_type = genomic DNA
agtggtagtggctcccgggccctgggccaa

SEQ ID NO: 45685 - DNA, 30 bp, Homo sapiens
  misc_feature 1..30: note = chr19:8124555-8124585
  misc_feature 1..30: note = hypo
  source 1..30: mol_type = genomic DNA
caggactcatggaagcgctctacttgtgtt

SEQ ID NO: 45686 - DNA, 34 bp, Homo sapiens
  misc_feature 1..34: note = chr19:8194085-8194119
  misc_feature 1..34: note = hypo
  source 1..34: mol_type = genomic DNA
ggctgcccacacatccgcccgccaggtggcatgc

SEQ ID NO: 45687 - DNA, 16 bp, Homo sapiens
  misc_feature 1..16: note = chr19:8253828-8253844
  misc_feature 1..16: note = hypo
  source 1..16: mol_type = genomic DNA
tggcaacgggctggac

SEQ ID NO: 45688 - DNA, 100 bp, Homo sapiens
  misc_feature 1..100: note = chr19:8475425-8475525
  misc_feature 1..100: note = hypo
  source 1..100: mol_type = genomic DNA
aaaagaaaatcaccatttggttgctattatggtaataactgactcaggcaagggtcatcaattgatattaagctcttggaaacggcgtgtgttgaggaac

SEQ ID NO: 45689 - DNA, 49 bp, Homo sapiens; identical to SEQ ID NO: 16427
  misc_feature 1..49: note = chr19:8576903-8576952
  misc_feature 1..49: note = hypo
  source 1..49: mol_type = genomic DNA

SEQ ID NO: 45690 - DNA, 88 bp, Homo sapiens
  misc_feature 1..88: note = chr19:9129141-9129229
  misc_feature 1..88: note = hypo
  source 1..88: mol_type = genomic DNA
ccttgagccgggacccggcctgcattggactaacgtatgacttcgcttctcaccccgaagcctttgcctcggccgttccctgtgccgg

SEQ ID NO: 45691 - DNA, 30 bp, Homo sapiens
  misc_feature 1..30: note = chr19:9261611-9261641
  misc_feature 1..30: note = hypo
  source 1..30: mol_type = genomic DNA
acttgagaataattccgggaggttgtgagg

SEQ ID NO: 45692 - DNA, 158 bp, Homo sapiens
  misc_feature 1..158: note = chr19:9937353-9937511
  misc_feature 1..158: note = hypo
  source 1..158: mol_type = genomic DNA
aaaacagtaaaaatcccacggccggggaaatcaggaccaaaccagtaaggagcagctctttaggcataagcacgcgcattaaagacaaaaagtatccttaacatgataaggataaccagctcattagcgctcatgcatatggacggcatatcatgaat

SEQ ID NO: 45693 - DNA, 15 bp, Homo sapiens
  misc_feature 1..15: note = chr19:10231227-10231242
  misc_feature 1..15: note = hypo
  source 1..15: mol_type = genomic DNA
cgtctcagaaaaata

SEQ ID NO: 45694 - DNA, 30 bp, Homo sapiens; identical to SEQ ID NO: 16430
  misc_feature 1..30: note = chr19:10231504-10231534
  misc_feature 1..30: note = hypo
  source 1..30: mol_type = genomic DNA

SEQ ID NO: 45695 - DNA, 31 bp, Homo sapiens
  misc_feature 1..31: note = chr19:10362045-10362076
  misc_feature 1..31: note = hypo
  source 1..31: mol_type = genomic DNA
aaacaaatgaaaaaacgccaggcacggtggc

SEQ ID NO: 45696 - DNA, 232 bp, Homo sapiens
  misc_feature 1..232: note = chr19:10370332-10370564
  misc_feature 1..232: note = hypo
  source 1..232: mol_type = genomic DNA
cctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgag

SEQ ID NO: 45697 - DNA, 30 bp, Homo sapiens
  misc_feature 1..30: note = chr19:10394324-10394354
  misc_feature 1..30: note = hypo
  source 1..30: mol_type = genomic DNA
ctgaggtcacgaccacggtgctggtgagga

SEQ ID NO: 45698 - DNA, 185 bp, Homo sapiens
  misc_feature 1..185: note = chr19:10562119-10562304
  misc_feature 1..185: note = hypo
  source 1..185: mol_type = genomic DNA
gcggctataggtctgcgtagccgctggtttattggctacgcatttgcagcgctggggtgttgggaatagattctgaagagtggcacgccagtgtgtacttgtgtaggtgtataggtttgcacgggtaattatgcagggttataggtgtgtggggctgtgccagaggggtgcgcatgtctgcaggg

SEQ ID NO: 45699 - DNA, 30 bp, Homo sapiens; identical to SEQ ID NO: 16433
  misc_feature 1..30: note = chr19:10570365-10570395
  misc_feature 1..30: note = hypo
  source 1..30: mol_type = genomic DNA

SEQ ID NO: 45700 - DNA, 139 bp, Homo sapiens
  misc_feature 1..139: note = chr19:10711944-10712083
  misc_feature 1..139: note = hypo
  source 1..139: mol_type = genomic DNA
ccggcctgttttcacccattttttccacaataactgtcaaggctgcagggaacaccccttggttactacatcccatgcacacacacctgcagtggtttgtccagggtcagtgccagacaggaatcgcaccaggtgaaca

SEQ ID NO: 45701 - DNA, 30 bp, Homo sapiens
  misc_feature 1..30: note = chr19:10762205-10762235
  misc_feature 1..30: note = hypo
  source 1..30: mol_type = genomic DNA
atttcttttttgagacggtctagctgtgcc

SEQ ID NO: 45702 - DNA, 75 bp, Homo sapiens
  misc_feature 1..75: note = chr19:10872535-10872610
  misc_feature 1..75: note = hypo
  source 1..75: mol_type = genomic DNA
tgagctctgctatttcgtacgccaccgatgggccaatgggctgccacctctgggttcaggcgtccaatcagctgt

SEQ ID NO: 45703 - DNA, 202 bp, Homo sapiens
  misc_feature 1..202: note = chr19:10875905-10876107
  misc_feature 1..202: note = hypo
  source 1..202: mol_type = genomic DNA
ttacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggg

SEQ ID NO: 45704 - DNA, 30 bp, Homo sapiens; identical to SEQ ID NO: 16436
  misc_feature 1..30: note = chr19:10954418-10954448
  misc_feature 1..30: note = hypo
  source 1..30: mol_type = genomic DNA

SEQ ID NO: 45705 - DNA, 30 bp, Homo sapiens
  misc_feature 1..30: note = chr19:11002349-11002379
  misc_feature 1..30: note = hypo
  source 1..30: mol_type = genomic DNA
agacgccggccctcccgcccccagccttcg

SEQ ID NO: 45706 - DNA, 95 bp, Homo sapiens
  misc_feature 1..95: note = chr19:11002992-11003087
  misc_feature 1..95: note = hypo
  source 1..95: mol_type = genomic DNA
tgctggggaagtgcccgttcagggccatggctgcagggctcctggacacccagctccggtgctggagtggggttgggattcgcccagaggccagg

SEQ ID NO: 45707 - DNA, 30 bp, Homo sapiens; identical to SEQ ID NO: 16438
  misc_feature 1..30: note = chr19:11005335-11005365
  misc_feature 1..30: note = hypo
  source 1..30: mol_type = genomic DNA

SEQ ID NO: 45708 - DNA, 25 bp, Homo sapiens
  misc_feature 1..25: note = chr19:11008369-11008394
  misc_feature 1..25: note = hypo
  source 1..25: mol_type = genomic DNA
atgctagctctgggccgggcacggt

SEQ ID NO: 45709 - DNA, 55 bp, Homo sapiens
  misc_feature 1..55: note = chr19:11030140-11030195
  misc_feature 1..55: note = hypo
  source 1..55: mol_type = genomic DNA
tgggaagagcaagctcgttttagctgcacagcctagaagccgtgggcagacctgg

SEQ ID NO: 45710 - DNA, 90 bp, Homo sapiens
  misc_feature 1..90: note = chr19:11052037-11052127
  misc_feature 1..90: note = hypo
  source 1..90: mol_type = genomic DNA
agtcaattatgtattcgtctggcgcccagtaaatggtcactttccataagataaagtgaacacagggtaggtacctatggagcttttttt

SEQ ID NO: 45711 - DNA, 36 bp, Homo sapiens
  misc_feature 1..36: note = chr19:11053260-11053296
  misc_feature 1..36: note = hypo
  source 1..36: mol_type = genomic DNA
gggattacaggcgtgagccaccgtgcccagccttgc

SEQ ID NO: 45712 - DNA, 42 bp, Homo sapiens
  misc_feature 1..42: note = chr19:11129719-11129761
  misc_feature 1..42: note = hypo
  source 1..42: mol_type = genomic DNA
tttcctctcttgctacggaggtgcaggcggtggtgggcagga

SEQ ID NO: 45713 - DNA, 30 bp, Homo sapiens; identical to SEQ ID NO: 16440
  misc_feature 1..30: note = chr19:11252737-11252767
  misc_feature 1..30: note = hypo
  source 1..30: mol_type = genomic DNA

SEQ ID NO: 45714 - DNA, 30 bp, Homo sapiens
  misc_feature 1..30: note = chr19:11406534-11406564
  misc_feature 1..30: note = hypo
  source 1..30: mol_type = genomic DNA
agttcccccctcccccgcttggatccccca

SEQ ID NO: 45715 - DNA, 104 bp, Homo sapiens
  misc_feature 1..104: note = chr19:11658653-11658757
  misc_feature 1..104: note = hypo
  source 1..104: mol_type = genomic DNA
gcagagaagcaggagcggaaattcgagccggggaagctaagagaagggcggaacatcattgggctgcaggtaccgccctgtcctcactgcgcagaggtcataga

SEQ ID NO: 45716 - DNA, 101 bp, Homo sapiens
  misc_feature 1..101: note = chr19:12220383-12220484
  misc_feature 1..101: note = hypo
  source 1..101: mol_type = genomic DNA
gcgatagtgctgggattacaggcatgaaccaccacgcctgttcacacaaacgtttttatgtttgataaatatttgcctttttgtcacgatttggcaccctg

SEQ ID NO: 45717 - DNA, 132 bp, Homo sapiens
  misc_feature 1..132: note = chr19:12222626-12222758
  misc_feature 1..132: note = hypo
  source 1..132: mol_type = genomic DNA
tctgggaatacataccgtttttctggtttctatcatagacataaaatgcctcatgctggcgggaagttttatggatgtaagaaatgtgggaaagcctttattagtttctgtgcctttcgataccatcaaagg

SEQ ID NO: 45718 - DNA, 40 bp, Homo sapiens
  misc_feature 1..40: note = chr19:12675871-12675911
  misc_feature 1..40: note = hypo
  source 1..40: mol_type = genomic DNA
attaccagtcttggccggacgtggtggctcacgcctgtaa

SEQ ID NO: 45719 - DNA, 23 bp, Homo sapiens
  misc_feature 1..23: note = chr19:12846825-12846848
  misc_feature 1..23: note = hypo
  source 1..23: mol_type = genomic DNA
tggagctgaagtccccgtctgag

SEQ ID NO: 45720 - DNA, 192 bp, Homo sapiens
  misc_feature 1..192: note = chr19:12863412-12863604
  misc_feature 1..192: note = hypo
  source 1..192: mol_type = genomic DNA
gtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccggtgaggctgccctgaggtgctcatgttctagcggagggggggcagc

SEQ ID NO: 45721 - DNA, 45 bp, Homo sapiens
  misc_feature 1..45: note = chr19:12977473-12977518
  misc_feature 1..45: note = hypo
  source 1..45: mol_type = genomic DNA
agacaggtatcaccacgtgaactcctatgacgaggatgacacgac

SEQ ID NO: 45722 - DNA, 30 bp, Homo sapiens; identical to SEQ ID NO: 16444
  misc_feature 1..30: note = chr19:13335742-13335772
  misc_feature 1..30: note = hypo
  source 1..30: mol_type = genomic DNA

SEQ ID NO: 45723 - DNA, 163 bp, Homo sapiens
  misc_feature 1..163: note = chr19:13781908-13782071
  misc_feature 1..163: note = hypo
  source 1..163: mol_type = genomic DNA
caaccaaatttggcccgtgggccataatttgtcaaaccctggtcaaggagtttggacttctttccattggatcattaaagatgttgcaggtgtgaatttcagttcccaatttagagacttaagagatgtaatcttatttttgttttttgtgcatttttttttg

SEQ ID NO: 45724 - DNA, 39 bp, Homo sapiens
  misc_feature 1..39: note = chr19:13943608-13943647
  misc_feature 1..39: note = hypo
  source 1..39: mol_type = genomic DNA
agaaagggcacccagcggccgggcgcggtggctcacgtc

SEQ ID NO: 45725 - DNA, 465 bp, Homo sapiens
  misc_feature 1..465: note = chr19:13988295-13988760
  misc_feature 1..465: note = hypo
  source 1..465: mol_type = genomic DNA
tttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtgcctgcacaggtggctgggggggacctgtccgagggtagtggctgagcccccctgtgaagtaagattagccccagtacccacctccaagggttaggggaagaccttagagagagcttagaacagcagttgattttatttacgtatttatttatttatcttgagacaggtctctttctgt

SEQ ID NO: 45726 - DNA, 40 bp, Homo sapiens
  misc_feature 1..40: note = chr19:14042824-14042864
  misc_feature 1..40: note = hypo
  source 1..40: mol_type = genomic DNA
cccacgtggccgatgcggttgccctcgaggtgcagctcct

SEQ ID NO: 45727 - DNA, 274 bp, Homo sapiens
  misc_feature 1..274: note = chr19:14181305-14181579
  misc_feature 1..274: note = hypo
  source 1..274: mol_type = genomic DNA
gtggcaggtgcctcccgccaggagaacggcgccagcgtgatcctccatgacattgtgagagccagagagaacatccagaaatccctggctggaagctcaggccccggggcctccagtggccccagcggagaccacagcgagctcgttgtccggatcgccagtctggaagtggagaaccagagcctgcgtggcgtggtacaggagctgcagcaggccatctccaagctggaggcccagctgaacgtgctggagaagagctcgcctggccaccggg

SEQ ID NO: 45728 - DNA, 79 bp, Homo sapiens
  misc_feature 1..79: note = chr19:14209036-14209115
  misc_feature 1..79: note = hypo
  source 1..79: mol_type = genomic DNA
tttatatcatgtccacgcccagacaaaacaaaggcacggtgtttgaagtcagaaaggacaactgcctttggtggggagg

SEQ ID NO: 45729 - DNA, 85 bp, Homo sapiens
  misc_feature 1..85: note = chr19:14244905-14244990
  misc_feature 1..85: note = hypo
  source 1..85: mol_type = genomic DNA
gcgctcggccacaaccatttttaaatgcaaggaacacaaacaggctgattgaaacctgatctcctgccgtcggggagctgggaat

SEQ ID NO: 45730 - DNA, 30 bp, Homo sapiens
  misc_feature 1..30: note = chr19:14616913-14616943
  misc_feature 1..30: note = hypo
  source 1..30: mol_type = genomic DNA
ccagggcctgccaggcgtcttcccctccac

SEQ ID NO: 45731 - DNA, 36 bp, Homo sapiens; identical to SEQ ID NO: 16449
  misc_feature 1..36: note = chr19:14630627-14630663
  misc_feature 1..36: note = hypo
  source 1..36: mol_type = genomic DNA

SEQ ID NO: 45732 - DNA, 44 bp, Homo sapiens
  misc_feature 1..44: note = chr19:14675028-14675072
  misc_feature 1..44: note = hypo
  source 1..44: mol_type = genomic DNA
agcgcctgctggagacgctcttcgtgcaccgcttctcccatggc

SEQ ID NO: 45733 - DNA, 40 bp, Homo sapiens
  misc_feature 1..40: note = chr19:14797872-14797912
  misc_feature 1..40: note = hypo
  source 1..40: mol_type = genomic DNA
aacaatggaaaacagcgtggcgattcctcaaagacctaaa

SEQ ID NO: 45734 - DNA, 80 bp, Homo sapiens
  misc_feature 1..80: note = chr19:14877987-14878067
  misc_feature 1..80: note = hypo
  source 1..80: mol_type = genomic DNA
ccatgtttcctggcacggaagcatctggaaggcaccactgtctgctcccttttcttttctttctttcttttttttttttt

SEQ ID NO: 45735 - DNA, 47 bp, Homo sapiens
  misc_feature 1..47: note = chr19:15220624-15220671
  misc_feature 1..47: note = hypo
  source 1..47: mol_type = genomic DNA
agcctgcgaggcccccgggctggcagggagcgcgagagggctgcccc

SEQ ID NO: 45736 - DNA, 123 bp, Homo sapiens
  misc_feature 1..123: note = chr19:15272392-15272515
  misc_feature 1..123: note = hypo
  source 1..123: mol_type = genomic DNA
gtctctcctgggctacgtcccgcggcagcctgtccaggtggtcggtgatctcacggttggcaaagtggtccaacagcagcttggcagcctcatagctgccctcgcgggcggccaggaataggg

SEQ ID NO: 45737 - DNA, 256 bp, Homo sapiens
  misc_feature 1..256: note = chr19:15292289-15292545
  misc_feature 1..256: note = hypo
  source 1..256: mol_type = genomic DNA
aggactcccccaagtcgttgctgtccccacttcgtcccaggtcccaggccccatcccaagccagagtccctgctctccaagcagaggccccgcccacctggggctgcagtcgggcaggtcctgttcgcagtggaagcctccgtagcctggcgggcaggtgcaggtgaaggaggccacgtggtcggtacaggtgcccgggccgcaggggttgctcaggcactcatccacatcgcgggcgcatcgtgggccggcgaaa

SEQ ID NO: 45738 - DNA, 38 bp, Homo sapiens
  misc_feature 1..38: note = chr19:15488546-15488584
  misc_feature 1..38: note = hypo
  source 1..38: mol_type = genomic DNA
gggattacaggcgtgagtcaccgcgccaggcccttcct

SEQ ID NO: 45739 - DNA, 30 bp, Homo sapiens
  misc_feature 1..30: note = chr19:15547714-15547744
  misc_feature 1..30: note = hypo
  source 1..30: mol_type = genomic DNA
ggacccccaggctctcggcccagggggctg

SEQ ID NO: 45740 - DNA, 174 bp, Homo sapiens
  misc_feature 1..174: note = chr19:15558347-15558521
  misc_feature 1..174: note = hypo
  source 1..174: mol_type = genomic DNA
cataccctggcacaccgaaggtgctcagtatttaatgaatgaataacacgtctggaggtggggagagtgtgagatacctttttgctgggtaaaccaaggggtagccagcatcgctgactacccagcctctccctagccactacagaagctgttttggcccgtggttcaggaaca

SEQ ID NO: 45741 - DNA, 30 bp, Homo sapiens
  misc_feature 1..30: note = chr19:16232444-16232474
  misc_feature 1..30: note = hypo
  source 1..30: mol_type = genomic DNA
atcacagtggctgaacggtgagaaagccag

SEQ ID NO: 45742 - DNA, 136 bp, Homo sapiens; identical to SEQ ID NO: 16452
  misc_feature 1..136: note = chr19:16275694-16275830
  misc_feature 1..136: note = hypo
  source 1..136: mol_type = genomic DNA

SEQ ID NO: 45743 - DNA, 30 bp, Homo sapiens; identical to SEQ ID NO: 16453
  misc_feature 1..30: note = chr19:16638285-16638315
  misc_feature 1..30: note = hypo
  source 1..30: mol_type = genomic DNA

SEQ ID NO: 45744 - DNA, 68 bp, Homo sapiens
  misc_feature 1..68: note = chr19:16638668-16638736
  misc_feature 1..68: note = hypo
  source 1..68: mol_type = genomic DNA
caaaccatcaaagctcggggaagggacgtgaagacctgtcacttgacctgtcccggagccacaggaag

SEQ ID NO: 45745 - DNA, 191 bp, Homo sapiens
  misc_feature 1..191: note = chr19:16939668-16939859
  misc_feature 1..191: note = hypo
  source 1..191: mol_type = genomic DNA
agcaaaaattcaccacgcaaggccctatattagggcgctgggggctcatacctcatcgtcccgtcaactctataaagcaggggccaacaaactttttccataaaaggccagatcgtaaatacttcagggtctgcagatctgtaggatctttagcaactacctactctgttgtaaggcgaaagcaggcagag

SEQ ID NO: 45746 - DNA, 44 bp, Homo sapiens
  misc_feature 1..44: note = chr19:17049224-17049268
  misc_feature 1..44: note = hypo
  source 1..44: mol_type = genomic DNA
ctgtaggtgtacgcccgggggactccttccgcctgaaacaaaga

SEQ ID NO: 45747 - DNA, 42 bp, Homo sapiens
  misc_feature 1..42: note = chr19:17265055-17265097
  misc_feature 1..42: note = hypo
  source 1..42: mol_type = genomic DNA
aaaatcactctggcacgccacccttgccggcccaggaatgcc

SEQ ID NO: 45748 - DNA, 62 bp, Homo sapiens
  misc_feature 1..62: note = chr19:17365683-17365745
  misc_feature 1..62: note = hypo
  source 1..62: mol_type = genomic DNA
agatctacaggaggtcgaggactttatgacacaaagagggaagtgaccggtgttcctggcag

SEQ ID NO: 45749 - DNA, 23 bp, Homo sapiens
  misc_feature 1..23: note = chr19:17379245-17379268
  misc_feature 1..23: note = hypo
  source 1..23: mol_type = genomic DNA
tttttttttttgagacggagttt

SEQ ID NO: 45750 - DNA, 798 bp, Homo sapiens
  misc_feature 1..798: note = chr19:17404613-17405411
  misc_feature 1..798: note = hypo
  source 1..798: mol_type = genomic DNA
ccactcagcctcccaagttgcagcgattattggcgtgaaccacctcgccgggctagtatccagggctattctaagtgctaaggatccccagaccctttctaatctgaactcgctaattagagtttctaatctaaagatcccctggtgccggtcttctagaattatataggtcaccggtctcatacaaatcctccgctgtgaggagagccttcttacagcggtggggacagtgcgtaattgctaacacctgtccagggcagccctgctttctagattctacttctgatgctagacctaatgctcctgtttgcctggggtcagaacaagatacagcaactagaggccacgcccacccggcagccacgccccctcgggaagaaagcacgcccaccaagcgctaccacgccccccgcagaggccacgcccctcccgggcagcaccctggggatttgtagctgtggcgccccaggtgcccgcctctacctcggccatgcgctggtcttcctccaccggcacaaacttatcgtgcatgccgtggacaagcaggacgggcacggtgagctcggcgtggtagacctcgtcgccctcgggccagtactggccgctcatcatggcccggagtacgaaggatgacacgttgaaagcgttgccctcctttaacagctgcttctccttggctccttggcgggcgaagccggccctggtggtggtggaggcaccgctagagccccttatgccagcccgactgccgtggggtgcccccgatgccagccctagtcccagcggtacagtcccccc

SEQ ID NO: 45751 - DNA, 438 bp, Homo sapiens
  misc_feature 1..438: note = chr19:17438085-17438523
  misc_feature 1..438: note = hypo
  source 1..438: mol_type = genomic DNA
ctcggccacccagcccgggatatcggggatggccacgtggatgaggtacttgaggagcagagcgaagtgctgcaggggtggcagagaggaggctgcaggctgcagacgctggggccgccctctcgcctcccagctgcccccgcccctgtcgccggccccacctcgagcactaccaccgacacgatggctgcctccgggctcagccaggggaagaggcgctgcagctgcccgcactggccgattaagtagcagttgaccacaatcgctaggacacccatggcctccatcaccttctgcagggcggcaggagggctcaggcggggtccagccggcctccccagaccccaggctcctcccagctgcacctgggctccctctgggcctcagctcggatctcttggcttccccccacctgccactggccgatgctttccacgc

SEQ ID NO: 45752 - DNA, 30 bp, Homo sapiens
  misc_feature 1..30: note = chr19:17644708-17644738
  misc_feature 1..30: note = hypo
  source 1..30: mol_type = genomic DNA
gtctcccgggggcagcgttgctacgggtga

SEQ ID NO: 45753 - DNA, 66 bp, Homo sapiens
  misc_feature 1..66: note = chr19:17687961-17688027
  misc_feature 1..66: note = hypo
  source 1..66: mol_type = genomic DNA
ggctccttaccccagcgactcctcaacgtctgtgccccacagtgaagcacccgcccgcagagccct

SEQ ID NO: 45754 - DNA, 154 bp, Homo sapiens
  misc_feature 1..154: note = chr19:17759263-17759417
  misc_feature 1..154: note = hypo
  source 1..154: mol_type = genomic DNA
ggtcctggcacttctcgtggcacttgacaccgcactcggtgcagcgcatgccctgcctcgcgatgccccacagcagcccctcgcactcgtagcagtaggtgggcgtggtggccgtccacacttcgaagttgtgtggcgtcgtgcacgagatggg

SEQ ID NO: 45755 - DNA, 79 bp, Homo sapiens
  misc_feature 1..79: note = chr19:17759753-17759832
  misc_feature 1..79: note = hypo
  source 1..79: mol_type = genomic DNA
ggccgaggtgatgcccgctttcctggactggaccagggactggggaggtcacagaagagggagtcgggggggttgacat

SEQ ID NO: 45756 - DNA, 30 bp, Homo sapiens
  misc_feature 1..30: note = chr19:17767185-17767215
  misc_feature 1..30: note = hypo
  source 1..30: mol_type = genomic DNA
atagcggctgctacccgtggggctgtgggg

SEQ ID NO: 45757 - DNA, 46 bp, Homo sapiens
  misc_feature 1..46: note = chr19:17836551-17836597
  misc_feature 1..46: note = hypo
  source 1..46: mol_type = genomic DNA
ggatgagggtgtcctcgcccagttttcccaccgggctaggtgttgc

SEQ ID NO: 45758 - DNA, 96 bp, Homo sapiens; identical to SEQ ID NO: 16462
  misc_feature 1..96: note = chr19:18041146-18041242
  misc_feature 1..96: note = hypo
  source 1..96: mol_type = genomic DNA

SEQ ID NO: 45759 - DNA, 181 bp, Homo sapiens
  misc_feature 1..181: note = chr19:18054301-18054482
  misc_feature 1..181: note = hypo
  source 1..181: mol_type = genomic DNA
catgtccacccccagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaac

SEQ ID NO: 45760 - DNA, 82 bp, Homo sapiens
  misc_feature 1..82: note = chr19:18054758-18054840
  misc_feature 1..82: note = hypo
  source 1..82: mol_type = genomic DNA
gcccaataaaggtggcggcaaggctgcggtgaggcacttgaagcctaagtgagtgggtggggagaggcgggcgaagaatggg

SEQ ID NO: 45761 - DNA, 51 bp, Homo sapiens
  misc_feature 1..51: note = chr19:18084967-18085018
  misc_feature 1..51: note = hypo
  source 1..51: mol_type = genomic DNA
caccgcctgggccaccggcgggcgctcttcgagaagcggaagcgcctcagc

SEQ ID NO: 45762 - DNA, 310 bp, Homo sapiens
  misc_feature 1..310: note = chr19:18092490-18092800
  misc_feature 1..310: note = hypo
  source 1..310: mol_type = genomic DNA
tggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcg

SEQ ID NO: 45763 - DNA, 165 bp, Homo sapiens
  misc_feature 1..165: note = chr19:18103700-18103865
  misc_feature 1..165: note = hypo
  source 1..165: mol_type = genomic DNA
acctccccagagcaacggcagcccctcggccatctgggaaccccgcgcggggccctagggtggcatccccgggaggtgggcagggttgggtacatgccgaacaactgtgctgaggttaaaattgccttgtgatttttctcctgctctgcccggtcctgccagggc

SEQ ID NO: 45764 - DNA, 79 bp, Homo sapiens
  misc_feature 1..79: note = chr19:18104430-18104509
  misc_feature 1..79: note = hypo
  source 1..79: mol_type = genomic DNA
gggctcagctcctgccggaggagggcacaaggacccgctgtgggctgagtgcagtggcgggcggatcgcttgagctcag

SEQ ID NO: 45765 - DNA, 76 bp, Homo sapiens
  misc_feature 1..76: note = chr19:18207919-18207995
  misc_feature 1..76: note = hypo
  source 1..76: mol_type = genomic DNA
ggtgagatcctcactcgcctcaccctagaacccgttctgctgtgtgtactgggcacattttttgttgttgttttgt

SEQ ID NO: 45766 - DNA, 18 bp, Homo sapiens
  misc_feature 1..18: note = chr19:18227706-18227724
  misc_feature 1..18: note = hypo
  source 1..18: mol_type = genomic DNA
gagcgaaactctgtctca

SEQ ID NO: 45767 - DNA, 105 bp, Homo sapiens
  misc_feature 1..105: note = chr19:18272708-18272813
  misc_feature 1..105: note = hypo
  source 1..105: mol_type = genomic DNA
aatcctgtgcacatgcgtgggcggacaggccctacccagccctcaccacactccccttccccctaaggagtgagcccagccctgacttcccggcgctgctggtgg

SEQ ID NO: 45768 - DNA, 18 bp, Homo sapiens
  misc_feature 1..18: note = chr19:18298268-18298286
  misc_feature 1..18: note = hypo
  source 1..18: mol_type = genomic DNA
acaggcataagccaccga

SEQ ID NO: 45769 - DNA, 218 bp, Homo sapiens
  misc_feature 1..218: note = chr19:18330991-18331209
  misc_feature 1..218: note = hypo
  source 1..218: mol_type = genomic DNA
gtactcctaaaatgtcgtccaggcagtgactcaacaaagctcacccaggaaggtccgggagatgtactcggacacctggttcccggagcggctggtttcggacaggtgggtcaactcccggttcaggatccgcttgaactggggcggagagaaggtgaagaccgtgatgatggggcaccgtgggccgaggcaggtgagctcagcgatctgccccacct

SEQ ID NO: 45770 - DNA, 48 bp, Homo sapiens
  misc_feature 1..48: note = chr19:18383303-18383351
  misc_feature 1..48: note = hypo
  source 1..48: mol_type = genomic DNA
aaagtcacaggaccacgttctggatccagggctcgggcaggcttcacc

SEQ ID NO: 45771 - DNA, 30 bp, Homo sapiens
  misc_feature 1..30: note = chr19:18600783-18600813
  misc_feature 1..30: note = hypo
  source 1..30: mol_type = genomic DNA
ccacgctgtggagcccgtgctggtccctca

SEQ ID NO: 45772 - DNA, 120 bp, Homo sapiens
  misc_feature 1..120: note = chr19:18681763-18681883
  misc_feature 1..120: note = hypo
  source 1..120: mol_type = genomic DNA
aggcgtgagtcaccggacccaggtcccgccctggcactttttaaccacccacaaatctggatcctacactgaaaagagacactgcagtggctcacgtctgtaatcccagcactttgggag

SEQ ID NO: 45773 - DNA, 30 bp, Homo sapiens
  misc_feature 1..30: note = chr19:18707421-18707451
  misc_feature 1..30: note = hypo
  source 1..30: mol_type = genomic DNA
gggtgctcaccactgcggggagtggaggcg

SEQ ID NO: 45774 - DNA, 42 bp, Homo sapiens; identical to SEQ ID NO: 16472
  misc_feature 1..42: note = chr19:18788397-18788439
  misc_feature 1..42: note = hypo
  source 1..42: mol_type = genomic DNA

SEQ ID NO: 45775 - DNA, 30 bp, Homo sapiens
  misc_feature 1..30: note = chr19:18878375-18878405
  misc_feature 1..30: note = hypo
  source 1..30: mol_type = genomic DNA
gtacctggcaatgcccggcccggactccat

SEQ ID NO: 45776 - DNA, 101 bp, Homo sapiens
  misc_feature 1..101: note = chr19:18880013-18880114
  misc_feature 1..101: note = hypo
  source 1..101: mol_type = genomic DNA
caagaggcggcagcccgttgggcacagcgcctggggcccagggctgggggctgcagctcagaccattggacttttctgcctagggccggctcaggcagaca

SEQ ID NO: 45777 - DNA, 30 bp, Homo sapiens; identical to SEQ ID NO: 16473
  misc_feature 1..30: note = chr19:18883509-18883539
  misc_feature 1..30: note = hypo
  source 1..30: mol_type = genomic DNA

SEQ ID NO: 45778 - DNA, 111 bp, Homo sapiens
  misc_feature 1..111: note = chr19:18883973-18884084
  misc_feature 1..111: note = hypo
  source 1..111: mol_type = genomic DNA
atagggacatcagtacggggctctcaggggcagatggttctaggtggagccgagacctgccttccctctgcactgggtctccgaggactcacccatcggtcccacaggccc

SEQ ID NO: 45779 - DNA, 30 bp, Homo sapiens
  misc_feature 1..30: note = chr19:18895773-18895803
  misc_feature 1..30: note = hypo
  source 1..30: mol_type = genomic DNA
gcttccacatgaccacgtagaagctggagc

SEQ ID NO: 45780 - DNA, 30 bp, Homo sapiens
  misc_feature 1..30: note = chr19:18975090-18975120
  misc_feature 1..30: note = hypo
  source 1..30: mol_type = genomic DNA
cccttgtcctcacaccgggatgctggccgt

SEQ ID NO: 45781 - DNA, 83 bp, Homo sapiens; identical to SEQ ID NO: 16475
  misc_feature 1..83: note = chr19:18988902-18988985
  misc_feature 1..83: note = hypo
  source 1..83: mol_type = genomic DNA

SEQ ID NO: 45782 - DNA, 586 bp, Homo sapiens
  misc_feature 1..586: note = chr19:18989695-18990281
  misc_feature 1..586: note = hypo
  source 1..586: mol_type = genomic DNA
cactaaaggagggaacgcggggtgcgggcccctccacactcactcggctttgctgggcttcaggctctgggcctcggctgtgtcatactcccgcaggtccttcagctcgtgcacctggcctgtcaacaccttggctgcaaacgccacgatgtactgcgagaggggaggggaggtgccagtgagaagaaagcccccacgccactgccctgctgacagccatgtgctcctgtcccgggccctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcatacaggaccttgagcgggaaccagtagaggcggaaccagaacctgcggtgggaggagtcaggaggccgtgggtggagggggacggtgccctacccagtccctgtcctatcccgtcctagacccacc

SEQ ID NO: 45783 - DNA, 567 bp, Homo sapiens
  misc_feature 1..567: note = chr19:18994680-18995247
  misc_feature 1..567: note = hypo
  source 1..567: mol_type = genomic DNA
tccctcaggaatctccgggcccacatcccctcctcagccttcctgcctctggtctgtcccctcgtcggacccctgagcactctgaccttggaaccctgagcactccgacctgatgtgatcccctccacggcctcctctgtgccccgccgcaacatcagcctccgcactctgtgtgggctgtgcctcggccccctgccacccgatcctgtccttaccggaaggcgtaggaggagacgatgaggatgagagtgaccacgtggtggagcagcatgaccaccgagtccttgcgccaggtgtccatgtatagcgtagcgtagatggagtggccatagaagcttccctggagcaggtaggcggctgcaatgtcccgtggcactgccatgcccggcgtccagtctggggagagccaaatctcacagtcagggccctgcgaagcctctagacgatcgcctccatgacccggtgacaccctccaagccacacgtgtcctcccagtacccaggtaaccatgcgtgtctgactgctggctttccattcccaattctatttttttttttttttctttga

SEQ ID NO: 45784 - DNA, 57 bp, Homo sapiens
  misc_feature 1..57: note = chr19:19042770-19042827
  misc_feature 1..57: note = hypo
  source 1..57: mol_type = genomic DNA
aggggtgccctcacccgctgccgcagccgctcggcctctgcacgctgagcctccagc

SEQ ID NO: 45785 - DNA, 30 bp, Homo sapiens
  misc_feature 1..30: note = chr19:19214217-19214247
  misc_feature 1..30: note = hypo
  source 1..30: mol_type = genomic DNA
ataaggacaccaattcgcatttagggccca

SEQ ID NO: 45786 - DNA, 200 bp, Homo sapiens
  misc_feature 1..200: note = chr19:19218598-19218798
  misc_feature 1..200: note = hypo
  source 1..200: mol_type = genomic DNA
acacccaggcccagccggcttcgggaggagccgagagcctctgtggctcctccctgtgcctgggaggcctgagtcccacctgctgggctgctctgtcctggcaggtacagcaacatctttcatgtcttcatccgcatctcgagagaagaggggctgaagactctctaccatggatttatgcccaccgtgctgggggtcat

SEQ ID NO: 45787 - DNA, 99 bp, Homo sapiens
  misc_feature 1..99: note = chr19:19334846-19334945
  misc_feature 1..99: note = hypo
  source 1..99: mol_type = genomic DNA
cgatcagcccgggaccgctatgcactgaccttcgctgaggcccaggaggcctgccgtctcagctcagccatcattgcagcccctcggcatctacaggct

SEQ ID NO: 45788 - DNA, 50 bp, Homo sapiens
  misc_feature 1..50: note = chr19:19335175-19335225
  misc_feature 1..50: note = hypo
  source 1..50: mol_type = genomic DNA
cggagctatgggaggcgcaacccacaggaactctacgatgtgtattgctt

SEQ ID NO: 45789 - DNA, 183 bp, Homo sapiens
  misc_feature 1..183: note = chr19:19391386-19391569
  misc_feature 1..183: note = hypo
  source 1..183: mol_type = genomic DNA
gggtcacacagctaacgagtgacagggcaggaatttgcagagccagagacaagagagctgagacggcatgtgggcagcatgcatgggcgcacgcacaaacgggctctcagaaggcagctccgttgctaacagacaccaggtgtaagcgcgcacagattcagagtctggcgtaagactcagctg

SEQ ID NO: 45790 - DNA, 39 bp, Homo sapiens
  misc_feature 1..39: note = chr19:19391907-19391946
  misc_feature 1..39: note = hypo
  source 1..39: mol_type = genomic DNA
gccctgttggggagacgcaggagccgaagtctgagcatc

SEQ ID NO: 45791 - DNA, 30 bp, Homo sapiens
  misc_feature 1..30: note = chr19:19737618-19737648
  misc_feature 1..30: note = hypo
  source 1..30: mol_type = genomic DNA
gggcagccacccacacgcccacaatgagca

SEQ ID NO: 45792 - DNA, 22 bp, Homo sapiens
  misc_feature 1..22: note = chr19:21265857-21265879
  misc_feature 1..22: note = hypo
  source 1..22: mol_type = genomic DNA
tttaagatggagtttcgctctt

SEQ ID NO: 45793 - DNA, 30 bp, Homo sapiens
  misc_feature 1..30: note = chr19:21727297-21727327
  misc_feature 1..30: note = hypo
  source 1..30: mol_type = genomic DNA
ataaaaattaggagtcgatttcaccatata

SEQ ID NO: 45794 - DNA, 42 bp, Homo sapiens
  misc_feature 1..42: note = chr19:22017749-22017791
  misc_feature 1..42: note = hypo
  source 1..42: mol_type = genomic DNA
aaaaaaaaaatagcccggctcggtggctatttttaagtgctg

SEQ ID NO: 45795 - DNA, 120 bp, Homo sapiens
  misc_feature 1..120: note = chr19:22606112-22606232
  misc_feature 1..120: note = hypo
  source 1..120: mol_type = genomic DNA
gccaccgcgcccaactaacctgaggtttttaaaaggacacaatccttctaagtaaaatgtgagccacatgtgaattttaaatttcctactagccaaactttaaaaacaaggaacacacgg

SEQ ID NO: 45796 - DNA, 171 bp, Homo sapiens
  misc_feature 1..171: note = chr19:28402178-28402349
  misc_feature 1..171: note = hypo
  source 1..171: mol_type = genomic DNA
gtgcggaaccaccgccgggagccagggactgtgctgtccgcagccctcacccccggggccccagtttctgcaaagagaggctgcactttggagggtgggtgggtgtgagtccgtcagctgaaacctggccccttatcccaagtggccagcataacacggtgacacaactta

SEQ ID NO: 45797 - DNA, 54 bp, Homo sapiens
  misc_feature 1..54: note = chr19:29145984-29146038
  misc_feature 1..54: note = hypo
  source 1..54: mol_type = genomic DNA
ccacctcacatctgccgccaccaacaacccctccaggggcggaggtgctgcaca

SEQ ID NO: 45798 - DNA, 85 bp, Homo sapiens
  misc_feature 1..85: note = chr19:29425113-29425198
  misc_feature 1..85: note = hypo
  source 1..85: mol_type = genomic DNA
caccgaagacacagacgatgctctcaccaggtccccactgggcttgattgctttattttactcttagaaacagtgtttcctttaa

SEQ ID NO: 45799 - DNA, 103 bp, Homo sapiens
  misc_feature 1..103: note = chr19:29716608-29716711
  misc_feature 1..103: note = hypo
  source 1..103: mol_type = genomic DNA
ccagtggaggctgtgcgcaaaatcaggcccagagccatggtttctttggcctgtaaagtgttaaaaaatgagattggtgggggaggagccaagatggacgaat

SEQ ID NO: 45800 - DNA, 30 bp, Homo sapiens
  misc_feature 1..30: note = chr19:29920756-29920786
  misc_feature 1..30: note = hypo
  source 1..30: mol_type = genomic DNA
tcccccgccgcccgccgtcaggggttactt

SEQ ID NO: 45801 - DNA, 49 bp, Homo sapiens
  misc_feature 1..49: note = chr19:29930941-29930990
  misc_feature 1..49: note = hypo
  source 1..49: mol_type = genomic DNA
cgggaactggggctgcgcggctctcgggggccagcgtgagttccaggtg

SEQ ID NO: 45802 - DNA, 45 bp, Homo sapiens
  misc_feature 1..45: note = chr19:30056272-30056317
  misc_feature 1..45: note = hypo
  source 1..45: mol_type = genomic DNA
gcacttgtcctctaacgtgacgactcgcagcgttcacatcagcaa

SEQ ID NO: 45803 - DNA, 30 bp, Homo sapiens
  misc_feature 1..30: note = chr19:30244714-30244744
  misc_feature 1..30: note = hypo
  source 1..30: mol_type = genomic DNA
ggctgagcgtgggagcgaggaccccgcttt

SEQ ID NO: 45804 - DNA, 388 bp, Homo sapiens
  misc_feature 1..388: note = chr19:30555329-30555717
  misc_feature 1..388: note = hypo
  source 1..388: mol_type = genomic DNA
gcccagcccccaccccgtggcacctgcccacgcggcacctgcccagggcggcccactgtgctcccggcagccctcctgacgtcaacggcagccgcggggacgctgcctcctctgccacacgttgctcacaaagtgtaggcaaaaggcaggcgtccaattgctgcggatgaggaagagaaataatttcgtttctaaatcaggactcagtaccggtggccaggccccggaaggggcatctgtcggctgcacggcagccactcctgcaatggaggagatggtccagttctccatggggacttggggggctccccagctctggccctgggtgccgaaagccctgagaacaagccatctgaaaattaggattctgcgtcgcctgtcaatcccc

SEQ ID NO: 45805 - DNA, 30 bp, Homo sapiens
  misc_feature 1..30: note = chr19:30562726-30562756
  misc_feature 1..30: note = hypo
  source 1..30: mol_type = genomic DNA
ggagaagctaatattcgccttttacaaaca

SEQ ID NO: 45806 - DNA, 184 bp, Homo sapiens
  misc_feature 1..184: note = chr19:30579049-30579233
  misc_feature 1..184: note = hypo
  source 1..184: mol_type = genomic DNA
gagactaagagggagcgtagacaaggagccacaggaggcgacactcccggtggtggattcctgcctaagttccagggaactcagaatctgggggccacgctggcaacatctgtctcttggcttcccaaagaaagactaacatgccagcaaagccaggaaatgtcaagaccgagagctcatgtgg

SEQ ID NO: 45807 - DNA, 33 bp, Homo sapiens
  misc_feature 1..33: note = chr19:30636005-30636038
  misc_feature 1..33: note = hypo
  source 1..33: mol_type = genomic DNA
tctgaggggtgccctcgccgggggtgccaccac

SEQ ID NO: 45808 - DNA, 64 bp, Homo sapiens
  misc_feature 1..64: note = chr19:30637506-30637570
  misc_feature 1..64: note = hypo
  source 1..64: mol_type = genomic DNA
cagcgagactcgatgcgaaggcaaggcaagcacgtgacatccagtactacgtgaggtgctgaca

SEQ ID NO: 45809 - DNA, 45 bp, Homo sapiens
  misc_feature 1..45: note = chr19:31017337-31017382
  misc_feature 1..45: note = hypo
  source 1..45: mol_type = genomic DNA
aacaggttcaggggccgggcgcggtggctcacgcctgtaatccca

SEQ ID NO: 45810 - DNA, 205 bp, Homo sapiens
  misc_feature 1..205: note = chr19:31587355-31587560
  misc_feature 1..205: note = hypo
  source 1..205: mol_type = genomic DNA
acgggagcaaagctccgtattttagtctcagtacaaatttgcttcaatcttatacaactcccatgcagcattgcccacagctgcatgctgtaaacaacaaacaaatctatttccatcagccctgctgatgccaggagaaaagtgcctgagcagaagacatgcacagatgcaaaccctcacctgagcctggcgctgccctccattt

SEQ ID NO: 45811 - DNA, 138 bp, Homo sapiens
  misc_feature 1..138: note = chr19:31780548-31780686
  misc_feature 1..138: note = hypo
  source 1..138: mol_type = genomic DNA
cccaggggtggggttcggagccagatgccctgcagcacggttctggctggggcggcacctcagacactggctctcagattggctgccactgtccctgtagcccctagcccccaagctgggccgcgttctcctccaggc

SEQ ID NO: 45812 - DNA, 30 bp, Homo sapiens
  misc_feature 1..30: note = chr19:32026024-32026054
  misc_feature 1..30: note = hypo
  source 1..30: mol_type = genomic DNA
tgcattacaagagagcgtgagctaacaaag

SEQ ID NO: 45813 - DNA, 59 bp, Homo sapiens
  misc_feature 1..59: note = chr19:32083683-32083742
  misc_feature 1..59: note = hypo
  source 1..59: mol_type = genomic DNA
tgatggctctactgccgtccacccgggaggatggacgtgtgttccgggatatcagagct

SEQ ID NO: 45814 - DNA, 32 bp, Homo sapiens
  misc_feature 1..32: note = chr19:32232273-32232305
  misc_feature 1..32: note = hypo
  source 1..32: mol_type = genomic DNA
agaggaaaatgaggccgcgtagccacaatgcc

SEQ ID NO: 45815 - DNA, 181 bp, Homo sapiens
  misc_feature 1..181: note = chr19:32364365-32364546
  misc_feature 1..181: note = hypo
  source 1..181: mol_type = genomic DNA
gcagccctatggccccgggcatgcgcttctcttcttcctacatgaaagccctccttacaagccttccttgtaccctatggctccaggatctggccccttcacctccccagagtcagagttaccacggtgcagtggcgcaccagtgggcctccggcaatgctgctcccgcttcccaccttcc

SEQ ID NO: 45816 - DNA, 53 bp, Homo sapiens
  misc_feature 1..53: note = chr19:32516351-32516404
  misc_feature 1..53: note = hypo
  source 1..53: mol_type = genomic DNA
aactcccctgcggcccgtccctgcctcaccgcatggcccggctttgcagtgca

SEQ ID NO: 45817 - DNA, 89 bp, Homo sapiens
  misc_feature 1..89: note = chr19:32672320-32672409
  misc_feature 1..89: note = hypo
  source 1..89: mol_type = genomic DNA
ctatgacaaattaagcggctggtgagtgcgcttgcacacaaaagaatggtgccgaaaactagggctgagctaggcgctgtgtcaataaa

SEQ ID NO: 45818 - DNA, 81 bp, Homo sapiens
  misc_feature 1..81: note = chr19:32718922-32719003
  misc_feature 1..81: note = hypo
  source 1..81: mol_type = genomic DNA
ctgcagcagggaggccgattcaggaggtcactgcacgagctgtgcctggcctggagtggcctggtgcggggaacctggcgg

SEQ ID NO: 45819 - DNA, 89 bp, Homo sapiens
  misc_feature 1..89: note = chr19:32835111-32835200
  misc_feature 1..89: note = hypo
  source 1..89: mol_type = genomic DNA
tctcttaccttttatcgaaaaaaaaattactcaacattttattttttcacagctatttggtctaattggcaaaggattctgtggaatag

SEQ ID NO: 45820 - DNA, 30 bp, Homo sapiens
  misc_feature 1..30: note = chr19:32898460-32898490
  misc_feature 1..30: note = hypo
  source 1..30: mol_type = genomic DNA
ttacgtgacgcattgcgtggtaactgctat

SEQ ID NO: 45821 - DNA, 16 bp, Homo sapiens
  misc_feature 1..16: note = chr19:33143466-33143482
  misc_feature 1..16: note = hypo
  source 1..16: mol_type = genomic DNA
gcgaaactccatcccg

SEQ ID NO: 45822 - DNA, 156 bp, Homo sapiens
  misc_feature 1..156: note = chr19:33415273-33415429
  misc_feature 1..156: note = hypo
  source 1..156: mol_type = genomic DNA
ccattagccacaacacgaggtctgtcgctgggccggttttgatgcctaacagtctatgtctgtttcagctcccaacagtctgtgtgtgtgacacttcagctgagcctcctccatcagggcttttccagcttccgtgtcctgcgctgtcctttggtg

SEQ ID NO: 45823 - DNA, 43 bp, Homo sapiens
  misc_feature 1..43: note = chr19:33468025-33468068
  misc_feature 1..43: note = hypo
  source 1..43: mol_type = genomic DNA
atggagcccgtgggtcgtcctgccttagcgtctgagttcagct

SEQ ID NO: 45824 - DNA, 75 bp, Homo sapiens
  misc_feature 1..75: note = chr19:33557281-33557356
  misc_feature 1..75: note = hypo
  source 1..75: mol_type = genomic DNA
gctgggattacaggcgtgagccaccgcacccggccgtggagcacggttcttaaccacctccgttttctaggctgc

SEQ ID NO: 45825 - DNA, 18 bp, Homo sapiens
  misc_feature 1..18: note = chr19:33557746-33557764
  misc_feature 1..18: note = hypo
  source 1..18: mol_type = genomic DNA
aaaaaaaaaaaagtccgg

SEQ ID NO: 45826 - DNA, 30 bp, Homo sapiens
  misc_feature 1..30: note = chr19:33908049-33908079
  misc_feature 1..30: note = hypo
  source 1..30: mol_type = genomic DNA
ccaagctatgtgcctcgagcatgggtgggg

SEQ ID NO: 45827 - DNA, 40 bp, Homo sapiens
  misc_feature 1..40: note = chr19:34263232-34263272
  misc_feature 1..40: note = hypo
  source 1..40: mol_type = genomic DNA
cgtgtcccgtatcttcgtggaggaccgccaccgcgtgctc

SEQ ID NO: 45828 - DNA, 30 bp, Homo sapiens; identical to SEQ ID NO: 16489
  misc_feature 1..30: note = chr19:34263853-34263883
  misc_feature 1..30: note = hypo
  source 1..30: mol_type = genomic DNA

SEQ ID NO: 45829 - DNA, 34 bp, Homo sapiens
  misc_feature 1..34: note = chr19:34558340-34558374
  misc_feature 1..34: note = hypo
  source 1..34: mol_type = genomic DNA
aggcatgagtcactgcgcccggcatcctttttat

SEQ ID NO: 45830 - DNA, 39 bp, Homo sapiens
  misc_feature 1..39: note = chr19:34896321-34896360
  misc_feature 1..39: note = hypo
  source 1..39: mol_type = genomic DNA
attacaggcatgagccaccgcgcccggcctttcttaagg

SEQ ID NO: 45831 - DNA, 16 bp, Homo sapiens
  misc_feature 1..16: note = chr19:35497210-35497226
  misc_feature 1..16: note = hypo
  source 1..16: mol_type = genomic DNA
gcgactctttgtctcc

SEQ ID NO: 45832 - DNA, 33 bp, Homo sapiens
  misc_feature 1..33: note = chr19:35524590-35524623
  misc_feature 1..33: note = hypo
  source 1..33: mol_type = genomic DNA
cgagcacaacaccagcgtcgtcaagaagatcca

SEQ ID NO: 45833 - DNA, 30 bp, Homo sapiens
  misc_feature 1..30: note = chr19:35607399-35607429
  misc_feature 1..30: note = hypo
  source 1..30: mol_type = genomic DNA
gagccaggagataaacggaagtcccttccc

SEQ ID NO: 45834 - DNA, 30 bp, Homo sapiens
  misc_feature 1..30: note = chr19:35608942-35608972
  misc_feature 1..30: note = hypo
  source 1..30: mol_type = genomic DNA
ggaagtgccagctctcgctatcaaaattat

SEQ ID NO: 45835 - DNA, 54 bp, Homo sapiens
  misc_feature 1..54: note = chr19:35615955-35616009
  misc_feature 1..54: note = hypo
  source 1..54: mol_type = genomic DNA
ggcttaaggcctagacgtgtggctgatgaacgtggcccacggtcagcagctcac

SEQ ID NO: 45836 - DNA, 221 bp, Homo sapiens
  misc_feature 1..221: note = chr19:35616256-35616477
  misc_feature 1..221: note = hypo
  source 1..221: mol_type = genomic DNA
ttgtcaggctcaaggcggaggacctggctgaaggcgaagtcgctgcctaggatggccagctggtccctggcgatgagcagtggctggaagacgtgggcaccgcgcgagggaagttgctgcagcagacgaaacatggagccgtcccagcgcatgacctgtgggggtgtggccagtgagggcctggggtcccgggggtctctgggggccgtggaacagcttgg

SEQ ID NO: 45837 - DNA, 261 bp, Homo sapiens
  misc_feature 1..261: note = chr19:35781223-35781484
  misc_feature 1..261: note = hypo
  source 1..261: mol_type = genomic DNA
ccgtgcatggcctcaattccggtttttaagccacccagtttgtgaaactttgttgtaacagccctggaaaactgatacacctgctctctcgtaaaagatcagctgatacggcagcaccggccactggatctgcgggtcagttgtccccttagacagggcacctgcccgccagtcacaggtcctgtcacccagccccttcctctcatgggctccagccgcctcgctcccacaggtctcctggagacccgagttgctgatgtc

SEQ ID NO: 45838 - DNA, 56 bp, Homo sapiens
  misc_feature 1..56: note = chr19:35797909-35797965
  misc_feature 1..56: note = hypo
  source 1..56: mol_type = genomic DNA
aaaagatactaagcacgtgcaccggcagggtgtcggcgttccgccgacatccaggt

SEQ ID NO: 45839 - DNA, 156 bp, Homo sapiens
  misc_feature 1..156: note = chr19:35827208-35827364
  misc_feature 1..156: note = hypo
  source 1..156: mol_type = genomic DNA
tcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagcc

SEQ ID NO: 45840 - DNA, 35 bp, Homo sapiens
  misc_feature 1..35: note = chr19:35842975-35843010
  misc_feature 1..35: note = hypo
  source 1..35: mol_type = genomic DNA
ggacccggcctctgccggcccggcccgcttcagcc

SEQ ID NO: 45841 - DNA, 30 bp, Homo sapiens
  misc_feature 1..30: note = chr19:35921023-35921053
  misc_feature 1..30: note = hypo
  source 1..30: mol_type = genomic DNA
gtggcttgacttattcgccaagtggagatt

SEQ ID NO: 45842 - DNA, 195 bp, Homo sapiens
  misc_feature 1..195: note = chr19:35940942-35941137
  misc_feature 1..195: note = hypo
  source 1..195: mol_type = genomic DNA
gggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttgga

SEQ ID NO: 45843 - DNA, 30 bp, Homo sapiens
  misc_feature 1..30: note = chr19:36199677-36199707
  misc_feature 1..30: note = hypo
  source 1..30: mol_type = genomic DNA
acttaaccagaaagacggaacatctttttt

SEQ ID NO: 45844 - DNA, 417 bp, Homo sapiens
  misc_feature 1..417: note = chr19:36221572-36221989
  misc_feature 1..417: note = hypo
  source 1..417: mol_type = genomic DNA
cccaagcatcctaaccgtcttatcccacatgccaggtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcaggtgtggctttggctctgtcttcttcctgaataccgctctccctaaacaaacctacagatctctgttccccgctcccttttggaaagtccaggaggcttgcttttgcttcagttgctgtaatgtaacggcagctcgcttactgccatgccttgtgtgccaggggctgtgcccggcttttcatgggaagtgaggtggggagagcggcacgctgcctacttgag

SEQ ID NO: 45845 - DNA, 50 bp, Homo sapiens; identical to SEQ ID NO: 16495
  misc_feature 1..50: note = chr19:36222432-36222482
  misc_feature 1..50: note = hypo
  source 1..50: mol_type = genomic DNA

SEQ ID NO: 45846 - DNA, 277 bp, Homo sapiens
  misc_feature 1..277: note = chr19:36249972-36250249
  misc_feature 1..277: note = hypo
  source 1..277: mol_type = genomic DNA
gtctggaatgggaaccgcgcgcctgtaacgttgaaaagcccctcctagactggatccagggttgagaaccaccggctgtcagttcctgagttgctccctgttaagactgctccaggggcgggctcccaggactcacccttccactgtcgatatcctgaatgtgcaacggtgcttcatggaaatgacagtccgtctcctccaggaatctatgggaattgtctggttctgccctcctctaatgtccccctccccagggctgcggcgaaaccacgtgctg

SEQ ID NO: 45847 - DNA, 339 bp, Homo sapiens
  misc_feature 1..339: note = chr19:36604439-36604778
  misc_feature 1..339: note = hypo
  source 1..339: mol_type = genomic DNA
acagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaatgatgcatggttaggaaggatttggacccagcagcgccttaccccaaaa

SEQ ID NO: 45848 - DNA, 150 bp, Homo sapiens
  misc_feature 1..150: note = chr19:36640992-36641142
  misc_feature 1..150: note = hypo
  source 1..150: mol_type = genomic DNA
tgcacacacccactccgtaacctctcccctgtacctgtgccaagcctagcacttgtgatgcctccatgccccgagggccctctctcagttctgggaggatgactccagtccctgcacgccctggcacacccttcacggttgctacccagg

SEQ ID NO: 45849 - DNA, 196 bp, Homo sapiens
  misc_feature 1..196: note = chr19:36704661-36704857
  misc_feature 1..196: note = hypo
  source 1..196: mol_type = genomic DNA
ggcctcccaaagggctgatgtgagccaccacacccggccctacatccactcctgagacacaggacacaatcacagacacctctatacctttccagtcacaatatctttccagtcacaatcacacacccgctaagacacacccagtcacacaatctactctccactgtgatacagttactcccgtatagtcacaagc

SEQ ID NO: 45850 - DNA, 101 bp, Homo sapiens
  misc_feature 1..101: note = chr19:36747803-36747904
  misc_feature 1..101: note = hypo
  source 1..101: mol_type = genomic DNA
aatgtggcttggattcgggcgcaggccctgtctcgcaggttttcaggtgcgcttggcttttcctcagctttgttgcggaggtctcccgtggcccccgggcg

SEQ ID NO: 45851 - DNA, 30 bp, Homo sapiens
  misc_feature 1..30: note = chr19:37110908-37110938
  misc_feature 1..30: note = hypo
  source 1..30: mol_type = genomic DNA
aggagtgagccactgcgcctggcctgagag

SEQ ID NO: 45852 - DNA, 91 bp, Homo sapiens
  misc_feature 1..91: note = chr19:37702078-37702169
  misc_feature 1..91: note = hypo
  source 1..91: mol_type = genomic DNA
cgtgagccaccgcctccggctgttatatttacaatacctaagttaccccttggttacggcacactgcagaaaacaacgatttactaggaga

SEQ ID NO: 45853 - DNA, 98 bp, Homo sapiens
  misc_feature 1..98: note = chr19:38228271-38228369
  misc_feature 1..98: note = hypo
  source 1..98: mol_type = genomic DNA
gaagggtagagtttcaagaatttgaggacatatttttaaaacaccacgactggcattctgagtacaaattgcttatatttctacgtcatgcaaaatat

SEQ ID NO: 45854 - DNA, 36 bp, Homo sapiens; identical to SEQ ID NO: 16499
  misc_feature 1..36: note = chr19:38481038-38481074
  misc_feature 1..36: note = hypo
  source 1..36: mol_type = genomic DNA

SEQ ID NO: 45855 - DNA, 30 bp, Homo sapiens
  misc_feature 1..30: note = chr19:38782535-38782565
  misc_feature 1..30: note = hypo
  source 1..30: mol_type = genomic DNA
atggtctacctgatccgggtggcacggagg

SEQ ID NO: 45856 - DNA, 214 bp, Homo sapiens
  misc_feature 1..214: note = chr19:38828121-38828335
  misc_feature 1..214: note = hypo
  source 1..214: mol_type = genomic DNA
actcacccatcgacccgagcgaggtgaggggaccagggtcaagtgaaccagagggattttgaacccgcactccactcatttctggacgtgtggcctaacctctctttgcagaaatacctgggcttcccttactacctgaagatcaactactcctgcgaggaaaaggtgagtgggtgcagcacggataggctcattctatgagccttggttttcc

SEQ ID NO: 45857 - DNA, 230 bp, Homo sapiens
  misc_feature 1..230: note = chr19:38873935-38874165
  misc_feature 1..230: note = hypo
  source 1..230: mol_type = genomic DNA
gccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaag

SEQ ID NO: 45858 - DNA, 184 bp, Homo sapiens
  misc_feature 1..184: note = chr19:38905548-38905732
  misc_feature 1..184: note = hypo
  source 1..184: mol_type = genomic DNA
accagctcctgcagccgcaggtagaggttgttcagcttgggtaggtgcaggcggccgtcaggcaacctgtcgggctgtgcctcatgcagggacaccaggtccttgaggtgcacgcccagtacaggcagccggaaacccgcgcagccagcccaggtgcggcggtagcgggcgtagttgttgtggg

SEQ ID NO: 45859 - DNA, 112 bp, Homo sapiens
  misc_feature 1..112: note = chr19:38934459-38934571
  misc_feature 1..112: note = hypo
  source 1..112: mol_type = genomic DNA
ggtgtgaaggggccccgcagcagggattcagggggtagaaggtctgcagaacgccaaggcaagcatgagactaccctggggacatgaatgggggcttcgtagcagagagtct

SEQ ID NO: 45860 - DNA, 87 bp, Homo sapiens
  misc_feature 1..87: note = chr19:38956890-38956977
  misc_feature 1..87: note = hypo
  source 1..87: mol_type = genomic DNA
gacatcccagcgcgccgaaaccctcggctggtgccctaccgcctgctggatgaagccaccaagcgcagcaaccgggacagcctctgc

SEQ ID NO: 45861 - DNA, 30 bp, Homo sapiens; identical to SEQ ID NO: 16502
  misc_feature 1..30: note = chr19:38974232-38974262
  misc_feature 1..30: note = hypo
  source 1..30: mol_type = genomic DNA

SEQ ID NO: 45862 - DNA, 321 bp, Homo sapiens
  misc_feature 1..321: note = chr19:38976340-38976661
  misc_feature 1..321: note = hypo
  source 1..321: mol_type = genomic DNA
cgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgc

SEQ ID NO: 45863 - DNA, 145 bp, Homo sapiens
  misc_feature 1..145: note = chr19:38990607-38990752
  misc_feature 1..145: note = hypo
  source 1..145: mol_type = genomic DNA
ctatgccgccttgatcgacctgctcggacgctgtgcaccagagatgcatgtgagaccctgagccagggcaggatgggaagggagggcaggcacagccgctttgaacgcctcatgcaggcactcggtgacacggagtgagctccca

SEQ ID NO: 45864 - DNA, 53 bp, Homo sapiens
  misc_feature 1..53: note = chr19:38991499-38991552
  misc_feature 1..53: note = hypo
  source 1..53: mol_type = genomic DNA
tgccggaccacaaggcgtccatggtgctcttcctggaccgtgtgtatggcatc

SEQ ID NO: 45865 - DNA, 30 bp, Homo sapiens
  misc_feature 1..30: note = chr19:38996547-38996577
  misc_feature 1..30: note = hypo
  source 1..30: mol_type = genomic DNA
gaaaagaaaaaaacgcggaagatatcacaa

SEQ ID NO: 45866 - DNA, 80 bp, Homo sapiens
  misc_feature 1..80: note = chr19:38998362-38998442
  misc_feature 1..80: note = hypo
  source 1..80: mol_type = genomic DNA
acatggaactggactcgtcttccattgaaaagcggtttgcctttggcttcctgcagcagctgctgcgctggatggacatt

SEQ ID NO: 45867 - DNA, 41 bp, Homo sapiens
  misc_feature 1..41: note = chr19:39006715-39006756
  misc_feature 1..41: note = hypo
  source 1..41: mol_type = genomic DNA
ccgtcttccaggcttcggccagccctcggggagtgcctggc

SEQ ID NO: 45868 - DNA, 52 bp, Homo sapiens
  misc_feature 1..52: note = chr19:39071019-39071071
  misc_feature 1..52: note = hypo
  source 1..52: mol_type = genomic DNA
ccgtgggccttctggcggtggtcgtctacctgtacaccgtggtggccttcaa

SEQ ID NO: 45869 - DNA, 30 bp, Homo sapiens
  misc_feature 1..30: note = chr19:39101480-39101510
  misc_feature 1..30: note = hypo
  source 1..30: mol_type = genomic DNA
tcagttccggcaactcggggtatttgggaa

SEQ ID NO: 45870 - DNA, 21 bp, Homo sapiens
  misc_feature 1..21: note = chr19:39135433-39135454
  misc_feature 1..21: note = hypo
  source 1..21: mol_type = genomic DNA
acagggcgagactccacctcc

SEQ ID NO: 45871 - DNA, 30 bp, Homo sapiens
  misc_feature 1..30: note = chr19:39151783-39151813
  misc_feature 1..30: note = hypo
  source 1..30: mol_type = genomic DNA
tctacattcaacttgcgcctgcaaactcag

SEQ ID NO: 45872 - DNA, 30 bp, Homo sapiens
  misc_feature 1..30: note = chr19:39191735-39191765
  misc_feature 1..30: note = hypo
  source 1..30: mol_type = genomic DNA
caagctggtctccatcggggcagaaggtga

SEQ ID NO: 45873 - DNA, 42 bp, Homo sapiens
  misc_feature 1..42: note = chr19:39222079-39222121
  misc_feature 1..42: note = hypo
  source 1..42: mol_type = genomic DNA
tgtgtgaagacagaacgctcaggacagcgtctgacacgtgac

SEQ ID NO: 45874 - DNA, 30 bp, Homo sapiens
  misc_feature 1..30: note = chr19:39235148-39235178
  misc_feature 1..30: note = hypo
  source 1..30: mol_type = genomic DNA
ggctggggaaggaggcgggtttacctcggt

SEQ ID NO: 45875 - DNA, 30 bp, Homo sapiens
  misc_feature 1..30: note = chr19:39266345-39266375
  misc_feature 1..30: note = hypo
  source 1..30: mol_type = genomic DNA
tgagatatgcatcctcgatgggctcttatt

SEQ ID NO: 45876 - DNA, 30 bp, Homo sapiens
  misc_feature 1..30: note = chr19:39329609-39329639
  misc_feature 1..30: note = hypo
  source 1..30: mol_type = genomic DNA
ccatctccaccatggcggcccccggcttgc

SEQ ID NO: 45877 - DNA, 30 bp, Homo sapiens
  misc_feature 1..30: note = chr19:39329947-39329977
  misc_feature 1..30: note = hypo
  source 1..30: mol_type = genomic DNA
tctgttacacacagacgtgtgtgatctatg

SEQ ID NO: 45878 - DNA, 30 bp, Homo sapiens; identical to SEQ ID NO: 16504
  misc_feature 1..30: note = chr19:39330221-39330251
  misc_feature 1..30: note = hypo
  source 1..30: mol_type = genomic DNA

SEQ ID NO: 45879 - DNA, 19 bp, Homo sapiens
  misc_feature 1..19: note = chr19:39393000-39393019
  misc_feature 1..19: note = hypo
  source 1..19: mol_type = genomic DNA
cgcccggcctcattttatt

SEQ ID NO: 45880 - DNA, 30 bp, Homo sapiens
  misc_feature 1..30: note = chr19:39524876-39524906
  misc_feature 1..30: note = hypo
  source 1..30: mol_type = genomic DNA
tattttatttggcttcgacataacgtgagc

SEQ ID NO: 45881 - DNA, 94 bp, Homo sapiens
  misc_feature 1..94: note = chr19:39646149-39646243
  misc_feature 1..94: note = hypo
  source 1..94: mol_type = genomic DNA
aaccaagcagccctccggaggcctcgaggggaacagacagtgttcacaggagaaacagttacacctgcgagctctgcctcgggccagcctttgc

SEQ ID NO: 45882 - DNA, 30 bp, Homo sapiens
  misc_feature 1..30: note = chr19:39672405-39672435
  misc_feature 1..30: note = hypo
  source 1..30: mol_type = genomic DNA
ggaatgaatgactctcgacaggtgccggag

SEQ ID NO: 45883 - DNA, 30 bp, Homo sapiens
  misc_feature 1..30: note = chr19:39815860-39815890
  misc_feature 1..30: note = hypo
  source 1..30: mol_type = genomic DNA
ccaagggaagtggcacggacaccaacatct

SEQ ID NO: 45884 - DNA, 250 bp, Homo sapiens
  misc_feature 1..250: note = chr19:39816936-39817186
  misc_feature 1..250: note = hypo
  source 1..250: mol_type = genomic DNA
ccaagtctagggcaccgactcaaaacttagggagcttggatctgtgggcgtttataggataggttggtggaactagaggaggcggtccccagtttgtactgcctctccagggaatctccccaaacccgaagacacgtcccattgtgctgactcctcattggatagtgcagtctgttctggcctctctgattggtccttccacaatccctagctgtactccctctgcattggactgcgcctgtgagccacc

SEQ ID NO: 45885 - DNA, 19 bp, Homo sapiens
  misc_feature 1..19: note = chr19:39996557-39996576
  misc_feature 1..19: note = hypo
  source 1..19: mol_type = genomic DNA
agattaaatgcggcccggc

SEQ ID NO: 45886 - DNA, 189 bp, Homo sapiens; identical to SEQ ID NO: 16507
  misc_feature 1..189: note = chr19:40218707-40218896
  misc_feature 1..189: note = hypo
  source 1..189: mol_type = genomic DNA

SEQ ID NO: 45887 - DNA, 77 bp, Homo sapiens
  misc_feature 1..77: note = chr19:40829862-40829939
  misc_feature 1..77: note = hypo
  source 1..77: mol_type = genomic DNA
gggaagacaacagctcgcacgcccagaatcgctcccccatccccactcactttactccctgtcgtggtgtctgcctt

SEQ ID NO: 45888 - DNA, 114 bp, Homo sapiens
  misc_feature 1..114: note = chr19:40889727-40889841
  misc_feature 1..114: note = hypo
  source 1..114: mol_type = genomic DNA
gccaggggttggcagcgtcagggtgggggttgcgcttgaagaagtggtgggccttgcaggcggcgtgcaacaggtgtggcttgggcaggccctgggtttcgcagatgtagcgca

SEQ ID NO: 45889 - DNA, 30 bp, Homo sapiens
  misc_feature 1..30: note = chr19:40901793-40901823
  misc_feature 1..30: note = hypo
  source 1..30: mol_type = genomic DNA
tcgcctggcttgccacgtgatggggactct

SEQ ID NO: 45890 - DNA, 417 bp, Homo sapiens
  misc_feature 1..417: note = chr19:40902278-40902695
  misc_feature 1..417: note = hypo
  source 1..417: mol_type = genomic DNA
cgggagctgcacttccgggaggtgcacatcgggcacagccatctcgggcaccttcgggagtttcacctcagggagtttcatctcagggagcttcatctctgggacttttggaagctgcacttctgggaggtgcacatcgggcacggccatctcgggcaccttcgggagttgcacttcagggagtttcatctcaggaagtttcatctcaggcacctttggaagcttcatctcagggactttcatctctggcactttcggcagctgcacctctggaagccgcacctctggcacagccacctctgacacctctgggagtttcatctctgacactttcggcagctgtacctctggaagccgcacctccggcacagccatctctggcacctttgggagtttcatctccgacactttcagcag

SEQ ID NO: 45891 - DNA, 16 bp, Homo sapiens
  misc_feature 1..16: note = chr19:40908674-40908690
  misc_feature 1..16: note = hypo
  source 1..16: mol_type = genomic DNA
ccgtctcaaaaaaaaa

SEQ ID NO: 45892 - DNA, 31 bp, Homo sapiens; identical to SEQ ID NO: 16508
  misc_feature 1..31: note = chr19:40951175-40951206
  misc_feature 1..31: note = hypo
  source 1..31: mol_type = genomic DNA

SEQ ID NO: 45893 - DNA, 49 bp, Homo sapiens; identical to SEQ ID NO: 16509
  misc_feature 1..49: note = chr19:41062945-41062994
  misc_feature 1..49: note = hypo
  source 1..49: mol_type = genomic DNA

SEQ ID NO: 45894 - DNA, 47 bp, Homo sapiens
  misc_feature 1..47: note = chr19:41198165-41198212
  misc_feature 1..47: note = hypo
  source 1..47: mol_type = genomic DNA
atgaggtcctgtatgcggcgggccgtttcccccgacccaaagtcata

SEQ ID NO: 45895 - DNA, 30 bp, Homo sapiens
  misc_feature 1..30: note = chr19:41615907-41615937
  misc_feature 1..30: note = hypo
  source 1..30: mol_type = genomic DNA
tggcacatctatatgcggtgacatgctact

SEQ ID NO: 45896 - DNA, 120 bp, Homo sapiens
  misc_feature 1..120: note = chr19:41881467-41881587
  misc_feature 1..120: note = hypo
  source 1..120: mol_type = genomic DNA
ccactgcgcccggcccgtgagcccgtttctttatctgcaaaacagggattaaaaacaagccaacaccccttcagcactcctccgcaaaaaaacaccccaaaacaaaataggccaggcgcg

SEQ ID NO: 45897 - DNA, 40 bp, Homo sapiens
  misc_feature 1..40: note = chr19:41956303-41956343
  misc_feature 1..40: note = hypo
  source 1..40: mol_type = genomic DNA
agaaacacgtgtaggcgctcaccaaagacacctactagaa

SEQ ID NO: 45898 - DNA, 31 bp, Homo sapiens; identical to SEQ ID NO: 16511
  misc_feature 1..31: note = chr19:42202366-42202397
  misc_feature 1..31: note = hypo
  source 1..31: mol_type = genomic DNA

SEQ ID NO: 45899 - DNA, 127 bp, Homo sapiens; identical to SEQ ID NO: 16512
  misc_feature 1..127: note = chr19:42349306-42349433
  misc_feature 1..127: note = hypo
  source 1..127: mol_type = genomic DNA

SEQ ID NO: 45900 - DNA, 154 bp, Homo sapiens
  misc_feature 1..154: note = chr19:42373753-42373907
  misc_feature 1..154: note = hypo
  source 1..154: mol_type = genomic DNA
cttccctccccacagcggccgcaaactgacacctcagggacaaagagatctggacagaatcgccggacaggtaaggcctgcgtttggggtggggctgggtcccttagtcgctgcccaagcatttccaaagcccatacttcgtcaggtagactta

SEQ ID NO: 45901 - DNA, 491 bp, Homo sapiens
  misc_feature 1..491: note = chr19:42408203-42408694
  misc_feature 1..491: note = hypo
  source 1..491: mol_type = genomic DNA
gaagaaattggtccacgagggcccactgacgtggcgggtgactaaggacaaggcagtgggtgagtgccagagcagctgcctagtgcagggtgttggggcagtgagccaagggcggggagggggtcgcgcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctag

SEQ ID NO: 45902 - DNA, 30 bp, Homo sapiens
  misc_feature 1..30: note = chr19:42507833-42507863
  misc_feature 1..30: note = hypo
  source 1..30: mol_type = genomic DNA
gcctgggcaggcacacgaggggctggacca

SEQ ID NO: 45903 - DNA, 34 bp, Homo sapiens
  misc_feature 1..34: note = chr19:42579050-42579084
  misc_feature 1..34: note = hypo
  source 1..34: mol_type = genomic DNA
tttcagatggagtctcgctctgtcgcccaggcgg

SEQ ID NO: 45904 - DNA, 43 bp, Homo sapiens
  misc_feature 1..43: note = chr19:42697082-42697125
  misc_feature 1..43: note = hypo
  source 1..43: mol_type = genomic DNA
cctgcaaaagccaggcgcggtggctcacgcctgtaatcccagc

SEQ ID NO: 45905 - DNA, 71 bp, Homo sapiens
  misc_feature 1..71: note = chr19:42722668-42722739
  misc_feature 1..71: note = hypo
  source 1..71: mol_type = genomic DNA
aggctgtggtgtatgcgtgtccccttaccgcggggccttgggtgtgacggtcgccacgccccccacttagg

SEQ ID NO: 45906 - DNA, 41 bp, Homo sapiens
  misc_feature 1..41: note = chr19:42907251-42907292
  misc_feature 1..41: note = hypo
  source 1..41: mol_type = genomic DNA
catgggaagggcagtcgcctgtggagcgctgtgaaaggctg

SEQ ID NO: 45907 - DNA, 23 bp, Homo sapiens
  misc_feature 1..23: note = chr19:44599783-44599806
  misc_feature 1..23: note = hypo
  source 1..23: mol_type = genomic DNA
acaaaatgggcctggcgcggtgg

SEQ ID NO: 45908 - DNA, 38 bp, Homo sapiens
  misc_feature 1..38: note = chr19:45003229-45003267
  misc_feature 1..38: note = hypo
  source 1..38: mol_type = genomic DNA
cagcgtgggggttctcgagcctacgatacagcagctca

SEQ ID NO: 45909 - DNA, 30 bp, Homo sapiens
  misc_feature 1..30: note = chr19:45279887-45279917
  misc_feature 1..30: note = hypo
  source 1..30: mol_type = genomic DNA
tgaacgccatcctcccgcctggcttcttcg

SEQ ID NO: 45910 - DNA, 33 bp, Homo sapiens; identical to SEQ ID NO: 16517
  misc_feature 1..33: note = chr19:45381918-45381951
  misc_feature 1..33: note = hypo
  source 1..33: mol_type = genomic DNA

SEQ ID NO: 45911 - DNA, 107 bp, Homo sapiens
  misc_feature 1..107: note = chr19:45570386-45570493
  misc_feature 1..107: note = hypo
  source 1..107: mol_type = genomic DNA
tgagtgtatctagagcgccatctctgtagccggagggaggccggaatgccgctctgggacattttggagggagagtagcaggagaggagagtcgagcctgtcaccct

SEQ ID NO: 45912 - DNA, 235 bp, Homo sapiens
  misc_feature 1..235: note = chr19:45574465-45574700
  misc_feature 1..235: note = hypo
  source 1..235: mol_type = genomic DNA
gtggacatagggtgtcggcccagcatgtcccacatgggcccctttgcccagggcctctggcgacaggtccgggcctctccccgccctcgcctcagcccctgccctggcctcgcccgcactaggaactgggagcgcagctttctgtgccagtcctgctgcgccccaggcactgggggctggccgttccctcaccccctcactccaaaccggtctgtccagccgtccaccccacgga

SEQ ID NO: 45913 - DNA, 38 bp, Homo sapiens
  misc_feature 1..38: note = chr19:45575118-45575156
  misc_feature 1..38: note = hypo
  source 1..38: mol_type = genomic DNA
actcacagctgcccccgggcccgcggctcttgccccct

SEQ ID NO: 45914 - DNA, 30 bp, Homo sapiens
  misc_feature 1..30: note = chr19:45601584-45601614
  misc_feature 1..30: note = hypo
  source 1..30: mol_type = genomic DNA
gaatgacctgaggctcggctggtctcctca

SEQ ID NO: 45915 - DNA, 30 bp, Homo sapiens
  misc_feature 1..30: note = chr19:45616778-45616808
  misc_feature 1..30: note = hypo
  source 1..30: mol_type = genomic DNA
agcccctgccctgcacgatggtagcagagc

SEQ ID NO: 45916 - DNA, 30 bp, Homo sapiens; identical to SEQ ID NO: 16518
  misc_feature 1..30: note = chr19:45626698-45626728
  misc_feature 1..30: note = hypo
  source 1..30: mol_type = genomic DNA

SEQ ID NO: 45917 - DNA, 30 bp, Homo sapiens
  misc_feature 1..30: note = chr19:45627017-45627047
  misc_feature 1..30: note = hypo
  source 1..30: mol_type = genomic DNA
tttagaattttagaacgtgtttcactacat

SEQ ID NO: 45918 - DNA, 30 bp, Homo sapiens; identical to SEQ ID NO: 16519
  misc_feature 1..30: note = chr19:45709152-45709182
  misc_feature 1..30: note = hypo
  source 1..30: mol_type = genomic DNA

SEQ ID NO: 45919 - DNA, 30 bp, Homo sapiens
  misc_feature 1..30: note = chr19:45751388-45751418
  misc_feature 1..30: note = hypo
  source 1..30: mol_type = genomic DNA
ttttcaaacagagtccggtaggttttagta

SEQ ID NO: 45920 - DNA, 233 bp, Homo sapiens
  misc_feature 1..233: note = chr19:45810003-45810236
  misc_feature 1..233: note = hypo
  source 1..233: mol_type = genomic DNA
gcgcctacttctgggcggggatcatgtcgtcaatggactggcctttctccaacttcttctccatttccaccatgagcttcacaccatccaccaccagctgcacctgttctacttcggacgagcccagccgatcagcgttggacacgtcaaatactgagcccacggcagctgtgtccacgccacctgtgggagcaagggacaggggcgtgaagaggcagcgaaggtgcagaggg

SEQ ID NO: 45921 - DNA, 92 bp, Homo sapiens
  misc_feature 1..92: note = chr19:45810770-45810862
  misc_feature 1..92: note = hypo
  source 1..92: mol_type = genomic DNA
gtgcttgctcaggtgcgccagcttcacatgcacgcctccacgcagcccagtgcccaggttggatgggcaggtgagcacgtagcccaggtgct

SEQ ID NO: 45922 - DNA, 26 bp, Homo sapiens
  misc_feature 1..26: note = chr19:45835234-45835260
  misc_feature 1..26: note = hypo
  source 1..26: mol_type = genomic DNA
ggtcaacagagcgagactacgtctca

SEQ ID NO: 45923 - DNA, 201 bp, Homo sapiens
  misc_feature 1..201: note = chr19:45851193-45851394
  misc_feature 1..201: note = hypo
  source 1..201: mol_type = genomic DNA
cctaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgct

SEQ ID NO: 45924 - DNA, 235 bp, Homo sapiens
  misc_feature 1..235: note = chr19:45997416-45997651
  misc_feature 1..235: note = hypo
  source 1..235: mol_type = genomic DNA
tgcttacctagaaggcgtggctccaccgtgaattctaattggtccgtgctatcgaggcactgtccccttactggctctcgctccagtggcccccactgcttttcttcctcttccagcaatggctcttcgggcccagagttcgaatctcgcgatcgggatggggacggagtaccggcctggggtgtcccagagcccggactgagctggggagtcaagacctcgggcgatgagggct

SEQ ID NO: 45925 - DNA, 17 bp, Homo sapiens
  misc_feature 1..17: note = chr19:46144063-46144080
  misc_feature 1..17: note = hypo
  source 1..17: mol_type = genomic DNA
tccgcctcccaaactgc

SEQ ID NO: 45926 - DNA, 160 bp, Homo sapiens
  misc_feature 1..160: note = chr19:46234839-46234999
  misc_feature 1..160: note = hypo
  source 1..160: mol_type = genomic DNA
tgggattacaggcgtgagccaccgcgcccggcccgtcccctcctttcttacctcctgatttacaaatgagaaaattaagccttaggaggaaggaaagtcccatacattaggagttagtccacatcatagaatagcagctccacatcgctcgagcccagga

SEQ ID NO: 45927 - DNA, 30 bp, Homo sapiens
  misc_feature 1..30: note = chr19:46269160-46269190
  misc_feature 1..30: note = hypo
  source 1..30: mol_type = genomic DNA
agggctgggggccaccgggaggcctccctc

SEQ ID NO: 45928 - DNA, 64 bp, Homo sapiens
  misc_feature 1..64: note = chr19:46321335-46321399
  misc_feature 1..64: note = hypo
  source 1..64: mol_type = genomic DNA
gctgctgcatcaccacggccagcacctctgacgtgtacacgttccgctccgcaaagcacaggtt

SEQ ID NO: 45929 - DNA, 121 bp, Homo sapiens
  misc_feature 1..121: note = chr19:46327091-46327212
  misc_feature 1..121: note = hypo
  source 1..121: mol_type = genomic DNA
cagcaggagcagctccggggagttcatgcccattcctcggatctagaggcagagacagggatgaccagacccagggtgagagcttaggggagggtcaggtgttgcccggcagggtggcttg

SEQ ID NO: 45930 - DNA, 30 bp, Homo sapiens
  misc_feature 1..30: note = chr19:46346873-46346903
  misc_feature 1..30: note = hypo
  source 1..30: mol_type = genomic DNA
gctcggggtccaccacggagctacatttct

SEQ ID NO: 45931 - DNA, 95 bp, Homo sapiens
  misc_feature 1..95: note = chr19:46356540-46356635
  misc_feature 1..95: note = hypo
  source 1..95: mol_type = genomic DNA
ccaagtgtcccatgtcgtcttctgcctttgcacacacttctgtgccctcagcttgacatgctctccctctcttggctgggcacggtggctcgtgc

SEQ ID NO: 45932 - DNA, 125 bp, Homo sapiens
  misc_feature 1..125: note = chr19:46404522-46404647
  misc_feature 1..125: note = hypo
  source 1..125: mol_type = genomic DNA
agacactcacctgcacgtcggtcctcccggcggtcttccgacaacacgtagcgctgagggcaggcgcttgggggcggcggctgtgaagagggggccgcagggggctcctccgccccagcacctgc

SEQ ID NO: 45933 - DNA, 39 bp, Homo sapiens
  misc_feature 1..39: note = chr19:46811882-46811921
  misc_feature 1..39: note = hypo
  source 1..39: mol_type = genomic DNA
tgcctgtgacctccccgctgcccccgggcctccccagcc

SEQ ID NO: 45934 - DNA, 30 bp, Homo sapiens
  misc_feature 1..30: note = chr19:47116936-47116966
  misc_feature 1..30: note = hypo
  source 1..30: mol_type = genomic DNA
atggactgattaaaacgcagcacccgctca

SEQ ID NO: 45935 - DNA, 66 bp, Homo sapiens
  misc_feature 1..66: note = chr19:47200499-47200565
  misc_feature 1..66: note = hypo
  source 1..66: mol_type = genomic DNA
atgtttgaagagtcacgtgaaccgccagactttcctgcccagtccctatcccgtggagctgcttgg

SEQ ID NO: 45936 - DNA, 37 bp, Homo sapiens
  misc_feature 1..37: note = chr19:47284561-47284598
  misc_feature 1..37: note = hypo
  source 1..37: mol_type = genomic DNA
gaggactcccaagtccgggcgcggtggctcacgcctg

SEQ ID NO: 45937 - DNA, 44 bp, Homo sapiens; identical to SEQ ID NO: 16528
  misc_feature 1..44: note = chr19:47429440-47429484
  misc_feature 1..44: note = hypo
  source 1..44: mol_type = genomic DNA

SEQ ID NO: 45938 - DNA, 30 bp, Homo sapiens
  misc_feature 1..30: note = chr19:47593170-47593200
  misc_feature 1..30: note = hypo
  source 1..30: mol_type = genomic DNA
tggcccgggtggctccgatgccccagagga

SEQ ID NO: 45939 - DNA, 30 bp, Homo sapiens
  misc_feature 1..30: note = chr19:47633375-47633405
  misc_feature 1..30: note = hypo
  source 1..30: mol_type = genomic DNA
ttcctgttttcttaacgctcctctctccca

SEQ ID NO: 45940 - DNA, 30 bp, Homo sapiens
  misc_feature 1..30: note = chr19:47783598-47783628
  misc_feature 1..30: note = hypo
  source 1..30: mol_type = genomic DNA
ggtgaggagggtgtgcgctgattcagatct

SEQ ID NO: 45941 - DNA, 30 bp, Homo sapiens
  misc_feature 1..30: note = chr19:47847634-47847664
  misc_feature 1..30: note = hypo
  source 1..30: mol_type = genomic DNA
tgatacctgtgtctgcggtcattactccag

SEQ ID NO: 45942 - DNA, 23 bp, Homo sapiens
  misc_feature 1..23: note = chr19:47864411-47864434
  misc_feature 1..23: note = hypo
  source 1..23: mol_type = genomic DNA
atgacaatggcaggccgtcccgg

SEQ ID NO: 45943 - DNA, 47 bp, Homo sapiens
  misc_feature 1..47: note = chr19:47986518-47986565
  misc_feature 1..47: note = hypo
  source 1..47: mol_type = genomic DNA
ctctctccctcctcccgtccacgcctcactcacgggcaatagagtca

SEQ ID NO: 45944 - DNA, 42 bp, Homo sapiens; identical to SEQ ID NO: 16529
  misc_feature 1..42: note = chr19:48003498-48003540
  misc_feature 1..42: note = hypo
  source 1..42: mol_type = genomic DNA

SEQ ID NO: 45945 - DNA, 32 bp, Homo sapiens
  misc_feature 1..32: note = chr19:48003977-48004009
  misc_feature 1..32: note = hypo
  source 1..32: mol_type = genomic DNA
tgcagcctggcagaacgcgtttccagcagctg

SEQ ID NO: 45946 - DNA, 41 bp, Homo sapiens
  misc_feature 1..41: note = chr19:48106984-48107025
  misc_feature 1..41: note = hypo
  source 1..41: mol_type = genomic DNA
tagggttacgggcgtgagccactgcacggggccagggctgg

SEQ ID NO: 45947 - DNA, 30 bp, Homo sapiens
  misc_feature 1..30: note = chr19:48137321-48137351
  misc_feature 1..30: note = hypo
  source 1..30: mol_type = genomic DNA
gcatactgcacacaccgtttggcatctccc

SEQ ID NO: 45948 - DNA, 89 bp, Homo sapiens
  misc_feature 1..89: note = chr19:48151322-48151411
  misc_feature 1..89: note = hypo
  source 1..89: mol_type = genomic DNA
cgtctgccttctctccgtctccctgttttcctgttaccgtctccccgtccctctctctgtctctctgaactgctcgttccctccttgcc

SEQ ID NO: 45949 - DNA, 34 bp, Homo sapiens
  misc_feature 1..34: note = chr19:48237374-48237408
  misc_feature 1..34: note = hypo
  source 1..34: mol_type = genomic DNA
ggcaagagaggatgacgctcgaatggacatggtg

SEQ ID NO: 45950 - DNA, 25 bp, Homo sapiens
  misc_feature 1..25: note = chr19:48293267-48293292
  misc_feature 1..25: note = hypo
  source 1..25: mol_type = genomic DNA
tcactgtgcccggccacacaggcgt

SEQ ID NO: 45951 - DNA, 30 bp, Homo sapiens
  misc_feature 1..30: note = chr19:48586347-48586377
  misc_feature 1..30: note = hypo
  source 1..30: mol_type = genomic DNA
aggcgtgagccaccgcgcctggccctggct

SEQ ID NO: 45952 - DNA, 22 bp, Homo sapiens
  misc_feature 1..22: note = chr19:48614830-48614852
  misc_feature 1..22: note = hypo
  source 1..22: mol_type = genomic DNA
aagcccagcactaagcgtcatc

SEQ ID NO: 45953 - DNA, 54 bp, Homo sapiens
  misc_feature 1..54: note = chr19:48775999-48776053
  misc_feature 1..54: note = hypo
  source 1..54: mol_type = genomic DNA
ctgggcagggccagacgtgcaggatgcactggtttcttacgagaaagagctttt

SEQ ID NO: 45954 - DNA, 240 bp, Homo sapiens
  misc_feature 1..240: note = chr19:48800603-48800843
  misc_feature 1..240: note = hypo
  source 1..240: mol_type = genomic DNA
ggctcaaaatggacccggggatggcatgggggtgcctggtgggcaccaggacggtactggagccggccctctgggtgctggccaggtccacgctcagggtgccgtccagcttcgcggcggcggcggccaggtccttctggcgctgcgcctccgcctgctcctggagctccacctgcagggaaggtgaactgggccccgacacacactgaggcctggccccacccccgcaggccccactct

SEQ ID NO: 45955 - DNA, 39 bp, Homo sapiens
  misc_feature 1..39: note = chr19:48806604-48806643
  misc_feature 1..39: note = hypo
  source 1..39: mol_type = genomic DNA
atggggagatgcaggcggggagaacggtagatatgggta

SEQ ID NO: 45956 - DNA, 16 bp, Homo sapiens
  misc_feature 1..16: note = chr19:48834248-48834264
  misc_feature 1..16: note = hypo
  source 1..16: mol_type = genomic DNA
tggagtgcagtggtac

SEQ ID NO: 45957 - DNA, 30 bp, Homo sapiens
  misc_feature 1..30: note = chr19:48844484-48844514
  misc_feature 1..30: note = hypo
  source 1..30: mol_type = genomic DNA
cctcgagacaggacacgcattttggcaagc

SEQ ID NO: 45958 - DNA, 40 bp, Homo sapiens
  misc_feature 1..40: note = chr19:48902532-48902572
  misc_feature 1..40: note = hypo
  source 1..40: mol_type = genomic DNA
aggaatgggcctgggcgcggtggctcacgcctgtaatccc

SEQ ID NO: 45959 - DNA, 30 bp, Homo sapiens
  misc_feature 1..30: note = chr19:48902848-48902878
  misc_feature 1..30: note = hypo
  source 1..30: mol_type = genomic DNA
tcagaaagaaaggggcgaagtctagtggag

SEQ ID NO: 45960 - DNA, 374 bp, Homo sapiens
  misc_feature 1..374: note = chr19:49119027-49119401
  misc_feature 1..374: note = hypo
  source 1..374: mol_type = genomic DNA
tggggctggctggtacgagggataggagaagcagcccaagtgtggccaggcctggccctgcaggctgagtctggggagagggcagggctgggggcctgatactcacttggtgtggctgtgcggggttcctggggccttgccgaaatgccggtacacctctcggcccttgcgaggacctagggaaggggaaggagaaccgggtgagacagggatctggcgcccagcttctggcctcccagatccaggagggtgaaggctgccagtagccacacagctcagtccaaacccgtcgaccacgtatcactcaccggagagcaggacagtgccacagcccttaggggagtccagggccagctggtcgaaagtgaggatct

SEQ ID NO: 45961 - DNA, 23 bp, Homo sapiens
  misc_feature 1..23: note = chr19:49266813-49266836
  misc_feature 1..23: note = hypo
  source 1..23: mol_type = genomic DNA
cgagactccgtctatttaaaaaa

SEQ ID NO: 45962 - DNA, 76 bp, Homo sapiens
  misc_feature 1..76: note = chr19:49328490-49328566
  misc_feature 1..76: note = hypo
  source 1..76: mol_type = genomic DNA
tcgcaaaaaaaaaaaaaaaaaaaattgtatgatctgggtggtggtggggggcaggagtcaacgggtagagcaagtt

SEQ ID NO: 45963 - DNA, 44 bp, Homo sapiens
  misc_feature 1..44: note = chr19:49402394-49402438
  misc_feature 1..44: note = hypo
  source 1..44: mol_type = genomic DNA
aaaaaaaaaaaaaaaagagagagagagagcgggagaccagagac

SEQ ID NO: 45964 - DNA, 38 bp, Homo sapiens
  misc_feature 1..38: note = chr19:49463885-49463923
  misc_feature 1..38: note = hypo
  source 1..38: mol_type = genomic DNA
ctgggattacaggcatgagccgccgcacctggccatgt

SEQ ID NO: 45965 - DNA, 30 bp, Homo sapiens
  misc_feature 1..30: note = chr19:49482126-49482156
  misc_feature 1..30: note = hypo
  source 1..30: mol_type = genomic DNA
tgtgagcagggaagccgtgccctggggcct

SEQ ID NO: 45966 - DNA, 45 bp, Homo sapiens
  misc_feature 1..45: note = chr19:49541866-49541911
  misc_feature 1..45: note = hypo
  source 1..45: mol_type = genomic DNA
acacccagtgccccccggtccacaccccggcggcaggtcctccac

SEQ ID NO: 45967 - DNA, 30 bp, Homo sapiens
  misc_feature 1..30: note = chr19:49553727-49553757
  misc_feature 1..30: note = hypo
  source 1..30: mol_type = genomic DNA
cagctgcaggcacctcgcccaacacctcca

SEQ ID NO: 45968 - DNA, 30 bp, Homo sapiens
  misc_feature 1..30: note = chr19:49703569-49703599
  misc_feature 1..30: note = hypo
  source 1..30: mol_type = genomic DNA
ttgtaccacctgggccgcactgtcctctgc

SEQ ID NO: 45969 - DNA, 21 bp, Homo sapiens
  misc_feature 1..21: note = chr19:49890887-49890908
  misc_feature 1..21: note = hypo
  source 1..21: mol_type = genomic DNA
aaaggacaggccaggcgctgt

SEQ ID NO: 45970 - DNA, 41 bp, Homo sapiens
  misc_feature 1..41: note = chr19:49971866-49971907
  misc_feature 1..41: note = hypo
  source 1..41: mol_type = genomic DNA
ggcagcagaaaaaggcgccccaaagtcggcaggagcttgtc

SEQ ID NO: 45971 - DNA, 18 bp, Homo sapiens
  misc_feature 1..18: note = chr19:49997380-49997398
  misc_feature 1..18: note = hypo
  source 1..18: mol_type = genomic DNA
gcccggccaatttttttt

SEQ ID NO: 45972 - DNA, 31 bp, Homo sapiens; identical to SEQ ID NO: 16534
  misc_feature 1..31: note = chr19:50049718-50049749
  misc_feature 1..31: note = hypo
  source 1..31: mol_type = genomic DNA

SEQ ID NO: 45973 - DNA, 21 bp, Homo sapiens
  misc_feature 1..21: note = chr19:50050812-50050833
  misc_feature 1..21: note = hypo
  source 1..21: mol_type = genomic DNA
tttttttttggaagacgaatc

SEQ ID NO: 45974 - DNA, 20 bp, Homo sapiens
  misc_feature 1..20: note = chr19:50053089-50053109
  misc_feature 1..20: note = hypo
  source 1..20: mol_type = genomic DNA
atccacactgtagcccgtgt

SEQ ID NO: 45975 - DNA, 205 bp, Homo sapiens
  misc_feature 1..205: note = chr19:50166617-50166822
  misc_feature 1..205: note = hypo
  source 1..205: mol_type = genomic DNA
agattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgc

SEQ ID NO: 45976 - DNA, 130 bp, Homo sapiens
  misc_feature 1..130: note = chr19:50216075-50216205
  misc_feature 1..130: note = hypo
  source 1..130: mol_type = genomic DNA
ctatgtttcctcaggcggtggattcgggcctgtgagtggagctgggcgcgctggcccccagaggaaagagggggctggggggcctgcactcctgcatagtgggggtggaggggaccggagctattttctt

SEQ ID NO: 45977 - DNA, 174 bp, Homo sapiens
  misc_feature 1..174: note = chr19:50216693-50216867
  misc_feature 1..174: note = hypo
  source 1..174: mol_type = genomic DNA
gcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactcct

SEQ ID NO: 45978 - DNA, 30 bp, Homo sapiens
  misc_feature 1..30: note = chr19:50292243-50292273
  misc_feature 1..30: note = hypo
  source 1..30: mol_type = genomic DNA
tccagctgcagcacacgagggttcccagca

SEQ ID NO: 45979 - DNA, 30 bp, Homo sapiens
  misc_feature 1..30: note = chr19:50306672-50306702
  misc_feature 1..30: note = hypo
  source 1..30: mol_type = genomic DNA
gtcggccttcctcaccgtggggaagccggc

SEQ ID NO: 45980 - DNA, 120 bp, Homo sapiens
  misc_feature 1..120: note = chr19:50319641-50319761
  misc_feature 1..120: note = hypo
  source 1..120: mol_type = genomic DNA
tgagccatctcgcccggccgaagattatgttttaaaatatttactggccattcaaaattttgtgtgtgtgtttgtgtgaaactagtcaggtttctttttatttatttatttttatttttt

SEQ ID NO: 45981 - DNA, 45 bp, Homo sapiens
  misc_feature 1..45: note = chr19:50331949-50331994
  misc_feature 1..45: note = hypo
  source 1..45: mol_type = genomic DNA
tgtgtccttgggggacgcctggccagtgcccggtctcagcatccc

SEQ ID NO: 45982 - DNA, 426 bp, Homo sapiens
  misc_feature 1..426: note = chr19:50353152-50353578
  misc_feature 1..426: note = hypo
  source 1..426: mol_type = genomic DNA
aacactgatgactcccgaatttctctctccaggctatgacatcaatatctatctacattgtttagtcaacatccgaaacagaagtagggactccgtctctaacctcctacagctgtgtctatttctcctctctaccttcactcgactccgcccacactggctcccttttattccttctactttcaggatttgtctttgctgttctgtcctctttgcacacttttccagccatctggaatggcaggttgctcacaggtcgttttcttgacttcccttgcttgctaactttacctcgctatggtcatatcccatcgccctgtggatgtgcgctagttaacacttagcacagcctgtgattatgtctctccccagtggaccgtggggcctgtgagggacgtggtctgattcggtcgtcgccgagcacag

SEQ ID NO: 45983 - DNA, 30 bp, Homo sapiens
  misc_feature 1..30: note = chr19:50362485-50362515
  misc_feature 1..30: note = hypo
  source 1..30: mol_type = genomic DNA
gtccacgaagctgttcgtgggtgggggggg

SEQ ID NO: 45984 - DNA, 254 bp, Homo sapiens
  misc_feature 1..254: note = chr19:50364908-50365162
  misc_feature 1..254: note = hypo
  source 1..254: mol_type = genomic DNA
agcagcggcaggggacgcccgcggctcgggcacactggacgtacctgtgggggaaggagctggatgtgcaggccccgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcgtgtcctggggacacgagaggtcacaaac

SEQ ID NO: 45985 - DNA, 45 bp, Homo sapiens
  misc_feature 1..45: note = chr19:50395086-50395131
  misc_feature 1..45: note = hypo
  source 1..45: mol_type = genomic DNA
ggagagggtcccaggcgtgctgtgtcctcccgggggctcagtgat

SEQ ID NO: 45986 - DNA, 51 bp, Homo sapiens
  misc_feature 1..51: note = chr19:50481531-50481582
  misc_feature 1..51: note = hypo
  source 1..51: mol_type = genomic DNA
ggttccagccaactccgatgagagaaatgactactccggggagagaaaagg

SEQ ID NO: 45987 - DNA, 212 bp, Homo sapiens
  misc_feature 1..212: note = chr19:50919863-50920075
  misc_feature 1..212: note = hypo
  source 1..212: mol_type = genomic DNA
cagggggggaccacacgcgctgcaagacggtgctcacgggcaaggtgggcggcctcctggccttcgccaaacgccgcaactgctgcattggctgccgcacagtgctcagccaccagggtgagcggccctggccactgggcccccactggccctcaacctgctctgccgtcaccccagatcctagacacccaccccatcggctggcactgcca

SEQ ID NO: 45988 - DNA, 95 bp, Homo sapiens
  misc_feature 1..95: note = chr19:50926491-50926586
  misc_feature 1..95: note = hypo
  source 1..95: mol_type = genomic DNA
aaaactcaagctcagtcatttggttgaggtttgctgggtgccgggcactgcattgagactgcacatagtaagccctgcagcggcctcccaggtta

SEQ ID NO: 45989 - DNA, 115 bp, Homo sapiens
  misc_feature 1..115: note = chr19:50938597-50938712
  misc_feature 1..115: note = hypo
  source 1..115: mol_type = genomic DNA
ccttgaatctgtccccgcacagccccagggctgacccacgcctcccgtgctcccagccctcccggggctccctggcacccgcaggcagagcccagcccctcggctggcatcggct

SEQ ID NO: 45990 - DNA, 44 bp, Homo sapiens
  misc_feature 1..44: note = chr19:50947800-50947844
  misc_feature 1..44: note = hypo
  source 1..44: mol_type = genomic DNA
tggtgtactcttctacgtatcagagatataatggggagaaaaaa

SEQ ID NO: 45991 - DNA, 74 bp, Homo sapiens
  misc_feature 1..74: note = chr19:50967770-50967844
  misc_feature 1..74: note = hypo
  source 1..74: mol_type = genomic DNA
tgcaagctggaggtccgaggtgagggcgtggccatccccaacactggctgacccttgctcgggccctgtgccag

SEQ ID NO: 45992 - DNA, 35 bp, Homo sapiens
  misc_feature 1..35: note = chr19:51022774-51022809
  misc_feature 1..35: note = hypo
  source 1..35: mol_type = genomic DNA
cgtgctgtgctgtgacggtacgacctatattgcaa

SEQ ID NO: 45993 - DNA, 58 bp, Homo sapiens
  misc_feature 1..58: note = chr19:51046474-51046532
  misc_feature 1..58: note = hypo
  source 1..58: mol_type = genomic DNA
tcatgcaggtggcagcgcggcgggggacagatgacaaccaaggcggcaggtcacacgg

SEQ ID NO: 45994 - DNA, 33 bp, Homo sapiens
  misc_feature 1..33: note = chr19:51128766-51128799
  misc_feature 1..33: note = hypo
  source 1..33: mol_type = genomic DNA
ttccgcttcttcagacgccgcccctcgctgatc

SEQ ID NO: 45995 - DNA, 82 bp, Homo sapiens
  misc_feature 1..82: note = chr19:51203231-51203313
  misc_feature 1..82: note = hypo
  source 1..82: mol_type = genomic DNA
tggaggattggagggatcggggcattggagggttggaaggctcggggcattggaggattggagggctcggggcattggaggg

SEQ ID NO: 45996 - DNA, 30 bp, Homo sapiens
  misc_feature 1..30: note = chr19:51304561-51304591
  misc_feature 1..30: note = hypo
  source 1..30: mol_type = genomic DNA
tcagaaggcgggaagcgctagtgccccggg

SEQ ID NO: 45997 - DNA, 48 bp, Homo sapiens
  misc_feature 1..48: note = chr19:51340799-51340847
  misc_feature 1..48: note = hypo
  source 1..48: mol_type = genomic DNA
tgattcagatgtagccgctggagccaggtggcccgggtttgagttctg

SEQ ID NO: 45998 - DNA, 30 bp, Homo sapiens
  misc_feature 1..30: note = chr19:51684708-51684738
  misc_feature 1..30: note = hypo
  source 1..30: mol_type = genomic DNA
caggccgtgggggcgcgttacctgattgtc

SEQ ID NO: 45999 - DNA, 30 bp, Homo sapiens
  misc_feature 1..30: note = chr19:51715131-51715161
  misc_feature 1..30: note = hypo
  source 1..30: mol_type = genomic DNA
cctgtgagcaggggacgccccccatcttct

SEQ ID NO: 46000 - DNA, 40 bp, Homo sapiens
  misc_feature 1..40: note = chr19:51754542-51754582
  misc_feature 1..40: note = hypo
  source 1..40: mol_type = genomic DNA
tgggcttccagtcagcgtcagtcagcggatccttgggccg

SEQ ID NO: 46001 - DNA, 41 bp, Homo sapiens
  misc_feature 1..41: note = chr19:52086376-52086417
  misc_feature 1..41: note = hypo
  source 1..41: mol_type = genomic DNA
agattacaggcgtgagccaccgtgcccggctatgggcatct

SEQ ID NO: 46002 - DNA, 30 bp, Homo sapiens
  misc_feature 1..30: note = chr19:52091303-52091333
  misc_feature 1..30: note = hypo
  source 1..30: mol_type = genomic DNA
ttcaaagagcatcagcgaattcacacgggt

SEQ ID NO: 46003 - DNA, 82 bp, Homo sapiens
  misc_feature 1..82: note = chr19:52248361-52248443
  misc_feature 1..82: note = hypo
  source 1..82: mol_type = genomic DNA
tactgagttgttgaccgataaaggctgaggactttatataaagtatcttctttttttttttttctgagccggagtctctctc

SEQ ID NO: 46004 - DNA, 23 bp, Homo sapiens
  misc_feature 1..23: note = chr19:52512149-52512172
  misc_feature 1..23: note = hypo
  source 1..23: mol_type = genomic DNA
ggttgggaaagaggccgggcgcg

SEQ ID NO: 46005 - DNA, 137 bp, Homo sapiens
  misc_feature 1..137: note = chr19:52780320-52780457
  misc_feature 1..137: note = hypo
  source 1..137: mol_type = genomic DNA
gtgaggtcttccctgcgtgtgtggttgtggcacaggaagaaagtatgttgattctaaaccctaaacagcatatttttgacattcaggattgacttctaaagagtcatgttggccgggcgcgggggctcatacctgta

SEQ ID NO: 46006 - DNA, 149 bp, Homo sapiens
  misc_feature 1..149: note = chr19:52893581-52893730
  misc_feature 1..149: note = hypo
  source 1..149: mol_type = genomic DNA
cagtcccagggaggccgtgaactcttcctggtcctgggatcctgcagaccctgcccctctcctgactttctcctgcctttttcctccttgatcgggggcccttctgctccccaggcctccccttctcctgatatcgagtgtggggacgt

SEQ ID NO: 46007 - DNA, 25 bp, Homo sapiens
  misc_feature 1..25: note = chr19:52983447-52983472
  misc_feature 1..25: note = hypo
  source 1..25: mol_type = genomic DNA
cgtgcccagtcgattatgaatctta

SEQ ID NO: 46008 - DNA, 26 bp, Homo sapiens
  misc_feature 1..26: note = chr19:53028928-53028954
  misc_feature 1..26: note = hypo
  source 1..26: mol_type = genomic DNA
ttatttatttagagacggaatctctt

SEQ ID NO: 46009 - DNA, 39 bp, Homo sapiens
  misc_feature 1..39: note = chr19:53105829-53105868
  misc_feature 1..39: note = hypo
  source 1..39: mol_type = genomic DNA
tatgtacagatttagcgagggaagcacagtaatgaagac

SEQ ID NO: 46010 - DNA, 76 bp, Homo sapiens
  misc_feature 1..76: note = chr19:53148247-53148323
  misc_feature 1..76: note = hypo
  source 1..76: mol_type = genomic DNA
agcaaaactccatcttaaaaaaaaaaaaaaaaaaaaagggggtgcttttggcacagcgttccgtgccaatccaacc

SEQ ID NO: 46011 - DNA, 30 bp, Homo sapiens
  misc_feature 1..30: note = chr19:53225425-53225455
  misc_feature 1..30: note = hypo
  source 1..30: mol_type = genomic DNA
gaaacatactgaaaccgtttctacaaaaaa

SEQ ID NO: 46012 - DNA, 30 bp, Homo sapiens
  misc_feature 1..30: note = chr19:53299504-53299534
  misc_feature 1..30: note = hypo
  source 1..30: mol_type = genomic DNA
ctcaggaggtcctgacgatgtgtgcccaag

SEQ ID NO: 46013 - DNA, 30 bp, Homo sapiens
  misc_feature 1..30: note = chr19:53387507-53387537
  misc_feature 1..30: note = hypo
  source 1..30: mol_type = genomic DNA
cttcagatcgagtcacgctcttatcaccca

SEQ ID NO: 46014 - DNA, 30 bp, Homo sapiens
  misc_feature 1..30: note = chr19:53412458-53412488
  misc_feature 1..30: note = hypo
  source 1..30: mol_type = genomic DNA
tccatgtggaacaggcgctttgtaactttt

SEQ ID NO: 46015 - DNA, 24 bp, Homo sapiens
  misc_feature 1..24: note = chr19:53429320-53429344
  misc_feature 1..24: note = hypo
  source 1..24: mol_type = genomic DNA
ataagaagggacaatcggccaggt

SEQ ID NO: 46016 - DNA, 41 bp, Homo sapiens
  misc_feature 1..41: note = chr19:53702028-53702069
  misc_feature 1..41: note = hypo
  source 1..41: mol_type = genomic DNA
tatacagcaggtcctcgaataacgttgttttgttcaatgtc

SEQ ID NO: 46017 - DNA, 23 bp, Homo sapiens
  misc_feature 1..23: note = chr19:53728478-53728501
  misc_feature 1..23: note = hypo
  source 1..23: mol_type = genomic DNA
ttacccatgtggggccgggtgcg

SEQ ID NO: 46018 - DNA, 38 bp, Homo sapiens
  misc_feature 1..38: note = chr19:53965321-53965359
  misc_feature 1..38: note = hypo
  source 1..38: mol_type = genomic DNA
cttacagctcatgcacgagtcaccgtcataagatgttt

SEQ ID NO: 46019 - DNA, 114 bp, Homo sapiens
  misc_feature 1..114: note = chr19:54033275-54033389
  misc_feature 1..114: note = hypo
  source 1..114: mol_type = genomic DNA
aaggaagcatggtatcgacatctggcatccacttggcttctagggaggcctcaggagcttttactccactttacttggaaggtgaagtgggagcaggcacgtcacatggcaaaa

SEQ ID NO: 46020 - DNA, 21 bp, Homo sapiens
  misc_feature 1..21: note = chr19:54039855-54039876
  misc_feature 1..21: note = hypo
  source 1..21: mol_type = genomic DNA
tttaaaaattattctcgactg

SEQ ID NO: 46021 - DNA, 30 bp, Homo sapiens
  misc_feature 1..30: note = chr19:54046025-54046055
  misc_feature 1..30: note = hypo
  source 1..30: mol_type = genomic DNA
ggttaatattgattacgcagacagcgggtt

SEQ ID NO: 46022 - DNA, 39 bp, Homo sapiens
  misc_feature 1..39: note = chr19:54314338-54314377
  misc_feature 1..39: note = hypo
  source 1..39: mol_type = genomic DNA
tagcctggtgtcccacggtcctcgcgtgtccccggcctg

SEQ ID NO: 46023 - DNA, 126 bp, Homo sapiens
  misc_feature 1..126: note = chr19:54403466-54403592
  misc_feature 1..126: note = hypo
  source 1..126: mol_type = genomic DNA
gcccatgcacttctccgcaggaccgcctgtatttcgtgatggagtacgtcaccgggggagacttgatgtaccacattcaacagctgggcaagtttaaggagccccatgcagcgtgagtctcggcca

SEQ ID NO: 46024 - DNA, 44 bp, Homo sapiens
  misc_feature 1..44: note = chr19:55645710-55645754
  misc_feature 1..44: note = hypo
  source 1..44: mol_type = genomic DNA
cactttctccacatccgagctggagctctcgcatttcccaaggg

SEQ ID NO: 46025 - DNA, 16 bp, Homo sapiens
  misc_feature 1..16: note = chr19:55727832-55727848
  misc_feature 1..16: note = hypo
  source 1..16: mol_type = genomic DNA
gcgattagatcattga

SEQ ID NO: 46026 - DNA, 30 bp, Homo sapiens
  misc_feature 1..30: note = chr19:55798634-55798664
  misc_feature 1..30: note = hypo
  source 1..30: mol_type = genomic DNA
gctccacgacgtctacgagaacaagaaata

SEQ ID NO: 46027 - DNA, 58 bp, Homo sapiens
  misc_feature 1..58: note = chr19:55853009-55853067
  misc_feature 1..58: note = hypo
  source 1..58: mol_type = genomic DNA
ggggatctgtgtctgcgctgcggagcaagagcaagagctaaggcgatggctgacatgg

SEQ ID NO: 46028 - DNA, 30 bp, Homo sapiens
  misc_feature 1..30: note = chr19:55912333-55912363
  misc_feature 1..30: note = hypo
  source 1..30: mol_type = genomic DNA
ccactgccacaccaacgtggccattattct

SEQ ID NO: 46029 - DNA, 30 bp, Homo sapiens
  misc_feature 1..30: note = chr19:55927698-55927728
  misc_feature 1..30: note = hypo
  source 1..30: mol_type = genomic DNA
gcaccagatatacaccgggcactgttctgg

SEQ ID NO: 46030 - DNA, 54 bp, Homo sapiens
  misc_feature 1..54: note = chr19:55976843-55976897
  misc_feature 1..54: note = hypo
  source 1..54: mol_type = genomic DNA
agccaggatgtttcccgaaattgatgtaacaaatgaccacggctcagtacctag

SEQ ID NO: 46031 - DNA, 30 bp, Homo sapiens
  misc_feature 1..30: note = chr19:55982821-55982851
  misc_feature 1..30: note = hypo
  source 1..30: mol_type = genomic DNA
ccggaaacactgtcacggacacacccagaa

SEQ ID NO: 46032 - DNA, 39 bp, Homo sapiens
  misc_feature 1..39: note = chr19:56179648-56179687
  misc_feature 1..39: note = hypo
  source 1..39: mol_type = genomic DNA
ttgggagacatggtgcgttctccccgaggagcctctgtg

SEQ ID NO: 46033 - DNA, 79 bp, Homo sapiens
  misc_feature 1..79: note = chr19:56181818-56181897
  misc_feature 1..79: note = hypo
  source 1..79: mol_type = genomic DNA
tgcaccctgctgtcccgtgcaccctgctgtccgtgcaccctgctgtccgtgcaccctgctgtcccgtgcaccctgctgt

SEQ ID NO: 46034 - DNA, 100 bp, Homo sapiens
  misc_feature 1..100: note = chr19:56200496-56200596
  misc_feature 1..100: note = hypo
  source 1..100: mol_type = genomic DNA
gcctcatcctcaccccgccgtccctctgcgtgtcactctctgcctgtccctcactggttcagggacccccagccctctctttcttcggctctatctgacc

SEQ ID NO: 46035 - DNA, 51 bp, Homo sapiens
  misc_feature 1..51: note = chr19:56205745-56205796
  misc_feature 1..51: note = hypo
  source 1..51: mol_type = genomic DNA
aggcacctgtgaacacgcccccgctgccttcccccgcgggcctatagaccc

SEQ ID NO: 46036 - DNA, 34 bp, Homo sapiens
  misc_feature 1..34: note = chr19:56354394-56354428
  misc_feature 1..34: note = hypo
  source 1..34: mol_type = genomic DNA
gattacaggcgtcagccaccgtgcctggccttat

SEQ ID NO: 46037 - DNA, 84 bp, Homo sapiens
  misc_feature 1..84: note = chr19:56539038-56539122
  misc_feature 1..84: note = hypo
  source 1..84: mol_type = genomic DNA
cctgcagctgcaggacgtggtgggggagagcgtcgcccccttcaaccaaacgctcacaggcctgcacgccgcttttgtgtttca

SEQ ID NO: 46038 - DNA, 30 bp, Homo sapiens
  misc_feature 1..30: note = chr19:56543855-56543885
  misc_feature 1..30: note = hypo
  source 1..30: mol_type = genomic DNA
ggcctctaaagccaccgtggtctcacctcg

SEQ ID NO: 46039 - DNA, 30 bp, Homo sapiens
  misc_feature 1..30: note = chr19:56603841-56603871
  misc_feature 1..30: note = hypo
  source 1..30: mol_type = genomic DNA
caggtttcccctccacgggagataaatgtt

SEQ ID NO: 46040 - DNA, 52 bp, Homo sapiens
  misc_feature 1..52: note = chr19:56617216-56617268
  misc_feature 1..52: note = hypo
  source 1..52: mol_type = genomic DNA
aagcccgcgcgcccacggcagtcaccgcgcattcccccggccgcgcccacgg

SEQ ID NO: 46041 - DNA, 40 bp, Homo sapiens
  misc_feature 1..40: note = chr19:56686390-56686430
  misc_feature 1..40: note = hypo
  source 1..40: mol_type = genomic DNA
aaagatgtctccagccgggcgcggtggctcacgcctgtaa

SEQ ID NO: 46042 - DNA, 35 bp, Homo sapiens
  misc_feature 1..35: note = chr19:56688387-56688422
  misc_feature 1..35: note = hypo
  source 1..35: mol_type = genomic DNA
aatgcacctggcccccgcttcggaaaatgactggc

SEQ ID NO: 46043 - DNA, 30 bp, Homo sapiens
  misc_feature 1..30: note = chr19:56727704-56727734
  misc_feature 1..30: note = hypo
  source 1..30: mol_type = genomic DNA
tccccgccctccgctcgttatcgtgttgag

SEQ ID NO: 46044 - DNA, 35 bp, Homo sapiens
  misc_feature 1..35: note = chr19:56987547-56987582
  misc_feature 1..35: note = hypo
  source 1..35: mol_type = genomic DNA
gtcaacaccagacagcggggcgccacagtccatgc

SEQ ID NO: 46045 - DNA, 30 bp, Homo sapiens
  misc_feature 1..30: note = chr19:57334846-57334876
  misc_feature 1..30: note = hypo
  source 1..30: mol_type = genomic DNA
accactcggggatggcgggtcatcttcatg

SEQ ID NO: 46046 - DNA, 30 bp, Homo sapiens
  misc_feature 1..30: note = chr19:57399477-57399507
  misc_feature 1..30: note = hypo
  source 1..30: mol_type = genomic DNA
gtgcctggcccaacccgtccttcttagaag

SEQ ID NO: 46047 - DNA, 30 bp, Homo sapiens
  misc_feature 1..30: note = chr19:57477131-57477161
  misc_feature 1..30: note = hypo
  source 1..30: mol_type = genomic DNA
agaggcgtgagctaccgcacccggccggat

SEQ ID NO: 46048 - DNA, 49 bp, Homo sapiens
  misc_feature 1..49: note = chr19:57491242-57491291
  misc_feature 1..49: note = hypo
  source 1..49: mol_type = genomic DNA
tggatgggccaccctcgggggaggttctgtggtacggggtggtgcccag

SEQ ID NO: 46049 - DNA, 18 bp, Homo sapiens
  misc_feature 1..18: note = chr19:58032743-58032761
  misc_feature 1..18: note = hypo
  source 1..18: mol_type = genomic DNA
ctccgtctcaaaaaaaaa

SEQ ID NO: 46050 - DNA, 130 bp, Homo sapiens
  misc_feature 1..130: note = chr19:58046095-58046225
  misc_feature 1..130: note = hypo
  source 1..130: mol_type = genomic DNA
gttgcatttagcaagcgctgcctggatcccttgagcagagtggcatgtggagaagccaggtgaagtacctgtgtcatggatgctgagggcagtggagttcaaggtgtagcagtcacgatctggagatgtg

SEQ ID NO: 46051 - DNA, 179 bp, Homo sapiens
  misc_feature 1..179: note = chr19:58101908-58102087
  misc_feature 1..179: note = hypo
  source 1..179: mol_type = genomic DNA
tgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaatt

SEQ ID NO: 46052 - DNA, 30 bp, Homo sapiens
  misc_feature 1..30: note = chr19:58233563-58233593
  misc_feature 1..30: note = hypo
  source 1..30: mol_type = genomic DNA
aaggacagatagaaacgctgtgtggccact

SEQ ID NO: 46053 - DNA, 30 bp, Homo sapiens
  misc_feature 1..30: note = chr19:58438364-58438394
  misc_feature 1..30: note = hypo
  source 1..30: mol_type = genomic DNA
tctctagtgtgaactcgatgatgttcagtt

SEQ ID NO: 46054 - DNA, 30 bp, Homo sapiens
  misc_feature 1..30: note = chr19:58447467-58447497
  misc_feature 1..30: note = hypo
  source 1..30: mol_type = genomic DNA
gtgcaaaagtaattgcggtttttgccatga

SEQ ID NO: 46055 - DNA, 30 bp, Homo sapiens
  misc_feature 1..30: note = chr19:58448066-58448096
  misc_feature 1..30: note = hypo
  source 1..30: mol_type = genomic DNA
cgtatgttaaattatcgagcttgttatctt

SEQ ID NO: 46056 - DNA, 190 bp, Homo sapiens
  misc_feature 1..190: note = chr19:58457382-58457572
  misc_feature 1..190: note = hypo
  source 1..190: mol_type = genomic DNA
cctgagtgtcctatgcgtttgcatccatctcatgtccattcttctcttgggagccgtggccactgccaaactacactgtcttttacataccttgccttcatgaccacttactctatcatcatcctcccagtcttggcccactaacagctttacaaccaaaacctggagcttgccccgcctaactgtgacc

SEQ ID NO: 46057 - DNA, 30 bp, Homo sapiens
  misc_feature 1..30: note = chr19:58512170-58512200
  misc_feature 1..30: note = hypo
  source 1..30: mol_type = genomic DNA
aagaggaggctgactcgctaatgggcacta

SEQ ID NO: 46058 - DNA, 75 bp, Homo sapiens
  misc_feature 1..75: note = chr19:58517427-58517502
  misc_feature 1..75: note = hypo
  source 1..75: mol_type = genomic DNA
gactaagacaacccccgagataggaaggggtaaggtaaatgcaatgagagttggggttttcgatcttagtccagt

SEQ ID NO: 46059 - DNA, 41 bp, Homo sapiens
  misc_feature 1..41: note = chr19:58536175-58536216
  misc_feature 1..41: note = hypo
  source 1..41: mol_type = genomic DNA
gtcaggaggccccagcggggcggggccgtgtggaggctggc

SEQ ID NO: 46060 - DNA, 157 bp, Homo sapiens
  misc_feature 1..157: note = chr19:58836900-58837057
  misc_feature 1..157: note = hypo
  source 1..157: mol_type = genomic DNA
ccaacctctatgtatcgggccccaagccagagtctcctgctcaatgtctcttacacatacacacacacacagagaagatacattctcacacacagtccaggcatcgactgaatcacacaatcacactaccattcacagtcaccgtaacaacatcaca

SEQ ID NO: 46061 - DNA, 120 bp, Homo sapiens
  misc_feature 1..120: note = chr19:58874839-58874959
  misc_feature 1..120: note = hypo
  source 1..120: mol_type = genomic DNA
aaaaaaaaaaaaaaaattgagtcgggatctcagaagctaagcagggtcgggcctggttagtacttgggagaccgtctgggaacaccgagtgctgttggctaaaataaataaataaaccgg

SEQ ID NO: 46062 - DNA, 75 bp, Homo sapiens
  misc_feature 1..75: note = chr19:58891154-58891229
  misc_feature 1..75: note = hypo
  source 1..75: mol_type = genomic DNA
catggaggttgcacacggcacaatgaggtcttatttgcccaagagaatgtgcagggaagtcgccaggcacggtgg

SEQ ID NO: 46063 - DNA, 38 bp, Homo sapiens
  misc_feature 1..38: note = chr19:58964230-58964268
  misc_feature 1..38: note = hypo
  source 1..38: mol_type = genomic DNA
gtgggaaagaaattgcgggagcgctgagatcgagacca

SEQ ID NO: 46064 - DNA, 20 bp, Homo sapiens
  misc_feature 1..20: note = chr20:277026-277046
  misc_feature 1..20: note = hypo
  source 1..20: mol_type = genomic DNA
gctaccggccgggcgcggtg

SEQ ID NO: 46065 - DNA, 186 bp, Homo sapiens
  misc_feature 1..186: note = chr20:399939-400125
  misc_feature 1..186: note = hypo
  source 1..186: mol_type = genomic DNA
gtggaccaagtgggccgcgtggaaccaccaccctttaaccctcctccacagatctgggcttcaaggacctcacgctgcagccgcggggccctctggagccaggccccccaaagcccggggtcccccaggaacccggacgggggcagccagatgcagtgcctgagcccccaccggtaagctgtcctt

SEQ ID NO: 46066 - DNA, 1122 bp, Homo sapiens
  misc_feature 1..1122: note = chr20:401049-402171
  misc_feature 1..1122: note = hypo
  source 1..1122: mol_type = genomic DNA
ccccactcctgttcccgtctcagctcctcggcttcgtcacttccccacccctgacgttgagtggctccaccagccctggcccgggccctgccctgctacctgactcaccactcagaccccggcccccttccttaccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtct

SEQ ID NO: 46067 - DNA, 143 bp, Homo sapiens
  misc_feature 1..143: note = chr20:741900-742043
  misc_feature 1..143: note = hypo
  source 1..143: mol_type = genomic DNA
agaggtgcagagtcacggggcttgcggggcgagcgccggagcaaagaactctcacagggctcaggggaacccacggaatactctctaggtgcgaggagcgccttctgggagtgagcctgcggggccgacgggtcccatgagtt

SEQ ID NO: 46068 - DNA, 45 bp, Homo sapiens
  misc_feature 1..45: note = chr20:799104-799149
  misc_feature 1..45: note = hypo
  source 1..45: mol_type = genomic DNA
gagtgaggggtggggcgtagtttcagattttttttttttttttga

SEQ ID NO: 46069 - DNA, 44 bp, Homo sapiens
  misc_feature 1..44: note = chr20:799689-799733
  misc_feature 1..44: note = hypo
  source 1..44: mol_type = genomic DNA
gccgggatcacaggcgtgagccaccgcgccgggcccagcttctg

SEQ ID NO: 46070 - DNA, 41 bp, Homo sapiens; identical to SEQ ID NO: 16556
  misc_feature 1..41: note = chr20:1323452-1323493
  misc_feature 1..41: note = hypo
  source 1..41: mol_type = genomic DNA

SEQ ID NO: 46071 - DNA, 30 bp, Homo sapiens; identical to SEQ ID NO: 16557
  misc_feature 1..30: note = chr20:1692274-1692304
  misc_feature 1..30: note = hypo
  source 1..30: mol_type = genomic DNA

SEQ ID NO: 46072 - DNA, 30 bp, Homo sapiens
  misc_feature 1..30: note = chr20:2058766-2058796
  misc_feature 1..30: note = hypo
  source 1..30: mol_type = genomic DNA
gtgagccaccgcgcccggcctgtgtacaca

SEQ ID NO: 46073 - DNA, 147 bp, Homo sapiens; identical to SEQ ID NO: 5237
  misc_feature 1..147: note = chr20:2113428-2113575
  misc_feature 1..147: note = hypo
  source 1..147: mol_type = genomic DNA

SEQ ID NO: 46074 - DNA, 41 bp, Homo sapiens
  misc_feature 1..41: note = chr20:2444391-2444432
  misc_feature 1..41: note = hypo
  source 1..41: mol_type = genomic DNA
cctgttgggatggcccgccaaccccacggactggcccagca

SEQ ID NO: 46075 - DNA, 32 bp, Homo sapiens; identical to SEQ ID NO: 16560
  misc_feature 1..32: note = chr20:2645508-2645540
  misc_feature 1..32: note = hypo
  source 1..32: mol_type = genomic DNA

SEQ ID NO: 46076 - DNA, 30 bp, Homo sapiens
  misc_feature 1..30: note = chr20:3001373-3001403
  misc_feature 1..30: note = hypo
  source 1..30: mol_type = genomic DNA
ttgatcctagggtatcgggtgtcatgatca

SEQ ID NO: 46077 - DNA, 43 bp, Homo sapiens; identical to SEQ ID NO: 1636
  misc_feature 1..43: note = chr20:3027758-3027801
  misc_feature 1..43: note = hypo
  source 1..43: mol_type = genomic DNA

SEQ ID NO: 46078 - DNA, 30 bp, Homo sapiens
  misc_feature 1..30: note = chr20:3202086-3202116
  misc_feature 1..30: note = hypo
  source 1..30: mol_type = genomic DNA
catctggcttgtccacggagttcagggtac

SEQ ID NO: 46079 - DNA, 91 bp, Homo sapiens; identical to SEQ ID NO: 16562
  misc_feature 1..91: note = chr20:3202418-3202509
  misc_feature 1..91: note = hypo
  source 1..91: mol_type = genomic DNA

SEQ ID NO: 46080 - DNA, 95 bp, Homo sapiens
  misc_feature 1..95: note = chr20:3204880-3204975
  misc_feature 1..95: note = hypo
  source 1..95: mol_type = genomic DNA
gtcctcgaccccactcggcgtgatcgccacagttcagcctgcgggctgcaggcccctcgggaggccctgcttatgccacacgcccttactctgtg

SEQ ID NO: 46081 - DNA, 30 bp, Homo sapiens
  misc_feature 1..30: note = chr20:3729991-3730021
  misc_feature 1..30: note = hypo
  source 1..30: mol_type = genomic DNA
atccttggcccctaccgggcaccatatact

SEQ ID NO: 46082 - DNA, 30 bp, Homo sapiens; identical to SEQ ID NO: 16564
  misc_feature 1..30: note = chr20:3763473-3763503
  misc_feature 1..30: note = hypo
  source 1..30: mol_type = genomic DNA

SEQ ID NO: 46083 - DNA, 34 bp, Homo sapiens
  misc_feature 1..34: note = chr20:3764967-3765001
  misc_feature 1..34: note = hypo
  source 1..34: mol_type = genomic DNA
gggagaggcactctccggccgggaacctccaggg

SEQ ID NO: 46084 - DNA, 105 bp, Homo sapiens; identical to SEQ ID NO: 16565
  misc_feature 1..105: note = chr20:3820924-3821029
  misc_feature 1..105: note = hypo
  source 1..105: mol_type = genomic DNA

SEQ ID NO: 46085 - DNA, 17 bp, Homo sapiens
  misc_feature 1..17: note = chr20:4657798-4657815
  misc_feature 1..17: note = hypo
  source 1..17: mol_type = genomic DNA
tccgtctaaaaaaaaaa

SEQ ID NO: 46086 - DNA, 30 bp, Homo sapiens
  misc_feature 1..30: note = chr20:4677123-4677153
  misc_feature 1..30: note = hypo
  source 1..30: mol_type = genomic DNA
aaccttgcactctagcgttggttctcatgt

SEQ ID NO: 46087 - DNA, 76 bp, Homo sapiens
  misc_feature 1..76: note = chr20:4690696-4690772
  misc_feature 1..76: note = hypo
  source 1..76: mol_type = genomic DNA
ttcatgatcaaccaacgtggtttagtttggctcagacctaggaagatctaaaactttacgccggatcatgttcctc

SEQ ID NO: 46088 - DNA, 30 bp, Homo sapiens
  misc_feature 1..30: note = chr20:4749380-4749410
  misc_feature 1..30: note = hypo
  source 1..30: mol_type = genomic DNA
cagggtagggagtgccgtggtgaagagtct

SEQ ID NO: 46089 - DNA, 48 bp, Homo sapiens
  misc_feature 1..48: note = chr20:5762556-5762604
  misc_feature 1..48: note = hypo
  source 1..48: mol_type = genomic DNA
tttcaacaaccggcacgactgtacaggtgcacacgagctgaatagagg

SEQ ID NO: 46090 - DNA, 30 bp, Homo sapiens
  misc_feature 1..30: note = chr20:10641102-10641132
  misc_feature 1..30: note = hypo
  source 1..30: mol_type = genomic DNA
cttcataaaagggatcggttaaacacacta

SEQ ID NO: 46091 - DNA, 207 bp, Homo sapiens
  misc_feature 1..207: note = chr20:13243380-13243587
  misc_feature 1..207: note = hypo
  source 1..207: mol_type = genomic DNA
ctccattttgtcagccggccccaagaaccttcaatgaggagagatacacagggatgggtggcccctccacctcaaagccagctccctacccaaatgcaaagagttgcccattcttcatttcttctaaagcctgagataataaacgaggtcactgccaagccctaaagtaaacatcgttatgatacattctgccgccataactaggga

SEQ ID NO: 46092 - DNA, 142 bp, Homo sapiens
  misc_feature 1..142: note = chr20:16554594-16554736
  misc_feature 1..142: note = hypo
  source 1..142: mol_type = genomic DNA
tgttttaaatgtgtgcgggaatgtcattatattggctagaatcaaaccttatttagacttgttttgcacttttgtacactttagtaatttttagttttaatcataagggagttaaaggcgaacacaactggtattttttttt

SEQ ID NO: 46093 - DNA, 142 bp, Homo sapiens
  misc_feature 1..142: note = chr20:16555036-16555178
  misc_feature 1..142: note = hypo
  source 1..142: mol_type = genomic DNA
cttaaggcttagggcctctggtagaagtgagctccacctcccttcctgtgtagaaggtaaatgcattcattcattcagtgaatcgagcatgcatgaaatcgtttgcgcacacccagaagcccacctgcgagccacaggagca

SEQ ID NO: 46094 - DNA, 179 bp, Homo sapiens
  misc_feature 1..179: note = chr20:17482564-17482743
  misc_feature 1..179: note = hypo
  source 1..179: mol_type = genomic DNA
cgggtctgaggctgccgctctggagtggcgagctttcatgtgcatggcaaagttgagaaaggtaattatttggagaggaaaagaaatgaagccgaaaggcaaagacaaacagaaattagggagccatggcaagagaaggaagagatggaaaaggagacggagagcggctgcctcagctc

SEQ ID NO: 46095 - DNA, 30 bp, Homo sapiens
  misc_feature 1..30: note = chr20:17702368-17702398
  misc_feature 1..30: note = hypo
  source 1..30: mol_type = genomic DNA
aagcaaattctggaccgctgttcacacaga

SEQ ID NO: 46096 - DNA, 154 bp, Homo sapiens
  misc_feature 1..154: note = chr20:18233341-18233495
  misc_feature 1..154: note = hypo
  source 1..154: mol_type = genomic DNA
ccaggttttgttttccgagtcttggcgtccccagccaaagttcctgggtactggctgccacccatgggagaggggaacacccaccagctccaccccataggacattgctagggccttagtcacctagaaaagccctccacgtatttgcctggtt

SEQ ID NO: 46097 - DNA, 208 bp, Homo sapiens
  misc_feature 1..208: note = chr20:18489646-18489854
  misc_feature 1..208: note = hypo
  source 1..208: mol_type = genomic DNA
gagccaccgcgcccggccgccagtgccttttaataaagaacgttttgagagagagacggttatttaatgaaatctgctgacatacttgctgagagttgtgatagaacttgctttcattccgactttagttatccctttgcttcccatgaagctccagagtgcttcctgtgcacacagtgcttcaggttcttgccgttgccagaaataa

SEQ ID NO: 46098 - DNA, 197 bp, Homo sapiens
  misc_feature 1..197: note = chr20:19080645-19080842
  misc_feature 1..197: note = hypo
  source 1..197: mol_type = genomic DNA
agtccttgctcctgccgcccccatggtgggctgaagtttacatgttggggtttttgccaggcaactccctggacagcctatcactaagccctcacctaaaaccactgacagtggttcttattttgcttactggacaaaaaaagaaaccgagtttccgatggatttgttttttgggatgacaccgggtaatctcccat

SEQ ID NO: 46099 - DNA, 40 bp, Homo sapiens
  misc_feature 1..40: note = chr20:19674013-19674053
  misc_feature 1..40: note = hypo
  source 1..40: mol_type = genomic DNA
cgtttgcttcctccacgctgtggatcgcagccttctccta

SEQ ID NO: 46100 - DNA, 30 bp, Homo sapiens
  misc_feature 1..30: note = chr20:19928306-19928336
  misc_feature 1..30: note = hypo
  source 1..30: mol_type = genomic DNA
agtctaggagattcccggaaaccttcaggg

SEQ ID NO: 46101 - DNA, 30 bp, Homo sapiens
  misc_feature 1..30: note = chr20:19961658-19961688
  misc_feature 1..30: note = hypo
  source 1..30: mol_type = genomic DNA
ctggtaatcactcctcgtgggcggccctgt

SEQ ID NO: 46102 - DNA, 30 bp, Homo sapiens
  misc_feature 1..30: note = chr20:20376922-20376952
  misc_feature 1..30: note = hypo
  source 1..30: mol_type = genomic DNA
ctccattaaggctggcggtcaaaggccggc

SEQ ID NO: 46103 - DNA, 30 bp, Homo sapiens
  misc_feature 1..30: note = chr20:20377191-20377221
  misc_feature 1..30: note = hypo
  source 1..30: mol_type = genomic DNA
tgtgggcagggcccccggggaggggaaggc

SEQ ID NO: 46104 - DNA, 30 bp, Homo sapiens
  misc_feature 1..30: note = chr20:20421168-20421198
  misc_feature 1..30: note = hypo
  source 1..30: mol_type = genomic DNA
ttgcgcagacagcatcggagctttgtcagc

SEQ ID NO: 46105 - DNA, 32 bp, Homo sapiens
  misc_feature 1..32: note = chr20:20914015-20914047
  misc_feature 1..32: note = hypo
  source 1..32: mol_type = genomic DNA
gataggaaaggcggacgcgcaaatccaccaac

SEQ ID NO: 46106 - DNA, 30 bp, Homo sapiens
  misc_feature 1..30: note = chr20:23117794-23117824
  misc_feature 1..30: note = hypo
  source 1..30: mol_type = genomic DNA
cagcagaggggcctacggctgggactgtgg

SEQ ID NO: 46107 - DNA, 37 bp, Homo sapiens
  misc_feature 1..37: note = chr20:23138450-23138487
  misc_feature 1..37: note = hypo
  source 1..37: mol_type = genomic DNA
tacacgcgtgagccaccgcgcccggcctcctagtgtc

SEQ ID NO: 46108 - DNA, 94 bp, Homo sapiens
  misc_feature 1..94: note = chr20:24467593-24467687
  misc_feature 1..94: note = hypo
  source 1..94: mol_type = genomic DNA
agagtgtgcatttctaacaagtgccagtgatgacagtgctgctagcccgcaggacacactttgagcagccggggaatcacgggccaaggttggg

SEQ ID NO: 46109 - DNA, 174 bp, Homo sapiens
  misc_feature 1..174: note = chr20:24523871-24524045
  misc_feature 1..174: note = hypo
  source 1..174: mol_type = genomic DNA
cagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggac

SEQ ID NO: 46110 - DNA, 134 bp, Homo sapiens
  misc_feature 1..134: note = chr20:24571035-24571169
  misc_feature 1..134: note = hypo
  source 1..134: mol_type = genomic DNA
tgggataagaagcctcgggggtttgagcggaggagaagcccctgtggccacatgctcccgggagccttcagagaacagggcggagggggaggcgcagggcgacgacggcagtggtcaaacgcagaaccgtggag

SEQ ID NO: 46111 - DNA, 77 bp, Homo sapiens
  misc_feature 1..77: note = chr20:24571472-24571549
  misc_feature 1..77: note = hypo
  source 1..77: mol_type = genomic DNA
cgtgggagcattgaccgctgatgagcagcttcaggcatgcagggagggacagcaccgaggagcggactccagagcaa

SEQ ID NO: 46112 - DNA, 46 bp, Homo sapiens
  misc_feature 1..46: note = chr20:24872951-24872997
  misc_feature 1..46: note = hypo
  source 1..46: mol_type = genomic DNA
cccacccttgctgcacggacacccccagccccgcagatgccctgca

SEQ ID NO: 46113 - DNA, 246 bp, Homo sapiens
  misc_feature 1..246: note = chr20:25028280-25028526
  misc_feature 1..246: note = hypo
  source 1..246: mol_type = genomic DNA
tgagcttcaggcaaacggggtttgcatggagaaccaaggtgctgcaccaacacagcagcccctacaggaagcagcttggggaaggccagtgcagaccgcccaaagcacacagcatctgaagcatgcttggcacatagaatctgcttaaggaatcagagactaaaaagatcagcttaaaaacaaaacaactctactaaagatgattttatttattgtcccatcctcacaaggcgctgagagtgtggc

SEQ ID NO: 46114 - DNA, 152 bp, Homo sapiens
  misc_feature 1..152: note = chr20:25230352-25230504
  misc_feature 1..152: note = hypo
  source 1..152: mol_type = genomic DNA
acatagaagtggcaacgaatggccaaaacaggttataacaagggcttgggatgactttgccaggaaaagcagccaagaagcagtggctcccccagaattccctgctgttgggagagttctgatgcacagcaccattttttttttttttttaa

SEQ ID NO: 46115 - DNA, 211 bp, Homo sapiens
  misc_feature 1..211: note = chr20:25230744-25230955
  misc_feature 1..211: note = hypo
  source 1..211: mol_type = genomic DNA
aaagtgcaggagttacaggcgtgagccaacgcacccgacccgcaacatcatttttattgtctaagtggcggatggcaaggacatagctctgccttcacattcaagggcatttccttggagctggaccaggactcagctctacaccttagggtgcccattggagtatttatgtataatcacatcctggagaggccagcgatgggctcaggga

SEQ ID NO: 46116 - DNA, 97 bp, Homo sapiens
  misc_feature 1..97: note = chr20:25251463-25251560
  misc_feature 1..97: note = hypo
  source 1..97: mol_type = genomic DNA
gtttttctttcaagacgttttgattggaacaagggctggatttaatgacacgtgctatagcgccttggggcccctggtactgcggtgtttgcacagg

SEQ ID NO: 46117 - DNA, 30 bp, Homo sapiens
  misc_feature 1..30: note = chr20:25603036-25603066
  misc_feature 1..30: note = hypo
  source 1..30: mol_type = genomic DNA
gaagatataaggctccgagtggttaattcc

SEQ ID NO: 46118 - DNA, 30 bp, Homo sapiens
  misc_feature 1..30: note = chr20:30022593-30022623
  misc_feature 1..30: note = hypo
  source 1..30: mol_type = genomic DNA
gagagagagaaggcacggtgactcacgcct

SEQ ID NO: 46119 - DNA, 30 bp, Homo sapiens; identical to SEQ ID NO: 16575
  misc_feature 1..30: note = chr20:30101713-30101743
  misc_feature 1..30: note = hypo
  source 1..30: mol_type = genomic DNA

SEQ ID NO: 46120 - DNA, 28 bp, Homo sapiens
  misc_feature 1..28: note = chr20:30134312-30134340
  misc_feature 1..28: note = hypo
  source 1..28: mol_type = genomic DNA
ggaggctgaggcaggcggatgacttgag

SEQ ID NO: 46121 - DNA, 47 bp, Homo sapiens
  misc_feature 1..47: note = chr20:30153940-30153987
  misc_feature 1..47: note = hypo
  source 1..47: mol_type = genomic DNA
ttggggtgctgggcacggccctgaggcagtgccgtgcccagcatggc

SEQ ID NO: 46122 - DNA, 20 bp, Homo sapiens
  misc_feature 1..20: note = chr20:30181151-30181171
  misc_feature 1..20: note = hypo
  source 1..20: mol_type = genomic DNA
cacatcgttgcttttgcatc

SEQ ID NO: 46123 - DNA, 30 bp, Homo sapiens
  misc_feature 1..30: note = chr20:30464460-30464490
  misc_feature 1..30: note = hypo
  source 1..30: mol_type = genomic DNA
gggcctataagatatcgtctagtagtggaa

SEQ ID NO: 46124 - DNA, 33 bp, Homo sapiens
  misc_feature 1..33: note = chr20:30468280-30468313
  misc_feature 1..33: note = hypo
  source 1..33: mol_type = genomic DNA
tctccgcaccccaaccgactttttttttttttt

SEQ ID NO: 46125 - DNA, 51 bp, Homo sapiens
  misc_feature 1..51: note = chr20:30585053-30585104
  misc_feature 1..51: note = hypo
  source 1..51: mol_type = genomic DNA
gtggcccgcaccttgcggacagaggggcctgtcatccggattgacttgcct

SEQ ID NO: 46126 - DNA, 30 bp, Homo sapiens
  misc_feature 1..30: note = chr20:30671697-30671727
  misc_feature 1..30: note = hypo
  source 1..30: mol_type = genomic DNA
aagctactctttgtccgtgcgagactacga

SEQ ID NO: 46127 - DNA, 30 bp, Homo sapiens
  misc_feature 1..30: note = chr20:30770464-30770494
  misc_feature 1..30: note = hypo
  source 1..30: mol_type = genomic DNA
gtagagagttcctatcgctagagatacaaa

SEQ ID NO: 46128 - DNA, 153 bp, Homo sapiens; identical to SEQ ID NO: 5243
  misc_feature 1..153: note = chr20:30864866-30865019
  misc_feature 1..153: note = hypo
  source 1..153: mol_type = genomic DNA

SEQ ID NO: 46129 - DNA, 48 bp, Homo sapiens
  misc_feature 1..48: note = chr20:31108565-31108613
  misc_feature 1..48: note = hypo
  source 1..48: mol_type = genomic DNA
ctcttagatggcccccgccctagccctccagcacgccacccctgctac

SEQ ID NO: 46130 - DNA, 213 bp, Homo sapiens
  misc_feature 1..213: note = chr20:31115617-31115830
  misc_feature 1..213: note = hypo
  source 1..213: mol_type = genomic DNA
gctctccacatgcatcgagtagatgatgtcaaagaaatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccgacagtgggtcttg

SEQ ID NO: 46131 - DNA, 30 bp, Homo sapiens
  misc_feature 1..30: note = chr20:31147343-31147373
  misc_feature 1..30: note = hypo
  source 1..30: mol_type = genomic DNA
gtaggaatgttattacgttcattttgcaga

SEQ ID NO: 46132 - DNA, 30 bp, Homo sapiens
  misc_feature 1..30: note = chr20:31151622-31151652
  misc_feature 1..30: note = hypo
  source 1..30: mol_type = genomic DNA
cattgcctggtctcccggccaaggtggcag

SEQ ID NO: 46133 - DNA, 159 bp, Homo sapiens
  misc_feature 1..159: note = chr20:31226664-31226823
  misc_feature 1..159: note = hypo
  source 1..159: mol_type = genomic DNA
cgctcccggcaatgtcggcctgactcacctggtgataccaagtgtatattctgtgtcaggagctgcggtgtgcaactcaagatgctctgacttacttaattcttacacccaacaagttccaacagggaaacagagttcaggcagcgaggtagctgccca

SEQ ID NO: 46134 - DNA, 30 bp, Homo sapiens
  misc_feature 1..30: note = chr20:31553994-31554024
  misc_feature 1..30: note = hypo
  source 1..30: mol_type = genomic DNA
cttgagcgggataagcgagatgctcctcac

SEQ ID NO: 46135 - DNA, 30 bp, Homo sapiens
  misc_feature 1..30: note = chr20:31940171-31940201
  misc_feature 1..30: note = hypo
  source 1..30: mol_type = genomic DNA
actgcatggggtccacgggcagccggagct

SEQ ID NO: 46136 - DNA, 223 bp, Homo sapiens
  misc_feature 1..223: note = chr20:32242529-32242752
  misc_feature 1..223: note = hypo
  source 1..223: mol_type = genomic DNA
tttacagggaatggacggggtgggagccaggtaaagaagttgctgcagtcttccacgccagagaggacggtggccctgacttgggggctggggcgaggcacaatggtggggatggcaggctacagatgaggtgggctcgtgagatcgacagacaaggcagaggcttgagggcttcctccaggtccccacagccccagcccagctcagacgtctgttctgtggc

SEQ ID NO: 46137 - DNA, 69 bp, Homo sapiens
  misc_feature 1..69: note = chr20:32301884-32301953
  misc_feature 1..69: note = hypo
  source 1..69: mol_type = genomic DNA
tgcatggaatggcagcgagttctgtgtgccaagggcacgccagggtggacacaacgggggtcagctgag

SEQ ID NO: 46138 - DNA, 30 bp, Homo sapiens
  misc_feature 1..30: note = chr20:32414088-32414118
  misc_feature 1..30: note = hypo
  source 1..30: mol_type = genomic DNA
aggaccattcgaggccgaggagactgtggg

SEQ ID NO: 46139 - DNA, 153 bp, Homo sapiens
  misc_feature 1..153: note = chr20:32450390-32450543
  misc_feature 1..153: note = hypo
  source 1..153: mol_type = genomic DNA
gtgtttatttaaggaatggaagcgttcactcaagccagacttcaggggcaaatgtacattgggaatctccaagggacatctcccaaactacctgaccagggtgtgggttccgccgaatatcttttgggaaacgctgtgcgggggtccctagag

SEQ ID NO: 46140 - DNA, 38 bp, Homo sapiens
  misc_feature 1..38: note = chr20:32459722-32459760
  misc_feature 1..38: note = hypo
  source 1..38: mol_type = genomic DNA
atcaggtgctcatcacgtgttttcgaaggcagttgatt

SEQ ID NO: 46141 - DNA, 30 bp, Homo sapiens; identical to SEQ ID NO: 16581
  misc_feature 1..30: note = chr20:32524318-32524348
  misc_feature 1..30: note = hypo
  source 1..30: mol_type = genomic DNA

SEQ ID NO: 46142 - DNA, 30 bp, Homo sapiens
  misc_feature 1..30: note = chr20:32950057-32950087
  misc_feature 1..30: note = hypo
  source 1..30: mol_type = genomic DNA
cagctcttagaataccggacaggccacgtt

SEQ ID NO: 46143 - DNA, 123 bp, Homo sapiens
  misc_feature 1..123: note = chr20:33134858-33134981
  misc_feature 1..123: note = hypo
  source 1..123: mol_type = genomic DNA
agcatagccagggagcggcccagatggcagggcaaggtctctgtggagtgagggcagcagggaaggtgcctcgcaggagaggagagaaaacatacacttccctggggacgcgggcggggagtt

SEQ ID NO: 46144 - DNA, 30 bp, Homo sapiens
  misc_feature 1..30: note = chr20:33137930-33137960
  misc_feature 1..30: note = hypo
  source 1..30: mol_type = genomic DNA
gcccgtgtgccaggccggccaaggccagtt

SEQ ID NO: 46145 - DNA, 29 bp, Homo sapiens
  misc_feature 1..29: note = chr20:33290324-33290353
  misc_feature 1..29: note = hypo
  source 1..29: mol_type = genomic DNA
ttatcactagagtgccgggcacggtggct

SEQ ID NO: 46146 - DNA, 30 bp, Homo sapiens; identical to SEQ ID NO: 16583
  misc_feature 1..30: note = chr20:33547626-33547656
  misc_feature 1..30: note = hypo
  source 1..30: mol_type = genomic DNA

SEQ ID NO: 46147 - DNA, 30 bp, Homo sapiens
  misc_feature 1..30: note = chr20:33574865-33574895
  misc_feature 1..30: note = hypo
  source 1..30: mol_type = genomic DNA
ctgcatgaatggtcccggggcagtgcctgg

SEQ ID NO: 46148 - DNA, 45 bp, Homo sapiens
  misc_feature 1..45: note = chr20:33834734-33834779
  misc_feature 1..45: note = hypo
  source 1..45: mol_type = genomic DNA
tatgcagcagttttacgggatcccggtcaccggtgtgttggatca

SEQ ID NO: 46149 - DNA, 41 bp, Homo sapiens
  misc_feature 1..41: note = chr20:33855099-33855140
  misc_feature 1..41: note = hypo
  source 1..41: mol_type = genomic DNA
cagcccaggccccctcggccgcccctcggggaccggccatc

SEQ ID NO: 46150 - DNA, 30 bp, Homo sapiens; identical to SEQ ID NO: 16584
  misc_feature 1..30: note = chr20:33866905-33866935
  misc_feature 1..30: note = hypo
  source 1..30: mol_type = genomic DNA

SEQ ID NO: 46151 - DNA, 244 bp, Homo sapiens
  misc_feature 1..244: note = chr20:33879984-33880228
  misc_feature 1..244: note = hypo
  source 1..244: mol_type = genomic DNA
gtgccgcagcaccagcggtgagctctcccgccaccacggcagcttcagctcttccacccggccccgcaggggtcccgccatgccctgggctcccaggaccccaggccccgggcctccgaacatgcctgccacgcggctgcctcacccgccggcagggcccatggcccgcacgctgggctggctgcagcaggaagaggagaccagcagaaccgccttctgcccgcccgctcgctgtgtgtgtggc

SEQ ID NO: 46152 - DNA, 31 bp, Homo sapiens
  misc_feature 1..31: note = chr20:34041981-34042012
  misc_feature 1..31: note = hypo
  source 1..31: mol_type = genomic DNA
atttatacacaaggccgggcgcggtggctca

SEQ ID NO: 46153 - DNA, 30 bp, Homo sapiens
  misc_feature 1..30: note = chr20:34147200-34147230
  misc_feature 1..30: note = hypo
  source 1..30: mol_type = genomic DNA
agcctgagcctcctgcgcctcccgctccac

SEQ ID NO: 46154 - DNA, 276 bp, Homo sapiens
  misc_feature 1..276: note = chr20:34147978-34148254
  misc_feature 1..276: note = hypo
  source 1..276: mol_type = genomic DNA
aagggtccagacctgcgccagacgctcacctcccgctccgtgggcaggtagtcaaagcggaacacaaagcgccaattgaagttcccctccccagtcagggagttgaagtgaacgtctgtctcctgcttgtcatgctccaaccccttcacccagctggggccggggtgggtgagcgtcagggctggagctacatggagaacccactcctcaccccgctctcagcaccacggagggcctggggtcggggctctggactcagcccgagggcccacaccc

SEQ ID NO: 46155 - DNA, 63 bp, Homo sapiens
  misc_feature 1..63: note = chr20:34710619-34710682
  misc_feature 1..63: note = hypo
  source 1..63: mol_type = genomic DNA
ggaaggcagaagccacgcagacttctagtcctggttccactgcttactcggtatgtggccctt

SEQ ID NO: 46156 - DNA, 131 bp, Homo sapiens
  misc_feature 1..131: note = chr20:35089026-35089157
  misc_feature 1..131: note = hypo
  source 1..131: mol_type = genomic DNA
gacctaccacaggtgcggcctggagagatgaggcccacaaggcagcgacaggacctggattcagtgaggagaggggactcgcggggtagaagccaggaactgggaaggcgaggaggcgtgaaggcaccacc

SEQ ID NO: 46157 - DNA, 256 bp, Homo sapiens
  misc_feature 1..256: note = chr20:35924156-35924412
  misc_feature 1..256: note = hypo
  source 1..256: mol_type = genomic DNA
ctgtaaagtgctgttcgcaacacctggccgttcatttgccgactgctgctgctgctggaacaatggccagggaacaaaacctgtcacagccagtcgaaggggtgtctcctagttgagatctgcaggatgaataggacttgtttgactttggtcatcaggaaaggaaagcccagaaatactggcaggagggctgggaagtaaagcacagaggtgcagagagaactagatgagagccgtacggcgcacagtgtgtgta

SEQ ID NO: 46158 - DNA, 33 bp, Homo sapiens
  misc_feature 1..33: note = chr20:36049828-36049861
  misc_feature 1..33: note = hypo
  source 1..33: mol_type = genomic DNA
accccactctgcagacgccgggccacactgtgt

SEQ ID NO: 46159 - DNA, 39 bp, Homo sapiens; identical to SEQ ID NO: 16588
  misc_feature 1..39: note = chr20:36151122-36151161
  misc_feature 1..39: note = hypo
  source 1..39: mol_type = genomic DNA

SEQ ID NO: 46160 - DNA, 35 bp, Homo sapiens
  misc_feature 1..35: note = chr20:36526859-36526894
  misc_feature 1..35: note = hypo
  source 1..35: mol_type = genomic DNA
ccaagcctggagttccgcaccggtttcataccctc

SEQ ID NO: 46161 - DNA, 96 bp, Homo sapiens
  misc_feature 1..96: note = chr20:36571234-36571330
  misc_feature 1..96: note = hypo
  source 1..96: mol_type = genomic DNA
gtcaaagtacaaagacgaatataacaaacatccttgctccccccaagtggagtgaatagttattagcatcctgatatatttgtcgtcagcctttat

SEQ ID NO: 46162 - DNA, 30 bp, Homo sapiens
  misc_feature 1..30: note = chr20:36767887-36767917
  misc_feature 1..30: note = hypo
  source 1..30: mol_type = genomic DNA
ccaacgatcagggaacggttgatggatttg

SEQ ID NO: 46163 - DNA, 63 bp, Homo sapiens
  misc_feature 1..63: note = chr20:36775268-36775331
  misc_feature 1..63: note = hypo
  source 1..63: mol_type = genomic DNA
gcacaccctggtcatcgttgcagttgacctgcaaccagtggggcagcacggggactgagcctg

SEQ ID NO: 46164 - DNA, 40 bp, Homo sapiens
  misc_feature 1..40: note = chr20:39687444-39687484
  misc_feature 1..40: note = hypo
  source 1..40: mol_type = genomic DNA
ctataattatatgaccgctcgaaaacgccaagacaattta

SEQ ID NO: 46165 - DNA, 30 bp, Homo sapiens
  misc_feature 1..30: note = chr20:40715181-40715211
  misc_feature 1..30: note = hypo
  source 1..30: mol_type = genomic DNA
tttttcttttcaccacgcaaatcatcacaa

SEQ ID NO: 46166 - DNA, 107 bp, Homo sapiens
  misc_feature 1..107: note = chr20:42088631-42088738
  misc_feature 1..107: note = hypo
  source 1..107: mol_type = genomic DNA
atgttttaagatttccgagtctgaccaatcttgtctttcaggattttatgcgacaagcaggtgaagtaacctatgcggatgcccacaaggaacgaacaaatgagggt

SEQ ID NO: 46167 - DNA, 143 bp, Homo sapiens
  misc_feature 1..143: note = chr20:42199155-42199298
  misc_feature 1..143: note = hypo
  source 1..143: mol_type = genomic DNA
gagagggagtgagctcgcagccgcacagggcggggagcaggtgcaccctagccctacagcagccacccaataactcctgtcacactcctcctcccctccagctcttcttccacctgcagcgggagcgccggttcctggagccc

SEQ ID NO: 46168 - DNA, 102 bp, Homo sapiens; identical to SEQ ID NO: 1637
  misc_feature 1..102: note = chr20:42218592-42218694
  misc_feature 1..102: note = hypo
  source 1..102: mol_type = genomic DNA

SEQ ID NO: 46169 - DNA, 30 bp, Homo sapiens
  misc_feature 1..30: note = chr20:42853157-42853187
  misc_feature 1..30: note = hypo
  source 1..30: mol_type = genomic DNA
agtctattaaaggtacgagcttagctggac

SEQ ID NO: 46170 - DNA, 128 bp, Homo sapiens; identical to SEQ ID NO: 16591
  misc_feature 1..128: note = chr20:43065628-43065756
  misc_feature 1..128: note = hypo
  source 1..128: mol_type = genomic DNA

SEQ ID NO: 46171 - DNA, 113 bp, Homo sapiens
  misc_feature 1..113: note = chr20:43276908-43277021
  misc_feature 1..113: note = hypo
  source 1..113: mol_type = genomic DNA
tatgggaggcacacccgacagggcaaacttgacttgggcatcccctgacgatgaccctgcatggcaggcacacttgaatgggtgttcagagttctgagcgaaggaatccaaga

SEQ ID NO: 46172 - DNA, 37 bp, Homo sapiens
  misc_feature 1..37: note = chr20:43385586-43385623
  misc_feature 1..37: note = hypo
  source 1..37: mol_type = genomic DNA
atacagtgggtccagcgacttgcgagcgactttggtc

SEQ ID NO: 46173 - DNA, 31 bp, Homo sapiens
  misc_feature 1..31: note = chr20:43952328-43952359
  misc_feature 1..31: note = hypo
  source 1..31: mol_type = genomic DNA
ccgtgttagccaggatcgtctcaatctcctg

SEQ ID NO: 46174 - DNA, 40 bp, Homo sapiens
  misc_feature 1..40: note = chr20:44477901-44477941
  misc_feature 1..40: note = hypo
  source 1..40: mol_type = genomic DNA
aggctatttattcagcgcttgttcttttttttgtttgttt

SEQ ID NO: 46175 - DNA, 30 bp, Homo sapiens
  misc_feature 1..30: note = chr20:44562147-44562177
  misc_feature 1..30: note = hypo
  source 1..30: mol_type = genomic DNA
cctttatgaggtaggcggatttattatctt

SEQ ID NO: 46176 - DNA, 40 bp, Homo sapiens
  misc_feature 1..40: note = chr20:44601506-44601546
  misc_feature 1..40: note = hypo
  source 1..40: mol_type = genomic DNA
taatagagctgaggccgggcgctgtgagtcacgcctgtaa

SEQ ID NO: 46177 - DNA, 300 bp, Homo sapiens
  misc_feature 1..300: note = chr20:44601786-44602086
  misc_feature 1..300: note = hypo
  source 1..300: mol_type = genomic DNA
gcgacagagcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaactcctaagcaggct

SEQ ID NO: 46178 - DNA, 120 bp, Homo sapiens
  misc_feature 1..120: note = chr20:44602326-44602446
  misc_feature 1..120: note = hypo
  source 1..120: mol_type = genomic DNA
ccttccagcctggggaacaacagcggaaactcttgtctcaaacaaacaaacaaaaagtcctaaggagaagacctattaataaggagaaaaggtccgggctcggtgggtcacacctgtaat

SEQ ID NO: 46179 - DNA, 47 bp, Homo sapiens
  misc_feature 1..47: note = chr20:44756555-44756602
  misc_feature 1..47: note = hypo
  source 1..47: mol_type = genomic DNA
ccagtttaaaaatgtcggcaaatatttccaaacgttaagaaaatgtt

SEQ ID NO: 46180 - DNA, 30 bp, Homo sapiens
  misc_feature 1..30: note = chr20:44845534-44845564
  misc_feature 1..30: note = hypo
  source 1..30: mol_type = genomic DNA
gccacccagctgacccgccatgtctgtggc

SEQ ID NO: 46181 - DNA, 416 bp, Homo sapiens
  misc_feature 1..416: note = chr20:45337605-45338021
  misc_feature 1..416: note = hypo
  source 1..416: mol_type = genomic DNA
tgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtggtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttct

SEQ ID NO: 46182 - DNA, 30 bp, Homo sapiens
  misc_feature 1..30: note = chr20:45834171-45834201
  misc_feature 1..30: note = hypo
  source 1..30: mol_type = genomic DNA
tcaggttctactgaacggtgagcccctcag

SEQ ID NO: 46183 - DNA, 32 bp, Homo sapiens
  misc_feature 1..32: note = chr20:45949151-45949183
  misc_feature 1..32: note = hypo
  source 1..32: mol_type = genomic DNA
cctggccagccaccacgtaaagatgctgcggc

SEQ ID NO: 46184 - DNA, 30 bp, Homo sapiens
  misc_feature 1..30: note = chr20:45951653-45951683
  misc_feature 1..30: note = hypo
  source 1..30: mol_type = genomic DNA
cttggcattggccaacgtcaacacagcatt

SEQ ID NO: 46185 - DNA, 146 bp, Homo sapiens
  misc_feature 1..146: note = chr20:46013515-46013661
  misc_feature 1..146: note = hypo
  source 1..146: mol_type = genomic DNA
taaagtgctgggatcacaggtatgagccagcgcgcccggcggaggaattttcagtactaaagctatagtgttgtgatgagagtccggcgtgctccctgaatgccggtgcccgattcataacctagtgcattcgttcacacattatt

SEQ ID NO: 46186 - DNA, 30 bp, Homo sapiens
  misc_feature 1..30: note = chr20:46175625-46175655
  misc_feature 1..30: note = hypo
  source 1..30: mol_type = genomic DNA
ttcttgatccagtaccgttcttcatccagt

SEQ ID NO: 46187 - DNA, 30 bp, Homo sapiens
  misc_feature 1..30: note = chr20:46315525-46315555
  misc_feature 1..30: note = hypo
  source 1..30: mol_type = genomic DNA
aggctcccctggactcggctttctcagccc

SEQ ID NO: 46188 - DNA, 36 bp, Homo sapiens
  misc_feature 1..36: note = chr20:46365599-46365635
  misc_feature 1..36: note = hypo
  source 1..36: mol_type = genomic DNA
acatgggtgtggtcacgaaggcgttgatgaagtgcg

SEQ ID NO: 46189 - DNA, 30 bp, Homo sapiens
  misc_feature 1..30: note = chr20:46582135-46582165
  misc_feature 1..30: note = hypo
  source 1..30: mol_type = genomic DNA
attcttcctatgtgccgagtatatacactc

SEQ ID NO: 46190 - DNA, 30 bp, Homo sapiens
  misc_feature 1..30: note = chr20:46823521-46823551
  misc_feature 1..30: note = hypo
  source 1..30: mol_type = genomic DNA
ggcgaatgagctggacgagggccagccctg

SEQ ID NO: 46191 - DNA, 30 bp, Homo sapiens
  misc_feature 1..30: note = chr20:47128746-47128776
  misc_feature 1..30: note = hypo
  source 1..30: mol_type = genomic DNA
ctagatcagcagcaccggctcctccctggg

SEQ ID NO: 46192 - DNA, 68 bp, Homo sapiens; identical to SEQ ID NO: 16599
  misc_feature 1..68: note = chr20:47247201-47247269
  misc_feature 1..68: note = hypo
  source 1..68: mol_type = genomic DNA

SEQ ID NO: 46193 - DNA, 36 bp, Homo sapiens
  misc_feature 1..36: note = chr20:47252955-47252991
  misc_feature 1..36: note = hypo
  source 1..36: mol_type = genomic DNA
cagtgggtgggccagcggggccgccctcccgcccca

SEQ ID NO: 46194 - DNA, 36 bp, Homo sapiens
  misc_feature 1..36: note = chr20:47260725-47260761
  misc_feature 1..36: note = hypo
  source 1..36: mol_type = genomic DNA
gatgtttgtttctttcgctgccgcattcccagtgcc

SEQ ID NO: 46195 - DNA, 182 bp, Homo sapiens
  misc_feature 1..182: note = chr20:47274120-47274302
  misc_feature 1..182: note = hypo
  source 1..182: mol_type = genomic DNA
caaggtcaacctagccgctccggccatgggtatgtcgctccttgcagcccaaagcattcctaattgccacaggggcaagctgggctccagccagcacggcaggtgcatctcccccacccacctgcacacgccccaggcaaagccggaaggccccagggctgaatcctcggccagccacaccc

SEQ ID NO: 46196 - DNA, 30 bp, Homo sapiens
  misc_feature 1..30: note = chr20:47274646-47274676
  misc_feature 1..30: note = hypo
  source 1..30: mol_type = genomic DNA
ccctgccagctcccccgagggcctcacctc

SEQ ID NO: 46197 - DNA, 255 bp, Homo sapiens
  misc_feature 1..255: note = chr20:47296109-47296364
  misc_feature 1..255: note = hypo
  source 1..255: mol_type = genomic DNA
aggcctgctctgaggcgaacccagggtggaggtgaacgaggccagctgagtcagagtcacaggggcggagggcccctaccttggacatgatgtcctccagctcacttcgggccttgtaggtgccatcgtcgtagcggaagcgatacatcacctgctcattcttgaactggtgcttgtcggaaactggagagacaggaggacctgtgacgctgggcacgccccctcagcccctcccagccacgccccccagcattg

SEQ ID NO: 46198 - DNA, 184 bp, Homo sapiens; identical to SEQ ID NO: 16602
  misc_feature 1..184: note = chr20:47428537-47428721
  misc_feature 1..184: note = hypo
  source 1..184: mol_type = genomic DNA

SEQ ID NO: 46199 - DNA, 118 bp, Homo sapiens
  misc_feature 1..118: note = chr20:47837088-47837206
  misc_feature 1..118: note = hypo
  source 1..118: mol_type = genomic DNA
agactcctcaggcagcgtctgggtcccgtacactgtcgccatttccccgatgtcccctgtgggcgcgggcggccacccaggcctgctggctgcggccccctctcggacaggccttggc

SEQ ID NO: 46200 - DNA, 253 bp, Homo sapiens
  misc_feature 1..253: note = chr20:47905350-47905603
  misc_feature 1..253: note = hypo
  source 1..253: mol_type = genomic DNA
taaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgaga

SEQ ID NO: 46201 - DNA, 33 bp, Homo sapiens
  misc_feature 1..33: note = chr20:48252895-48252928
  misc_feature 1..33: note = hypo
  source 1..33: mol_type = genomic DNA
tgtttttatacaaggcgtcgtatgtgatgtttg

SEQ ID NO: 46202 - DNA, 30 bp, Homo sapiens; identical to SEQ ID NO: 16604
  misc_feature 1..30: note = chr20:48477511-48477541
  misc_feature 1..30: note = hypo
  source 1..30: mol_type = genomic DNA

SEQ ID NO: 46203 - DNA, 88 bp, Homo sapiens
  misc_feature 1..88: note = chr20:48673896-48673984
  misc_feature 1..88: note = hypo
  source 1..88: mol_type = genomic DNA
tcccttgacttgccccgcacagtgaggcctggcattttcttcccgctccccatgctggcacgtgacacagccccgggcacatgggagg

SEQ ID NO: 46204 - DNA, 21 bp, Homo sapiens
  misc_feature 1..21: note = chr20:48720805-48720826
  misc_feature 1..21: note = hypo
  source 1..21: mol_type = genomic DNA
agactccgtctcaaaaaaaaa

SEQ ID NO: 46205 - DNA, 154 bp, Homo sapiens
  misc_feature 1..154: note = chr20:48767027-48767181
  misc_feature 1..154: note = hypo
  source 1..154: mol_type = genomic DNA
cttcaggcctcacttcgaatgtcacctgctcagggaagccttcactgccccctccctaaaatgtcattcctgtccccaacatttcagatccccctctcctgctatgtatttgctccacagcgcttgccaccactgggcacgtgagacagttatt

SEQ ID NO: 46206 - DNA, 25 bp, Homo sapiens
  misc_feature 1..25: note = chr20:48771341-48771366
  misc_feature 1..25: note = hypo
  source 1..25: mol_type = genomic DNA
ttccatacaggcagccgggcgcggt

SEQ ID NO: 46207 - DNA, 180 bp, Homo sapiens
  misc_feature 1..180: note = chr20:48863456-48863636
  misc_feature 1..180: note = hypo
  source 1..180: mol_type = genomic DNA
agggggacctgtgggcggcctctgcctctccccgcgcagcgtcaggacacaggcccacattccctcctggcttctccctgaagggagagagaataatagttggttcaaatgtcaggcctgctccgtgctggtggggagactggttgagcaggtccgcaggagggacggagggaggaaatt

SEQ ID NO: 46208 - DNA, 142 bp, Homo sapiens
  misc_feature 1..142: note = chr20:49047022-49047164
  misc_feature 1..142: note = hypo
  source 1..142: mol_type = genomic DNA
ctcggtaccctacagcgcacaacacggcccttgccagaaagaatcaacagggctgtgggcgaggagccctggtctcacgagaggttgcccacccctcacctggtgccccaggaggtgggaggcttcgcgggctccaggtctt

SEQ ID NO: 46209 - DNA, 30 bp, Homo sapiens
  misc_feature 1..30: note = chr20:49194287-49194317
  misc_feature 1..30: note = hypo
  source 1..30: mol_type = genomic DNA
catccacctcctcatcggaaaatggatggg

SEQ ID NO: 46210 - DNA, 111 bp, Homo sapiens
  misc_feature 1..111: note = chr20:49200439-49200550
  misc_feature 1..111: note = hypo
  source 1..111: mol_type = genomic DNA
tcttcttgagcagaccgtgatttggaagagaggcacctgctggaaaccacacttcttgaaacagcctgggtgacggtcctttaggcagcctgccgccgtctctgtcccggt

SEQ ID NO: 46211 - DNA, 270 bp, Homo sapiens
  misc_feature 1..270: note = chr20:49204179-49204449
  misc_feature 1..270: note = hypo
  source 1..270: mol_type = genomic DNA
acaaagggtggaggtcggctctgtgccagggctgctaacggtgcccatcccaggtgccccagagttgttctgcctgctgggagagctgggtgtggcctctcgcagattctaagggccccaggcaccccgctgcgctgcacagtttgtgccactttttaccgaacgacagtgtggtttcccgggctgccgcccgcacggcctccaggtcagactggcacaggctggcagtctggtcgatgctttcaatgccctgttcgagattaggagaaa

SEQ ID NO: 46212 - DNA, 99 bp, Homo sapiens
  misc_feature 1..99: note = chr20:49218709-49218808
  misc_feature 1..99: note = hypo
  source 1..99: mol_type = genomic DNA
gcccctcgagggccacgccaggcccgtcctctctgtccccggttgccccttcctcgtggccgttctggctactcgaggctgtgccgctgtggaacaggg

SEQ ID NO: 46213 - DNA, 26 bp, Homo sapiens
  misc_feature 1..26: note = chr20:49250786-49250812
  misc_feature 1..26: note = hypo
  source 1..26: mol_type = genomic DNA
aggattatagccgtgagccaccgcgc

SEQ ID NO: 46214 - DNA, 79 bp, Homo sapiens
  misc_feature 1..79: note = chr20:49252062-49252141
  misc_feature 1..79: note = hypo
  source 1..79: mol_type = genomic DNA
cacctgtagtcgagctactgcggcaggctgaggtgggaggatcattagagacctcccagcaagtcgaggctgcagtgag

SEQ ID NO: 46215 - DNA, 387 bp, Homo sapiens
  misc_feature 1..387: note = chr20:49261761-49262148
  misc_feature 1..387: note = hypo
  source 1..387: mol_type = genomic DNA
gagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagcctaagggcactgggaaccctgtgggcatgcgcagttcaagccca

SEQ ID NO: 46216 - DNA, 114 bp, Homo sapiens
  misc_feature 1..114: note = chr20:49286780-49286894
  misc_feature 1..114: note = hypo
  source 1..114: mol_type = genomic DNA
agttttacctactgccggtttcggccaaaatgccagaaagccaagcagcaatcttgggcatcggacttggctagaaatccctctcctcctgggaagtctcgtcatcaacaccca

SEQ ID NO: 46217 - DNA, 20 bp, Homo sapiens
  misc_feature 1..20: note = chr20:49324105-49324125
  misc_feature 1..20: note = hypo
  source 1..20: mol_type = genomic DNA
cagagcgagactccaccaaa

SEQ ID NO: 46218 - DNA, 56 bp, Homo sapiens
  misc_feature 1..56: note = chr20:49345671-49345727
  misc_feature 1..56: note = hypo
  source 1..56: mol_type = genomic DNA
ggagagaggatgtgacgacacctccaggaatgcagggcccacgcaggtgcactggc

SEQ ID NO: 46219 - DNA, 295 bp, Homo sapiens
  misc_feature 1..295: note = chr20:49346464-49346759
  misc_feature 1..295: note = hypo
  source 1..295: mol_type = genomic DNA
aaaaaatgagcttctcgcctttgaacccaagtggggcaaagagcctgcagaagggacaccctcagtggcagcacccagcaaagacccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcaggga

SEQ ID NO: 46220 - DNA, 26 bp, Homo sapiens
  misc_feature 1..26: note = chr20:49350870-49350896
  misc_feature 1..26: note = hypo
  source 1..26: mol_type = genomic DNA
aactaggtagtgtgccggtccttttt

SEQ ID NO: 46221 - DNA, 32 bp, Homo sapiens
  misc_feature 1..32: note = chr20:49358364-49358396
  misc_feature 1..32: note = hypo
  source 1..32: mol_type = genomic DNA
gagccaccgcgcccggccgcactctgtctttt

SEQ ID NO: 46222 - DNA, 158 bp, Homo sapiens
  misc_feature 1..158: note = chr20:49377913-49378071
  misc_feature 1..158: note = hypo
  source 1..158: mol_type = genomic DNA
ctcctggccgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgctaggttatctac

SEQ ID NO: 46223 - DNA, 30 bp, Homo sapiens; identical to SEQ ID NO: 16619
  misc_feature 1..30: note = chr20:49380822-49380852
  misc_feature 1..30: note = hypo
  source 1..30: mol_type = genomic DNA

SEQ ID NO: 46224 - DNA, 30 bp, Homo sapiens
  misc_feature 1..30: note = chr20:49502935-49502965
  misc_feature 1..30: note = hypo
  source 1..30: mol_type = genomic DNA
aggattggggttggacggttttgaggactc

SEQ ID NO: 46225 - DNA, 20 bp, Homo sapiens
  misc_feature 1..20: note = chr20:52275978-52275998
  misc_feature 1..20: note = hypo
  source 1..20: mol_type = genomic DNA
tttttttttttgagacggag

SEQ ID NO: 46226 - DNA, 76 bp, Homo sapiens
  misc_feature 1..76: note = chr20:52341635-52341711
  misc_feature 1..76: note = hypo
  source 1..76: mol_type = genomic DNA
gatctcctctccgaccctgccctccggcctccgtggtggccttccctggacggtattcacacgttcccctactcta

SEQ ID NO: 46227 - DNA, 30 bp, Homo sapiens
  misc_feature 1..30: note = chr20:52484713-52484743
  misc_feature 1..30: note = hypo
  source 1..30: mol_type = genomic DNA
tgttggtggctgtcccgggcagtgtagggt

SEQ ID NO: 46228 - DNA, 40 bp, Homo sapiens
  misc_feature 1..40: note = chr20:52693155-52693195
  misc_feature 1..40: note = hypo
  source 1..40: mol_type = genomic DNA
tttttttttttgagacggagtcttgctctgtcaccaagct

SEQ ID NO: 46229 - DNA, 99 bp, Homo sapiens
  misc_feature 1..99: note = chr20:52693375-52693474
  misc_feature 1..99: note = hypo
  source 1..99: mol_type = genomic DNA
gacctcggggcacccttcttttattgcgaaaattgtgtcttatttatatttgtaacctaagtgcctacctgaatgccagcccaacgtcaatgttgcctc

SEQ ID NO: 46230 - DNA, 30 bp, Homo sapiens
  misc_feature 1..30: note = chr20:52773951-52773981
  misc_feature 1..30: note = hypo
  source 1..30: mol_type = genomic DNA
agctctgctaatcggcgaccaatgcacatt

SEQ ID NO: 46231 - DNA, 198 bp, Homo sapiens
  misc_feature 1..198: note = chr20:52867324-52867522
  misc_feature 1..198: note = hypo
  source 1..198: mol_type = genomic DNA
gggctgaccccccacctcgagagggaatcttttgatgaacttgccactcatcaagattacacaactagtaagaggtggagctaagagttgaactcagacaatatgaacctaaaaaccagtgttactaaatgagtcactccaatgaagaactttaactggaaatttggtgtcctacggagaggccgtagcatgcaaaga

SEQ ID NO: 46232 - DNA, 79 bp, Homo sapiens
  misc_feature 1..79: note = chr20:53051998-53052077
  misc_feature 1..79: note = hypo
  source 1..79: mol_type = genomic DNA
gatttagcctgctatcgtttgccaacccctcttatgggtcataggtaatttgcttgcatttaaatagctgttaaggccg

SEQ ID NO: 46233 - DNA, 24 bp, Homo sapiens
  misc_feature 1..24: note = chr20:53209356-53209380
  misc_feature 1..24: note = hypo
  source 1..24: mol_type = genomic DNA
caccacgcccggccagataaattt

SEQ ID NO: 46234 - DNA, 23 bp, Homo sapiens
  misc_feature 1..23: note = chr20:53535735-53535758
  misc_feature 1..23: note = hypo
  source 1..23: mol_type = genomic DNA
aaaaccaggaggggccgggcgcg

SEQ ID NO: 46235 - DNA, 30 bp, Homo sapiens
  misc_feature 1..30: note = chr20:53866697-53866727
  misc_feature 1..30: note = hypo
  source 1..30: mol_type = genomic DNA
acaaaaacaattccacgatccctgcattta

SEQ ID NO: 46236 - DNA, 18 bp, Homo sapiens
  misc_feature 1..18: note = chr20:54585945-54585963
  misc_feature 1..18: note = hypo
  source 1..18: mol_type = genomic DNA
tttgaggtgcagtctcgc

SEQ ID NO: 46237 - DNA, 101 bp, Homo sapiens
  misc_feature 1..101: note = chr20:55378966-55379067
  misc_feature 1..101: note = hypo
  source 1..101: mol_type = genomic DNA
tttctccacactcatcgtcccaggtgttgatttgttgatttttataaaccaatcataaccagttcagccttttttttttttttttttttttgagacggagt

SEQ ID NO: 46238 - DNA, 38 bp, Homo sapiens
  misc_feature 1..38: note = chr20:55379439-55379477
  misc_feature 1..38: note = hypo
  source 1..38: mol_type = genomic DNA
ttcagccttcttctccctccacacgccatccggggggt

SEQ ID NO: 46239 - DNA, 284 bp, Homo sapiens
  misc_feature 1..284: note = chr20:55693381-55693665
  misc_feature 1..284: note = hypo
  source 1..284: mol_type = genomic DNA
accccacctaagcaccgctcaccccactacacccgcagcactgcccgcctcacagagcagggccccacctgcctcagagtaagaaaccagcagctccaccacccctggaggctgccttggcgcagcactggaaacattcataagaacacagctgccttttccgagattcagaggttgctctggtgcctgtcacctgcccaggaatcctgctttccagcaaaggtgcctgtaattctaacttttaaagaatgtctcagggccgggcgcggtggctcacacctgta

SEQ ID NO: 46240 - DNA, 30 bp, Homo sapiens; identical to SEQ ID NO: 16624
  misc_feature 1..30: note = chr20:55925381-55925411
  misc_feature 1..30: note = hypo
  source 1..30: mol_type = genomic DNA

SEQ ID NO: 46241 - DNA, 215 bp, Homo sapiens
  misc_feature 1..215: note = chr20:55958990-55959205
  misc_feature 1..215: note = hypo
  source 1..215: mol_type = genomic DNA
gcttaaaatgtaaatcggctcccgaaaaagaactgacctgcattcttaatcttttattctttttccctcctgactgtggtgcagaggaggcagtatgggaggagacaaagctcaaagaaggcactgacaatccccagcatcctacgggcccgaatccacactgcggattccgtcagctcactggcggcagcactctctggtgtcttttttttttt

SEQ ID NO: 46242 - DNA, 94 bp, Homo sapiens
  misc_feature 1..94: note = chr20:55959325-55959419
  misc_feature 1..94: note = hypo
  source 1..94: mol_type = genomic DNA
tagctgggattacaggagtgaaccactgcacctggccttctcttgtgtcttttgtctttcatttctcttcttcactacccgtcagcatgatagg

SEQ ID NO: 46243 - DNA, 117 bp, Homo sapiens
  misc_feature 1..117: note = chr20:55969858-55969975
  misc_feature 1..117: note = hypo
  source 1..117: mol_type = genomic DNA
ggggcatggactgggcgggagcagctgcccagaggtgagggtgtgtgcctccagtgcctgcagctcttttctgcttacagtgggataaggccttcccacgtgcgtctgggctcgctc

SEQ ID NO: 46244 - DNA, 35 bp, Homo sapiens
  misc_feature 1..35: note = chr20:55989687-55989722
  misc_feature 1..35: note = hypo
  source 1..35: mol_type = genomic DNA
tgctagcagggtaagcgaagcgatggagggtgggt

SEQ ID NO: 46245 - DNA, 30 bp, Homo sapiens
  misc_feature 1..30: note = chr20:56041897-56041927
  misc_feature 1..30: note = hypo
  source 1..30: mol_type = genomic DNA
tccacatcctagtcccggcacgttttgagt

SEQ ID NO: 46246 - DNA, 23 bp, Homo sapiens
  misc_feature 1..23: note = chr20:56053945-56053968
  misc_feature 1..23: note = hypo
  source 1..23: mol_type = genomic DNA
gttatccaaattagccgggcacg

SEQ ID NO: 46247 - DNA, 30 bp, Homo sapiens
  misc_feature 1..30: note = chr20:56065208-56065238
  misc_feature 1..30: note = hypo
  source 1..30: mol_type = genomic DNA
gattcattggttgggcgtggtggctcacgc

SEQ ID NO: 46248 - DNA, 30 bp, Homo sapiens
  misc_feature 1..30: note = chr20:56265981-56266011
  misc_feature 1..30: note = hypo
  source 1..30: mol_type = genomic DNA
gatgcctctacaccccgaggcctggggatc

SEQ ID NO: 46249 - DNA, 180 bp, Homo sapiens
  misc_feature 1..180: note = chr20:56271495-56271675
  misc_feature 1..180: note = hypo
  source 1..180: mol_type = genomic DNA
tcaaatcctgctctgcggtgtgctgggcaatccctggcaggtgacttagctccacctcctccatgcgatggggttgccatgaggattagtgagacagggtgtgcaaagagctcagtgagcacctgccactgtcagtaggaattgctagggttcaaaaagccgcgacgtcaccggcaagaa

SEQ ID NO: 46250 - DNA, 30 bp, Homo sapiens
  misc_feature 1..30: note = chr20:56385780-56385810
  misc_feature 1..30: note = hypo
  source 1..30: mol_type = genomic DNA
tcggttgggagcattcggctgctggtaata

SEQ ID NO: 46251 - DNA, 90 bp, Homo sapiens
  misc_feature 1..90: note = chr20:56766160-56766250
  misc_feature 1..90: note = hypo
  source 1..90: mol_type = genomic DNA
cccccaacacatgcacgtgccaagaaccagtctggtcagttagaatcctccatcctggccgggcgcggtggctcacgcctgtaatcccag

SEQ ID NO: 46252 - DNA, 30 bp, Homo sapiens
  misc_feature 1..30: note = chr20:56771631-56771661
  misc_feature 1..30: note = hypo
  source 1..30: mol_type = genomic DNA
gggtgtctacttctccgaggacccagacac

SEQ ID NO: 46253 - DNA, 305 bp, Homo sapiens
  misc_feature 1..305: note = chr20:56771994-56772299
  misc_feature 1..305: note = hypo
  source 1..305: mol_type = genomic DNA
cctttgtgctgcctccggagtgtcccactggcctgaagcttagcacaaccacactgagctggtcaccttcacctctagccccgctggcccatccatcttaccaccaccccgtcaccggggccacctctcctgggcctcctcctctcccactccaccccgtcaccggggccacctctcctgggcctcctcctctcccactctgccccgtcaccggggccacctcttctggccctcctctcccactccgccccgtcaccggggccacctctcctggccctccgcctctccctcgcttcttttctcct

SEQ ID NO: 46254 - DNA, 30 bp, Homo sapiens
  misc_feature 1..30: note = chr20:56780688-56780718
  misc_feature 1..30: note = hypo
  source 1..30: mol_type = genomic DNA
cactccccacatctgcgcccacacctgaag

SEQ ID NO: 46255 - DNA, 40 bp, Homo sapiens
  misc_feature 1..40: note = chr20:56781064-56781104
  misc_feature 1..40: note = hypo
  source 1..40: mol_type = genomic DNA
caccccacatccccgcgtctgtgcccgcacctgaagacgc

SEQ ID NO: 46256 - DNA, 30 bp, Homo sapiens
  misc_feature 1..30: note = chr20:56839640-56839670
  misc_feature 1..30: note = hypo
  source 1..30: mol_type = genomic DNA
tcatcctggcagtagcgttccaagtcaact

SEQ ID NO: 46257 - DNA, 30 bp, Homo sapiens; identical to SEQ ID NO: 16627
  misc_feature 1..30: note = chr20:57198958-57198988
  misc_feature 1..30: note = hypo
  source 1..30: mol_type = genomic DNA

SEQ ID NO: 46258 - DNA, 32 bp, Homo sapiens
  misc_feature 1..32: note = chr20:57268913-57268945
  misc_feature 1..32: note = hypo
  source 1..32: mol_type = genomic DNA
ccgcccacttcatcacgcggctggtgcggacc

SEQ ID NO: 46259 - DNA, 38 bp, Homo sapiens
  misc_feature 1..38: note = chr20:57392369-57392407
  misc_feature 1..38: note = hypo
  source 1..38: mol_type = genomic DNA
gagcgggggctttcccgaggaggcgtcagtgagggtgg

SEQ ID NO: 46260 - DNA, 30 bp, Homo sapiens
  misc_feature 1..30: note = chr20:57398016-57398046
  misc_feature 1..30: note = hypo
  source 1..30: mol_type = genomic DNA
tggccccagcacctgcgctcttgcctgccc

SEQ ID NO: 46261 - DNA, 76 bp, Homo sapiens
  misc_feature 1..76: note = chr20:57622769-57622845
  misc_feature 1..76: note = hypo
  source 1..76: mol_type = genomic DNA
caatttccctagggacgatattccccaggggacattggcactgtctggagacatgctcggttgtcccaactggtgg

SEQ ID NO: 46262 - DNA, 76 bp, Homo sapiens
  misc_feature 1..76: note = chr20:57622905-57622981
  misc_feature 1..76: note = hypo
  source 1..76: mol_type = genomic DNA
cacaagttggcaactgactccctgccccaacaaagagggatctggccccaaatgttgacaacgtcagtgttgaaac

SEQ ID NO: 46263 - DNA, 51 bp, Homo sapiens
  misc_feature 1..51: note = chr20:57699771-57699822
  misc_feature 1..51: note = hypo
  source 1..51: mol_type = genomic DNA
acctcagatctctctcgtgtaaggggctggccccttcgagaggctcagtgt

SEQ ID NO: 46264 - DNA, 197 bp, Homo sapiens
  misc_feature 1..197: note = chr20:58283870-58284067
  misc_feature 1..197: note = hypo
  source 1..197: mol_type = genomic DNA
gataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaa

SEQ ID NO: 46265 - DNA, 159 bp, Homo sapiens
  misc_feature 1..159: note = chr20:58311576-58311735
  misc_feature 1..159: note = hypo
  source 1..159: mol_type = genomic DNA
gctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacac

SEQ ID NO: 46266 - DNA, 68 bp, Homo sapiens
  misc_feature 1..68: note = chr20:58348402-58348470
  misc_feature 1..68: note = hypo
  source 1..68: mol_type = genomic DNA
cacccacggggtctccgcatctcaccacggtccaccggcctcttcccccaagccgcgtcattgaggag

SEQ ID NO: 46267 - DNA, 317 bp, Homo sapiens
  misc_feature 1..317: note = chr20:58507720-58508037
  misc_feature 1..317: note = hypo
  source 1..317: mol_type = genomic DNA
tccgtctcgggaaaaaaaacaacaaaaaaaaaccacgctgccgtattcgcagatgctcggccagcctggagcccggtccagaaaaggccgcacgtggagccacgtgtcgcgcattgagccgccgcgggacgcatcaggcccagctgcgcggaggggctggcggcctcaaccgcaaggagaggccgcaggtggggacggcgggagggagagaagggactgaaggcgccgagcaggaggaaggttttgcgcgcactcccttcttccctaagtggaaccggcagtggcaacaacgaggccgaaggcgaagtccctgctcc

SEQ ID NO: 46268 - DNA, 303 bp, Homo sapiens
  misc_feature 1..303: note = chr20:58514097-58514400
  misc_feature 1..303: note = hypo
  source 1..303: mol_type = genomic DNA
ggatccagctctcttcgcactccccgcgaggcatgtgcagcgcgtggttgcgacatgtgaggctgtagtctcggtggtcgttgttgtcccagtactcggcacccgccacttggtagcgcaccgcgaagtgcacgcgggagccgagctccagcaggaagggcggtactggaaagccgaaggtgaaaacgtcctccgtgccctcggggcctgcgggcccgcgccaccgcgccaccgcctcgtgggtactgcgccagcccgagaaagtgtagcgcacagccacctgcttctcgaaggccacgttgc

SEQ ID NO: 46269 - DNA, 30 bp, Homo sapiens
  misc_feature 1..30: note = chr20:58671797-58671827
  misc_feature 1..30: note = hypo
  source 1..30: mol_type = genomic DNA
tttttttttcacgcacgtgtccctttgcca

SEQ ID NO: 46270 - DNA, 99 bp, Homo sapiens
  misc_feature 1..99: note = chr20:59005702-59005801
  misc_feature 1..99: note = hypo
  source 1..99: mol_type = genomic DNA
agaatcccattctcacggcggcttgcaggaccccatgtgatctcctaaccccctatatctcccctccacactcttccctcctgccgctctcacccctgc

SEQ ID NO: 46271 - DNA, 31 bp, Homo sapiens
  misc_feature 1..31: note = chr20:59185805-59185836
  misc_feature 1..31: note = hypo
  source 1..31: mol_type = genomic DNA
agccaccacgcccggccgagtaaaagtttct

SEQ ID NO: 46272 - DNA, 185 bp, Homo sapiens
  misc_feature 1..185: note = chr20:59232938-59233123
  misc_feature 1..185: note = hypo
  source 1..185: mol_type = genomic DNA
tccatgtgccagctccggacctgtttttaactcatcggcaacatttttaaaaataaggtatttcacataaaagtcagtatgtccaggttttggggggaatgataagattcagtatcaaggggctcctgttcccagatggaaggaaacgggcagggccgcccttcacacagcgttgctccgtccag

SEQ ID NO: 46273 - DNA, 30 bp, Homo sapiens
  misc_feature 1..30: note = chr20:59598638-59598668
  misc_feature 1..30: note = hypo
  source 1..30: mol_type = genomic DNA
tgcaggctcctagttcgaagctgtgatgtt

SEQ ID NO: 46274 - DNA, 185 bp, Homo sapiens
  misc_feature 1..185: note = chr20:59708146-59708331
  misc_feature 1..185: note = hypo
  source 1..185: mol_type = genomic DNA
agctcagctggcccacgcaagttccacactgacacagggcaagggaggaagccaaccagggaggccgtgccgaggaagaaaagcacaaaagtattgctaaaaatgtacaggagaaaagagaggatgagaaggatcaggatgtgaggcagaatatgcttagctgccaacagcgcatggcagtatcc

SEQ ID NO: 46275 - DNA, 94 bp, Homo sapiens
  misc_feature 1..94: note = chr20:59821803-59821897
  misc_feature 1..94: note = hypo
  source 1..94: mol_type = genomic DNA
ccttgccgggggtcccgcaggcctctctgagcagaagcctgtgtgccgagcagccatcagccatcagggcatctggggccgaatgttccaaatg

SEQ ID NO: 46276 - DNA, 30 bp, Homo sapiens
  misc_feature 1..30: note = chr20:59855416-59855446
  misc_feature 1..30: note = hypo
  source 1..30: mol_type = genomic DNA
ccaatccctctctggcgcctcccaaggcgg

SEQ ID NO: 46277 - DNA, 30 bp, Homo sapiens; identical to SEQ ID NO: 16632
  misc_feature 1..30: note = chr20:59910323-59910353
  misc_feature 1..30: note = hypo
  source 1..30: mol_type = genomic DNA

SEQ ID NO: 46278 - DNA, 30 bp, Homo sapiens
  misc_feature 1..30: note = chr20:59967982-59968012
  misc_feature 1..30: note = hypo
  source 1..30: mol_type = genomic DNA
tgcagatactcaccccgatacccaccaagg

SEQ ID NO: 46279 - DNA, 70 bp, Homo sapiens
  misc_feature 1..70: note = chr20:59973035-59973105
  misc_feature 1..70: note = hypo
  source 1..70: mol_type = genomic DNA
aggctgaccgcatgccgagctgcgtgcctgggaaccacatggcaagcttcacctgcgtgtcctgaaccag

SEQ ID NO: 46280 - DNA, 158 bp, Homo sapiens
  misc_feature 1..158: note = chr20:60120725-60120883
  misc_feature 1..158: note = hypo
  source 1..158: mol_type = genomic DNA
tttggcaactggtgccgctcatgcttggcgccagcgggcaggaggcagctttgtcctgcacaccgagacagtgtgcttgtgtatgtgagtgtgtgggggtggggtgtgtgtgcatgtgtttggggggtatgtgggatacggtgcgtgttcacatgtgt

SEQ ID NO: 46281 - DNA, 30 bp, Homo sapiens
  misc_feature 1..30: note = chr20:60121193-60121223
  misc_feature 1..30: note = hypo
  source 1..30: mol_type = genomic DNA
gtatttgttcacattcgtgagggtgtgtgc

SEQ ID NO: 46282 - DNA, 30 bp, Homo sapiens
  misc_feature 1..30: note = chr20:60122026-60122056
  misc_feature 1..30: note = hypo
  source 1..30: mol_type = genomic DNA
gacagcagtgatgggcggtgcctcttagga

SEQ ID NO: 46283 - DNA, 36 bp, Homo sapiens
  misc_feature 1..36: note = chr20:60162590-60162626
  misc_feature 1..36: note = hypo
  source 1..36: mol_type = genomic DNA
ggcagggttccaggccgagcgcggggaggttagggc

SEQ ID NO: 46284 - DNA, 30 bp, Homo sapiens
  misc_feature 1..30: note = chr20:60174306-60174336
  misc_feature 1..30: note = hypo
  source 1..30: mol_type = genomic DNA
gtgccctctttcacccggctgagcgggcag

SEQ ID NO: 46285 - DNA, 159 bp, Homo sapiens
  misc_feature 1..159: note = chr20:60175455-60175614
  misc_feature 1..159: note = hypo
  source 1..159: mol_type = genomic DNA
cctggcagggtccttcggggtcctggctctggggccttgagggagtcactctagtggctgagcctgagccatctctgcaacgggagccatagtggtgctcaggtggcgggacagcggtgagaatctaattcagaaatgaatgcccgcaactcaccctgc

SEQ ID NO: 46286 - DNA, 30 bp, Homo sapiens
  misc_feature 1..30: note = chr20:60176588-60176618
  misc_feature 1..30: note = hypo
  source 1..30: mol_type = genomic DNA
cggccctgctcttcccggggcctgttcaga

SEQ ID NO: 46287 - DNA, 30 bp, Homo sapiens; identical to SEQ ID NO: 16634
  misc_feature 1..30: note = chr20:60202364-60202394
  misc_feature 1..30: note = hypo
  source 1..30: mol_type = genomic DNA

SEQ ID NO: 46288 - DNA, 30 bp, Homo sapiens; identical to SEQ ID NO: 16635
  misc_feature 1..30: note = chr20:60202615-60202645
  misc_feature 1..30: note = hypo
  source 1..30: mol_type = genomic DNA

SEQ ID NO: 46289 - DNA, 30 bp, Homo sapiens
  misc_feature 1..30: note = chr20:60210184-60210214
  misc_feature 1..30: note = hypo
  source 1..30: mol_type = genomic DNA
gcttcctgttccttacgatgtctgctgaga

SEQ ID NO: 46290 - DNA, 164 bp, Homo sapiens
  misc_feature 1..164: note = chr20:60225027-60225191
  misc_feature 1..164: note = hypo
  source 1..164: mol_type = genomic DNA
gccttctgcctgcgccggagccctgagtctccccaggttgtgccagcagctccactctcctgggcacatttcctaaatgggcagtcagcggctatcccagtcttacctgcctctccttcttgcctcttccagtgtattctcctccatgccgctgcccggcccat

SEQ ID NO: 46291 - DNA, 182 bp, Homo sapiens
  misc_feature 1..182: note = chr20:60227182-60227364
  misc_feature 1..182: note = hypo
  source 1..182: mol_type = genomic DNA
cgcttttaatgtcaccgtctctttattaaagtacataatatacactcatgataggaagagctgaaaatactggaaagaaaataaaaatcctacagaaccccagtatccacgtgaaactatggtgacaccttcgaacagttccttccaccctcttactcctttgtatacgcagctatgtatgt

SEQ ID NO: 46292 - DNA, 33 bp, Homo sapiens
  misc_feature 1..33: note = chr20:60235486-60235519
  misc_feature 1..33: note = hypo
  source 1..33: mol_type = genomic DNA
atcgaaggcaggtgacgccgggactcgcttgca

SEQ ID NO: 46293 - DNA, 158 bp, Homo sapiens
  misc_feature 1..158: note = chr20:60237356-60237514
  misc_feature 1..158: note = hypo
  source 1..158: mol_type = genomic DNA
cctttctggagccatcgctggcttcctggagccgcacagcgcaacctctgtcagggcaagtgtagcaccaggttgtgctgtccaattaatgatgaaacaacctgtcctcaacgttctcagctccgtgcgcggcttcaccattccgagcttgggaggac

SEQ ID NO: 46294 - DNA, 148 bp, Homo sapiens
  misc_feature 1..148: note = chr20:60238291-60238439
  misc_feature 1..148: note = hypo
  source 1..148: mol_type = genomic DNA
cagaggagctttcatcgagggcttggcgcccacgacaaatgagtccacgcaggaaaggagtggcacccgcaggaggcctgtgctgcggagctcctgggagggtgacgctggggcaggggctgctgcggacaagcgttgggaggcctct

SEQ ID NO: 46295 - DNA, 199 bp, Homo sapiens
  misc_feature 1..199: note = chr20:60238848-60239047
  misc_feature 1..199: note = hypo
  source 1..199: mol_type = genomic DNA
gggcaccactgaacacggggtaaaccaatcaccagtcactcccacgctgggtcttccagctccctcgaggccgccctggccctccacactcccaccgctggcgccagcatctgtgcccgcggcagtttagagtgacactgtcctctgtccagcaccggtccacgttgaggtgtctgtgtgccaccgggacccttccgta

SEQ ID NO: 46296 - DNA, 169 bp, Homo sapiens
  misc_feature 1..169: note = chr20:60243965-60244134
  misc_feature 1..169: note = hypo
  source 1..169: mol_type = genomic DNA
ttctcatcagagcaccgtccgccagcccctctctccagtctgtccttgggacaaccctgggaagccagtgggacaggtgttccaggaggacccctgtccagcgaagctcagggctgcggcaggccggcggcaggtcaggtccttccttcaccctcggggatggtgcctg

SEQ ID NO: 46297 - DNA, 54 bp, Homo sapiens
  misc_feature 1..54: note = chr20:60281411-60281465
  misc_feature 1..54: note = hypo
  source 1..54: mol_type = genomic DNA
caccacccgaggcaccgacaactgacagaaaactgcagccggcctcatttgccg

SEQ ID NO: 46298 - DNA, 71 bp, Homo sapiens
  misc_feature 1..71: note = chr20:60281806-60281877
  misc_feature 1..71: note = hypo
  source 1..71: mol_type = genomic DNA
ggttgggaatctcaccggaactggctcgggcaggacgttcatggtgaggttccaaccggaatgagtcatgt

SEQ ID NO: 46299 - DNA, 183 bp, Homo sapiens
  misc_feature 1..183: note = chr20:60304145-60304328
  misc_feature 1..183: note = hypo
  source 1..183: mol_type = genomic DNA
agccctgttgctctgcgagcgctgactgcagcgtgttttgacaagaggccctggcatctcacaagcccaggagtcctcggtgcatggcgcattggtggctggatttgccactattattctctgctcactcctgtgttggcgtgagtgggaggacttcattagcgacatcgcccacatcaagag

SEQ ID NO: 46300 - DNA, 82 bp, Homo sapiens
  misc_feature 1..82: note = chr20:60329634-60329716
  misc_feature 1..82: note = hypo
  source 1..82: mol_type = genomic DNA
tgcaggcacactgcccggaacaccacacacacggtgcacggcacacacaccacacacacacgccccacacaccacacgcaca

SEQ ID NO: 46301 - DNA, 56 bp, Homo sapiens
  misc_feature 1..56: note = chr20:60355322-60355378
  misc_feature 1..56: note = hypo
  source 1..56: mol_type = genomic DNA
cctggagggttttcccggtgcacccaacactcccctcagcccggctactccctacc

SEQ ID NO: 46302 - DNA, 130 bp, Homo sapiens
  misc_feature 1..130: note = chr20:60359749-60359879
  misc_feature 1..130: note = hypo
  source 1..130: mol_type = genomic DNA
gtaatcccagttcctcgggacagttctcaaggccctccgatatcctgtgcccccaggagaatgtaagcccagttcctcggaacagttctccaggccctcagatgtcctgtgcccccggggcctcatcaga

SEQ ID NO: 46303 - DNA, 411 bp, Homo sapiens
  misc_feature 1..411: note = chr20:60374909-60375320
  misc_feature 1..411: note = hypo
  source 1..411: mol_type = genomic DNA
agcctcataacaccacggtccctgcggggcctcgagtggggcctctgcagtggctctgccccgctccccatctctcatgcaacctccctgagagcccagggccatctccgcttgtcttcatggcccgtcccttcccatgacccgctcggctgcagcggccctcggtgggcacagtcaccgggccggcttccccgcctgtgcttcctctgaggggttccccagcccacagcatggtccagggccgggtggggccagcatcctctactccctccttgaagcctgtgcagggctgcatcttctttgtgtgcaagcaagcgagcggcctgcagccccaagggccctttgtgagtgctgcaaagccccgaagaccagaccgcactccctcgagtgcacacacggtgcttctgggaa

SEQ ID NO: 46304 - DNA, 164 bp, Homo sapiens
  misc_feature 1..164: note = chr20:60385207-60385371
  misc_feature 1..164: note = hypo
  source 1..164: mol_type = genomic DNA
gacctgttctcaagacggagacagagatgggtgagggaggccgggccagccacactaacatcccactggcagaccccgggaaaggccatggccacccacatggatgtgtgggtatggccacatgtggctatccaccgggccagtcggggcggctgtgccaggct

SEQ ID NO: 46305 - DNA, 243 bp, Homo sapiens
  misc_feature 1..243: note = chr20:60415719-60415962
  misc_feature 1..243: note = hypo
  source 1..243: mol_type = genomic DNA
ctattcacggcccatcgtgggcttctgcggtgtttgtctcatttgccagacacaaatcaagtggaaaactgttctcccctgatctggtggattcactcgcacagtatttcttcttaatatggtaaactgtgggagaattcagagcattttgagagctgatgctcagagcccgtggatgcacatcacccgcagccacccgctgcccgccatatttcagaggcggccaaacgggcctggagaata

SEQ ID NO: 46306 - DNA, 72 bp, Homo sapiens
  misc_feature 1..72: note = chr20:60428149-60428221
  misc_feature 1..72: note = hypo
  source 1..72: mol_type = genomic DNA
accacaggtgagaagcgattgcagccacagcagggccaacgggctgggaagaaaacccgggcactgggagtc

SEQ ID NO: 46307 - DNA, 30 bp, Homo sapiens
  misc_feature 1..30: note = chr20:60439765-60439795
  misc_feature 1..30: note = hypo
  source 1..30: mol_type = genomic DNA
gtggccccagcttcccgggcagacccttat

SEQ ID NO: 46308 - DNA, 30 bp, Homo sapiens
  misc_feature 1..30: note = chr20:60447479-60447509
  misc_feature 1..30: note = hypo
  source 1..30: mol_type = genomic DNA
ccaaggctggtgtggcgagagtccttcatc

SEQ ID NO: 46309 - DNA, 241 bp, Homo sapiens
  misc_feature 1..241: note = chr20:60448710-60448951
  misc_feature 1..241: note = hypo
  source 1..241: mol_type = genomic DNA
ctgcccaggtgtgtgcgggggtggcagcctgtgtggcaggccatccccatctgagctgctgtctccgttccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggacc

SEQ ID NO: 46310 - DNA, 30 bp, Homo sapiens
  misc_feature 1..30: note = chr20:60449466-60449496
  misc_feature 1..30: note = hypo
  source 1..30: mol_type = genomic DNA
gtgctgggttccatgcgctcccacctcctg

SEQ ID NO: 46311 - DNA, 152 bp, Homo sapiens
  misc_feature 1..152: note = chr20:60452936-60453088
  misc_feature 1..152: note = hypo
  source 1..152: mol_type = genomic DNA
tccattgtgtgacaacgcgtctttggctgggaggacccccaggcaggggatgaggtgtaacccaaatgaggcccggccccaagcagactgtgacagggtcatcaccaggaaccacgggggccccagagggaggacttcgtggacacagacgg

SEQ ID NO: 46312 - DNA, 166 bp, Homo sapiens
  misc_feature 1..166: note = chr20:60453925-60454091
  misc_feature 1..166: note = hypo
  source 1..166: mol_type = genomic DNA
gtgccgaggccagggcgcccctcgccagggctctgctttcagtgtgggtctgtgcttaatgttcagagctgccctgctcttccttcgcccacctcctggggaaattgaatgatggtttataattataaccgcttctgcagcagaggatgcacgttgtcggattttc

SEQ ID NO: 46313 - DNA, 136 bp, Homo sapiens
  misc_feature 1..136: note = chr20:60454749-60454885
  misc_feature 1..136: note = hypo
  source 1..136: mol_type = genomic DNA
taatgaggaggtgaacgtgccgcccgagccccgtcctgaaggtgagagtgggctctgcagacgcaggcgctgttccgattgttgggcagtgaaattagcaccgggccagcattgttctcagcgtcccttccaggct

SEQ ID NO: 46314 - DNA, 30 bp, Homo sapiens
  misc_feature 1..30: note = chr20:60457286-60457316
  misc_feature 1..30: note = hypo
  source 1..30: mol_type = genomic DNA
ggctgaccatttgcacgtgggcggtgccac

SEQ ID NO: 46315 - DNA, 231 bp, Homo sapiens
  misc_feature 1..231: note = chr20:60477306-60477537
  misc_feature 1..231: note = hypo
  source 1..231: mol_type = genomic DNA
cagaaaaggtcaagccggggcctctgaaaccaggacccccggggcctccattccaggagaagcagcctcactctgcccttcaccagccacggagacccggggtctatgggcagtgccctaaatgccagccatgccctggggcacgcggtcaccaccccgcagaaccgctcccgtgctcgttgcaggagtgcaagggcagatccacagaggagcgtgcggggccccaccttc

SEQ ID NO: 46316 - DNA, 30 bp, Homo sapiens
  misc_feature 1..30: note = chr20:60492778-60492808
  misc_feature 1..30: note = hypo
  source 1..30: mol_type = genomic DNA
atggccacgtgtgggcggcagccatgctga

SEQ ID NO: 46317 - DNA, 30 bp, Homo sapiens
  misc_feature 1..30: note = chr20:60495131-60495161
  misc_feature 1..30: note = hypo
  source 1..30: mol_type = genomic DNA
gtgtcacggtgattgcgtggaagcatgttg

SEQ ID NO: 46318 - DNA, 111 bp, Homo sapiens
  misc_feature 1..111: note = chr20:60502200-60502311
  misc_feature 1..111: note = hypo
  source 1..111: mol_type = genomic DNA
catttttacatggttcgcctgcctcagtcaaaacacgtggttgttaacgtcaggtcaggagctgccatcaggagcaaagctacagtcagaacatgccgccaccaccgccgc

SEQ ID NO: 46319 - DNA, 40 bp, Homo sapiens
  misc_feature 1..40: note = chr20:60502586-60502626
  misc_feature 1..40: note = hypo
  source 1..40: mol_type = genomic DNA
gcagcagttcttccacgcgatcatgcgtctgggctcaggg

SEQ ID NO: 46320 - DNA, 228 bp, Homo sapiens
  misc_feature 1..228: note = chr20:60502832-60503060
  misc_feature 1..228: note = hypo
  source 1..228: mol_type = genomic DNA
ggctgtgagtttccacgtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatggcgtgtggcagggtgtcggtcaggagccatg

SEQ ID NO: 46321 - DNA, 179 bp, Homo sapiens
  misc_feature 1..179: note = chr20:60515823-60516002
  misc_feature 1..179: note = hypo
  source 1..179: mol_type = genomic DNA
cgctgtcctaggctgcgggaaaacagaaagaacaaagccaggcccgctcctcacacctgtgggcccacatgccatctgtctcaatgttttaaagggtttagaaggtatccatgaaactaacaagcaaaatcacattcccctcctaccttggcatatacacctcccggactccatggaat

SEQ ID NO: 46322 - DNA, 107 bp, Homo sapiens
  misc_feature 1..107: note = chr20:60552230-60552337
  misc_feature 1..107: note = hypo
  source 1..107: mol_type = genomic DNA
ccacacacacgacaccgcccagcggggcgcgcgccacacacacacaacaccgcccagcggggcgcgcaccacacacacacgacaccgcccagcggggcacgtgccac

SEQ ID NO: 46323 - DNA, 46 bp, Homo sapiens
  misc_feature 1..46: note = chr20:60578805-60578851
  misc_feature 1..46: note = hypo
  source 1..46: mol_type = genomic DNA
ctggatctgctgaggcgtggtgagcatgatccggttgtgaggctgc

SEQ ID NO: 46324 - DNA, 740 bp, Homo sapiens
  misc_feature 1..740: note = chr20:60772977-60773717
  misc_feature 1..740: note = hypo
  source 1..740: mol_type = genomic DNA
gagtaaaaactgcttcgggcgcagtggcgccgtcctctacatccgggtgagccgagactgccggacctggccctgtccccgttgttctggatcatccagctcctgggggccaccgtgtgacccacggggcccctgtggcttgatgcccacagctaggaaacagcacaatggaaacggaggctggcagacagcgggaaagcagccccacccctcaaagcaaacccagacgggcatttgtaccagggtctcacaccatgtgcatgtctagtgaaaaagtcatgaaacgattctcttttaaaaagagggagcccacggcacggacgcttcctccgtctctgaccccatgagccgacctctgactgagggaggccactggcacccagcgggcctgcgtctccttcgcgagctgaattcactcgtctcttagatgttttttctggtgcttcagttcacactaacgttttagaaacactatttgaaaaagccctttgtgcagtcagaagggtgtgtacgcagccccgtgaaagccctggagcactgggaccttttccttgtgctccggagctgttggcagaggtgagtggggcgggcagctgcccggggcacagtccgctcttgtcttctttccttagcgcttgcttcaggaatgggttaaggcctcctttcctcactgctggtagagctcagctgatgagtgcctgctgttccccaggtccccgtgggcacgctggtgaaggagg

SEQ ID NO: 46325 - DNA, 179 bp, Homo sapiens
  misc_feature 1..179: note = chr20:60781327-60781506
  misc_feature 1..179: note = hypo
  source 1..179: mol_type = genomic DNA
acatgctgaggcaaccggagcgtctcatcagtgaacacacgtgccggggacctgtcctggtgccgctaaagaggctgcagagccgcggggtgcggcagtgcttggcgggggcggggtgcagctctgcgtgcatggcgtccacctggggaccgcaggtgtcaagccggggagagccagtg

SEQ ID NO: 46326 - DNA, 211 bp, Homo sapiens
  misc_feature 1..211: note = chr20:60789965-60790176
  misc_feature 1..211: note = hypo
  source 1..211: mol_type = genomic DNA
tctctcctcaaagcacgaaggctctgagcaccccacaaagtcctcaggaatcagcaccaataaaaaaatacactttattgtgacctcacggtttgcagggcagcgcagcgggcacaggcagaggagcatgcagagcgcgtggcacgggtgcacagcacatggcgaagcggcccctgcccgggcacctcctctggaccgcccctgcacgcct

SEQ ID NO: 46327 - DNA, 34 bp, Homo sapiens
  misc_feature 1..34: note = chr20:60803825-60803859
  misc_feature 1..34: note = hypo
  source 1..34: mol_type = genomic DNA
ctatgtgtgtgtgcacgtgcgtctgtgggtctgc

SEQ ID NO: 46328 - DNA, 27 bp, Homo sapiens
  misc_feature 1..27: note = chr20:60816241-60816268
  misc_feature 1..27: note = hypo
  source 1..27: mol_type = genomic DNA
tttgagatggagtctcgctctgtcgcc

SEQ ID NO: 46329 - DNA, 66 bp, Homo sapiens
  misc_feature 1..66: note = chr20:60921238-60921304
  misc_feature 1..66: note = hypo
  source 1..66: mol_type = genomic DNA
tgccatccgtgaagtcggactcgcagttgcagcctgggcaggggcaggagccgggtaagcctggag

SEQ ID NO: 46330 - DNA, 41 bp, Homo sapiens
  misc_feature 1..41: note = chr20:60921597-60921638
  misc_feature 1..41: note = hypo
  source 1..41: mol_type = genomic DNA
gagagcggtagaagccgggcaggcagcgctcacagttgacg

SEQ ID NO: 46331 - DNA, 61 bp, Homo sapiens
  misc_feature 1..61: note = chr20:60921962-60922023
  misc_feature 1..61: note = hypo
  source 1..61: mol_type = genomic DNA
actcacactggcactcgttggcactgttggcagtcgcaggcttccacggctgctgattgaa

SEQ ID NO: 46332 - DNA, 260 bp, Homo sapiens
  misc_feature 1..260: note = chr20:60925281-60925541
  misc_feature 1..260: note = hypo
  source 1..260: mol_type = genomic DNA
cactccctgctgtcacgagctgcgtccccacttggcacttaatttcccaggacaagttagctctgctggagctcagcacctgaagctgtgctggcagcaacaagtgcctgggtgggtccccagggcccacagctcctggcaaacagcccaagtcctccggctcaggtgactgtgccactcctcccctcagacccaccagccacatccgaaggggcccagggctcccgcctctgctcggcactggccgtgagaatgggagt

SEQ ID NO: 46333 - DNA, 110 bp, Homo sapiens
  misc_feature 1..110: note = chr20:60925847-60925957
  misc_feature 1..110: note = hypo
  source 1..110: mol_type = genomic DNA
cccagctgcctcccccggaacaggtgctcctgaggccgggctggggtcccaccctgtgttcccattcccaggaaaacggcccagcgtgtgttaggcgctcaacatacagc

SEQ ID NO: 46334 - DNA, 228 bp, Homo sapiens
  misc_feature 1..228: note = chr20:60953312-60953540
  misc_feature 1..228: note = hypo
  source 1..228: mol_type = genomic DNA
caagacaagcctgggcgactcacctggggcaggaatgtggattccatcactccgcagaggctttcaagcaaaacacagcctcgtctctgggcctgtttctgccgtgcgggcacgtccagcccgacgctctcagaagcagctgggatgggctcggggaggtgggggtggagcaggagtcccagccgccttcctctggggcccatcccaggctcccggctgggcgccagc

SEQ ID NO: 46335 - DNA, 50 bp, Homo sapiens; identical to SEQ ID NO: 16653
  misc_feature 1..50: note = chr20:60970933-60970983
  misc_feature 1..50: note = hypo
  source 1..50: mol_type = genomic DNA

SEQ ID NO: 46336 - DNA, 271 bp, Homo sapiens
  misc_feature 1..271: note = chr20:60983859-60984130
  misc_feature 1..271: note = hypo
  source 1..271: mol_type = genomic DNA
gagaacagaaaggggcgagtgagggtggagggcaggacgcaggaggcaggaggcagctgtccgtgctggctgcagcgccgggtcctggggatcggctgtgcagtaggggggcccctagccagttcttctttgctggcgctaagctagactttgagggacaaggaggaatgctgaggaaggaacggggtctcttcctgggtctggtgaacccccttgctaggctcccgctgccagtcttctcccctccccagggtgtcgatgggtggccaaa

SEQ ID NO: 46337 - DNA, 30 bp, Homo sapiens; identical to SEQ ID NO: 16655
  misc_feature 1..30: note = chr20:60984485-60984515
  misc_feature 1..30: note = hypo
  source 1..30: mol_type = genomic DNA

SEQ ID NO: 46338 - DNA, 518 bp, Homo sapiens
  misc_feature 1..518: note = chr20:61288016-61288534
  misc_feature 1..518: note = hypo
  source 1..518: mol_type = genomic DNA
gggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacc

SEQ ID NO: 46339 - DNA, 319 bp, Homo sapiens
  misc_feature 1..319: note = chr20:61291131-61291450
  misc_feature 1..319: note = hypo
  source 1..319: mol_type = genomic DNA
ggccttttgccctcccgccgctgcctcactgtgaagacacatccccgaaagcccagagcttgtcctcactgtgaagacgcgtccctggatgcccagagcttggatgggcttctaccactccacggccgcctcagcccatggttattttccactcgccttttcgtttgaaagcacttatgtgcaaattgccacgtgcacaacagtcccttcgtggggagctctcagtgagctccagctgagccctctggcgtccctgggaaccccatctgtcatcctctgcactgtggggagggatgcctcctcccgctgttgcctggag

SEQ ID NO: 46340 - DNA, 295 bp, Homo sapiens
  misc_feature 1..295: note = chr20:61294577-61294872
  misc_feature 1..295: note = hypo
  source 1..295: mol_type = genomic DNA
taactagggctgcaccgtctgttcctgattcttcagaatccatttacatttggccacctcctcaaacaagagcatttgaatgttccaggcattcagagttgcgttcatcggaaccaggctctaggtgtggccgagaggaaagagccgccctcctgcaggtgggggtgatgtgaggccgacagtctgctctggtgagaggctggaaagtgtaggtttacaggatgtcactaagctgcagacgcaggggttcaagtcagcgacactgcggtgtgagcagaggcgacatggacatgtc

SEQ ID NO: 46341 - DNA, 84 bp, Homo sapiens
  misc_feature 1..84: note = chr20:61305619-61305703
  misc_feature 1..84: note = hypo
  source 1..84: mol_type = genomic DNA
gtggcactgagcatccgtgtggaggtgtccatggggccctcggggagactcatgggagctgtcagcctgcgggctgagctgaga

SEQ ID NO: 46342 - DNA, 30 bp, Homo sapiens
  misc_feature 1..30: note = chr20:61305919-61305949
  misc_feature 1..30: note = hypo
  source 1..30: mol_type = genomic DNA
ctgactcacagatgacgattccaagggtct

SEQ ID NO: 46343 - DNA, 50 bp, Homo sapiens
  misc_feature 1..50: note = chr20:61312710-61312760
  misc_feature 1..50: note = hypo
  source 1..50: mol_type = genomic DNA
ctgcttatactcactcgtgtgcgtgtgtattaagccgtgtcacttgtgtg

SEQ ID NO: 46344 - DNA, 34 bp, Homo sapiens
  misc_feature 1..34: note = chr20:61314672-61314706
  misc_feature 1..34: note = hypo
  source 1..34: mol_type = genomic DNA
tcctgcagagccagccgctcgctgctggccatgc

SEQ ID NO: 46345 - DNA, 30 bp, Homo sapiens
  misc_feature 1..30: note = chr20:61318633-61318663
  misc_feature 1..30: note = hypo
  source 1..30: mol_type = genomic DNA
atgaagttgaccaaacgccacacagccacg

SEQ ID NO: 46346 - DNA, 115 bp, Homo sapiens
  misc_feature 1..115: note = chr20:61321299-61321414
  misc_feature 1..115: note = hypo
  source 1..115: mol_type = genomic DNA
ccccaggggctgagtcgacgcctgcagccagcgcctgcactcctgttcacatgggcttccctggcctctgtgcctgctttgcgcctgcgcggcaggtgaacgaccccagccccct

SEQ ID NO: 46347 - DNA, 160 bp, Homo sapiens
  misc_feature 1..160: note = chr20:61329188-61329348
  misc_feature 1..160: note = hypo
  source 1..160: mol_type = genomic DNA
ggggctgggctgctgcgggatgaatgcctggccagtggtggggacatgtcttacaggcagcacagaacacacctgagaggataaaagctcatgtggtctcagcacctgccgatggagtcggggggtgagagagaataagaacacccgaaaaaatcaggga

SEQ ID NO: 46348 - DNA, 131 bp, Homo sapiens
  misc_feature 1..131: note = chr20:61330920-61331051
  misc_feature 1..131: note = hypo
  source 1..131: mol_type = genomic DNA
ggctcccaagtggaccgggaaaggctcccgagtggaccgggacaggctcccgagtggaccgggacaggctccctctctcttgctgctgggatgtctccccgggagcttgcgtctctcgccaccctcacctc

SEQ ID NO: 46349 - DNA, 30 bp, Homo sapiens
  misc_feature 1..30: note = chr20:61368079-61368109
  misc_feature 1..30: note = hypo
  source 1..30: mol_type = genomic DNA
catgcacacacctggcgtaggagttacttc

SEQ ID NO: 46350 - DNA, 136 bp, Homo sapiens
  misc_feature 1..136: note = chr20:61374450-61374586
  misc_feature 1..136: note = hypo
  source 1..136: mol_type = genomic DNA
gctgggaggggagcacggagccgcccctgctggacacgtatcccggccatctcaggcccacccattgcctcattgctccctgcccccggtccagtcagctgagtgccccgtggtgtgggtgcgtcatgccatggcg

SEQ ID NO: 46351 - DNA, 215 bp, Homo sapiens
  misc_feature 1..215: note = chr20:61393835-61394050
  misc_feature 1..215: note = hypo
  source 1..215: mol_type = genomic DNA
tatctgtgcacttaccgtaggtagggacacgtgtccacgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactc

SEQ ID NO: 46352 - DNA, 22 bp, Homo sapiens
  misc_feature 1..22: note = chr20:61411096-61411118
  misc_feature 1..22: note = hypo
  source 1..22: mol_type = genomic DNA
agttagaaagctcttcgttgtg

SEQ ID NO: 46353 - DNA, 156 bp, Homo sapiens
  misc_feature 1..156: note = chr20:61412187-61412343
  misc_feature 1..156: note = hypo
  source 1..156: mol_type = genomic DNA
gagcccaggtgccaccgagggaatgcaacgtgccacaccccaagacatgacacttgtgagaacagtgtggcccagcccccactccgggcacagcctcggacaccctgcccgcctccgcccatggaggtgcggcctgcaaagcgtacctgccgccgc

SEQ ID NO: 46354 - DNA, 30 bp, Homo sapiens
  misc_feature 1..30: note = chr20:61424994-61425024
  misc_feature 1..30: note = hypo
  source 1..30: mol_type = genomic DNA
taacggtgagggtcccgtctcccgagcgta

SEQ ID NO: 46355 - DNA, 58 bp, Homo sapiens
  misc_feature 1..58: note = chr20:61472103-61472161
  misc_feature 1..58: note = hypo
  source 1..58: mol_type = genomic DNA
agtgacaaggacgcccgaagcacagtggacggtcatgaaggagcgggggtgtggcagg

SEQ ID NO: 46356 - DNA, 685 bp, Homo sapiens
  misc_feature 1..685: note = chr20:61505851-61506536
  misc_feature 1..685: note = hypo
  source 1..685: mol_type = genomic DNA
cagggagaagcccaccgaccctgtggggctggtccctacaggggcatgtgggaagatcccagtgaagctgaggaccacgagccctgcaagtccattgggatctgccggtgaactccgcaggtcgtctttgaaggcacatgtggctcttctgccactgcctggggagctgagacccctttgcccaaagaccctcaagtgccttccctagggagctgccctgtaaggtgccgccgtcctgcccgggactcaccaccacctctgtgttccttctagacctagatccagactggagttccagcaggccccaaaagagaaagtgtgaggtgtggcctacaaatatgtttccctacgaaaacctgcggaaaatgtgtggaaatcgatgttgagagtgcgggatctgggtgggaggaatataagcttgcgtaagtggacagggactcagatacgagattctggatttgatgcgttggagggaacggctgggagtgacccaccccccacccccattttcttcatcagtcaccgaaactttcgccccacaggtagctgaccctaaattcagtgaaatccagaactttcctggcacactggagaggacggcagaacgctgggatggatttatcgtgcaagaccagcttgatgtccttagggcttggaggtcaccccttcacgaggattgtgagga

SEQ ID NO: 46357 - DNA, 30 bp, Homo sapiens
  misc_feature 1..30: note = chr20:61541112-61541142
  misc_feature 1..30: note = hypo
  source 1..30: mol_type = genomic DNA
ttatcccttggtcttcgctagacttctgct

SEQ ID NO: 46358 - DNA, 76 bp, Homo sapiens
  misc_feature 1..76: note = chr20:61567431-61567507
  misc_feature 1..76: note = hypo
  source 1..76: mol_type = genomic DNA
ctcaagctttctgctcgtgcatccccttgcacactttctccttgacgttcaggctgggcatggtggctgacgcctg

SEQ ID NO: 46359 - DNA, 331 bp, Homo sapiens
  misc_feature 1..331: note = chr20:61570543-61570874
  misc_feature 1..331: note = hypo
  source 1..331: mol_type = genomic DNA
ttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattcagacacctgcttgatttctccagacgcatgtctaatagt

SEQ ID NO: 46360 - DNA, 30 bp, Homo sapiens
  misc_feature 1..30: note = chr20:61571213-61571243
  misc_feature 1..30: note = hypo
  source 1..30: mol_type = genomic DNA
aagtagtatgtgtaacgtatgtatcagtgg

SEQ ID NO: 46361 - DNA, 30 bp, Homo sapiens
  misc_feature 1..30: note = chr20:61618995-61619025
  misc_feature 1..30: note = hypo
  source 1..30: mol_type = genomic DNA
ggtgaacacggagctcgggggacacgacca

SEQ ID NO: 46362 - DNA, 39 bp, Homo sapiens
  misc_feature 1..39: note = chr20:61655625-61655664
  misc_feature 1..39: note = hypo
  source 1..39: mol_type = genomic DNA
agttatgtgaacagccgccaccctcgtgcgggcaaaagc

SEQ ID NO: 46363 - DNA, 30 bp, Homo sapiens
  misc_feature 1..30: note = chr20:61666827-61666857
  misc_feature 1..30: note = hypo
  source 1..30: mol_type = genomic DNA
ctgcaggggactgaacggggctctgaaacc

SEQ ID NO: 46364 - DNA, 105 bp, Homo sapiens
  misc_feature 1..105: note = chr20:61695646-61695751
  misc_feature 1..105: note = hypo
  source 1..105: mol_type = genomic DNA
ctgacctgcatgggccgaggtcctgcaagagaacgggctccatttgcgtctgagggccaggatgcctgcactggggatcacgctgtgcttcggatggagcctcca

SEQ ID NO: 46365 - DNA, 189 bp, Homo sapiens
  misc_feature 1..189: note = chr20:61714761-61714950
  misc_feature 1..189: note = hypo
  source 1..189: mol_type = genomic DNA
tcagggggttccagccgaggctttgtgaaccggatcctgggtcactgagtaaccagactggtctcaggaggttccagctgaggctttgtgaaccagatcctgggtcactgagtgcccggaccaggggttcaggaggttccggccgaggctttatgaaccggatcctcctctttgcgtttcaaacagcgg

SEQ ID NO: 46366 - DNA, 136 bp, Homo sapiens; identical to SEQ ID NO: 16663
  misc_feature 1..136: note = chr20:61725275-61725411
  misc_feature 1..136: note = hypo
  source 1..136: mol_type = genomic DNA

SEQ ID NO: 46367 - DNA, 34 bp, Homo sapiens
  misc_feature 1..34: note = chr20:61749778-61749812
  misc_feature 1..34: note = hypo
  source 1..34: mol_type = genomic DNA
gtgtctactgcacgccgctcgctgcattgctggg

SEQ ID NO: 46368 - DNA, 71 bp, Homo sapiens
  misc_feature 1..71: note = chr20:61763598-61763669
  misc_feature 1..71: note = hypo
  source 1..71: mol_type = genomic DNA
catgaagcttcccaccgggtaggcactcactatgtctgttacgccgggcgccggcccgagtcctaaagata

SEQ ID NO: 46369 - DNA, 30 bp, Homo sapiens
  misc_feature 1..30: note = chr20:61765333-61765363
  misc_feature 1..30: note = hypo
  source 1..30: mol_type = genomic DNA
ccctggggctgggttcggccccagacgacc

SEQ ID NO: 46370 - DNA, 30 bp, Homo sapiens
  misc_feature 1..30: note = chr20:61799802-61799832
  misc_feature 1..30: note = hypo
  source 1..30: mol_type = genomic DNA
ctggctcagggaaggcgctccccaagatgg

SEQ ID NO: 46371 - DNA, 30 bp, Homo sapiens
  misc_feature 1..30: note = chr20:61820146-61820176
  misc_feature 1..30: note = hypo
  source 1..30: mol_type = genomic DNA
cccacttccctgctccgccaggctgctcca

SEQ ID NO: 46372 - DNA, 35 bp, Homo sapiens
  misc_feature 1..35: note = chr20:61823119-61823154
  misc_feature 1..35: note = hypo
  source 1..35: mol_type = genomic DNA
aggagcctggtggctcgaggagcctctgaaccggg

SEQ ID NO: 46373 - DNA, 18 bp, Homo sapiens
  misc_feature 1..18: note = chr20:61838526-61838544
  misc_feature 1..18: note = hypo
  source 1..18: mol_type = genomic DNA
cagctgcattaaccccgg

SEQ ID NO: 46374 - DNA, 102 bp, Homo sapiens
  misc_feature 1..102: note = chr20:61883273-61883375
  misc_feature 1..102: note = hypo
  source 1..102: mol_type = genomic DNA
ggatgtctgccctgccggagccccggggggaaggtaagcgagccccccaaggggagcagttcttgccctggcccactttgcctacgccgggcacagttctgt

SEQ ID NO: 46375 - DNA, 33 bp, Homo sapiens
  misc_feature 1..33: note = chr20:61941734-61941767
  misc_feature 1..33: note = hypo
  source 1..33: mol_type = genomic DNA
ggtggtggagggacccgccgcctccacggagct

SEQ ID NO: 46376 - DNA, 30 bp, Homo sapiens
  misc_feature 1..30: note = chr20:61965232-61965262
  misc_feature 1..30: note = hypo
  source 1..30: mol_type = genomic DNA
ccagggcagtggggacgggagagctgggac

SEQ ID NO: 46377 - DNA, 563 bp, Homo sapiens
  misc_feature 1..563: note = chr20:61973846-61974409
  misc_feature 1..563: note = hypo
  source 1..563: mol_type = genomic DNA
cctgagaggaggtaacgtcgatgcaaccacgttggcaaacccttcgtcagcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcaggggattcctgggtgccggctctatgcgaatattcttcagtctgtgaaagaaaatgccttgtcatgccgctgaggattcatacgcacgctgtgtaccttaccccgcgaggcaggcaaatgccaagaaatgccagctcggattagcgcagcgggagcgcctgtctgcagacagggagtgtaaacggcacagtcacgtggaagacacgttggcattatctc

SEQ ID NO: 46378 - DNA, 626 bp, Homo sapiens
  misc_feature 1..626: note = chr20:61980710-61981336
  misc_feature 1..626: note = hypo
  source 1..626: mol_type = genomic DNA
cctgtggcccctcaccgtgccgtccgccgaggcccactgtgtcccaaagccagagacggcaccgggatccaccctgtgccagccactcggggccccctgccccgctcagcctgggacctgcggccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgctt

SEQ ID NO: 46379 - DNA, 98 bp, Homo sapiens
  misc_feature 1..98: note = chr20:61982236-61982334
  misc_feature 1..98: note = hypo
  source 1..98: mol_type = genomic DNA
tgcagttctgctggtcgaaggggaagaaggtgacgtcgatgctgcaggagctcttgtaaatggccgggggagtccactgcacccgcccgtcatggaac

SEQ ID NO: 46380 - DNA, 36 bp, Homo sapiens
  misc_feature 1..36: note = chr20:61982611-61982647
  misc_feature 1..36: note = hypo
  source 1..36: mol_type = genomic DNA
ccacacacagaggcattctcacgtcacaggagcaca

SEQ ID NO: 46381 - DNA, 30 bp, Homo sapiens
  misc_feature 1..30: note = chr20:61986659-61986689
  misc_feature 1..30: note = hypo
  source 1..30: mol_type = genomic DNA
caggcacagaaaacccgtttccatgaccag

SEQ ID NO: 46382 - DNA, 183 bp, Homo sapiens
  misc_feature 1..183: note = chr20:61990886-61991069
  misc_feature 1..183: note = hypo
  source 1..183: mol_type = genomic DNA
cgccctcacctaccacgtcaatgagctgagcgatggacaggccgaagcggacgaggaccacgtccgagatgttggccacgggtcgggaccacttgttgtaaccggagaagagtttcttcaggagccgctcctcggcgtgggcccgggtctccacatggctgctggctgcggggagaggcaggc

SEQ ID NO: 46383 - DNA, 89 bp, Homo sapiens
  misc_feature 1..89: note = chr20:62011874-62011963
  misc_feature 1..89: note = hypo
  source 1..89: mol_type = genomic DNA
tggaagccacttgtggtctgcctggtccagcgccagcctcacagggagccggcatgtggagctgtcctccctgccgcagccggcatgcc

SEQ ID NO: 46384 - DNA, 116 bp, Homo sapiens
  misc_feature 1..116: note = chr20:62031637-62031753
  misc_feature 1..116: note = hypo
  source 1..116: mol_type = genomic DNA
ccccagaaccttccacggccatcgcggccgcaggaccccacacccgaagtcccccgcaaacccgcactggcgcattcttacggctctggcatcaacctgtccgtgtgagtaagtta

SEQ ID NO: 46385 - DNA, 392 bp, Homo sapiens
  misc_feature 1..392: note = chr20:62031973-62032365
  misc_feature 1..392: note = hypo
  source 1..392: mol_type = genomic DNA
gacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcc

SEQ ID NO: 46386 - DNA, 159 bp, Homo sapiens
  misc_feature 1..159: note = chr20:62033495-62033654
  misc_feature 1..159: note = hypo
  source 1..159: mol_type = genomic DNA
ccaagtctcgtgagccgttcctctcacaccacgtctgctgggcaccctccacagcaggtccaagcctcgtgagccgtccctctcacgccacgtctgccgggcaccctccacggcaggtccgagctttgtgaaccgtccctctcacgtctgctttgaggg

SEQ ID NO: 46387 - DNA, 209 bp, Homo sapiens
  misc_feature 1..209: note = chr20:62037523-62037732
  misc_feature 1..209: note = hypo
  source 1..209: mol_type = genomic DNA
gcccggaaaccccaccgggacccaaggccgcaggtcctcaccaaacaggcccgccctttgcgcaggtcctcagggaacaggcctgccctttgtgcctcccctgggctcggctgagacaaccccccgcctgttgccacgctggcaacaccccgtcatcactcccgcccctcctcacaccgggctgatgtcggccgcggccctgagcagag

SEQ ID NO: 46388 - DNA, 86 bp, Homo sapiens
  misc_feature 1..86: note = chr20:62038039-62038125
  misc_feature 1..86: note = hypo
  source 1..86: mol_type = genomic DNA
tcgccggtggccgagcgtggcgggggcccgcacggggtacagaggtcggagtcggtgtctgactctccctccgcaatgtagggcct

SEQ ID NO: 46389 - DNA, 183 bp, Homo sapiens
  misc_feature 1..183: note = chr20:62038491-62038674
  misc_feature 1..183: note = hypo
  source 1..183: mol_type = genomic DNA
gggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccat

SEQ ID NO: 46390 - DNA, 381 bp, Homo sapiens
  misc_feature 1..381: note = chr20:62046201-62046582
  misc_feature 1..381: note = hypo
  source 1..381: mol_type = genomic DNA
caccacatccatccccggagaggatggaccaggagaggatgcggccacacccaccttctgagttctgccgtgacgcggcacccttgatgcggaaagcctggcgtgcccggctgcggtccccgaagctccagctcttgggcaccttgctggggctgtcctcgaggctctggtcggcgctgggtgaccgcctcacagtctgggcctgcggggaccccttccccttggcagccacgcctcgggggctggagaagacacgatctttcaaactgaccttctggctgctcccacgggaaccgacagacagacagaaaaacagggagagaagtcactctgcaaagaacacaggccgtgtctgctcatggccgacgccgcccatgcgcc

SEQ ID NO: 46391 - DNA, 54 bp, Homo sapiens
  misc_feature 1..54: note = chr20:62050926-62050980
  misc_feature 1..54: note = hypo
  source 1..54: mol_type = genomic DNA
gagccgtgcagcagccgtcagtccgtgcggcgtgttccgcggtacctagagcgt

SEQ ID NO: 46392 - DNA, 30 bp, Homo sapiens
  misc_feature 1..30: note = chr20:62052467-62052497
  misc_feature 1..30: note = hypo
  source 1..30: mol_type = genomic DNA
aaggaggcagggtcccgcttccccaaacct

SEQ ID NO: 46393 - DNA, 122 bp, Homo sapiens
  misc_feature 1..122: note = chr20:62053217-62053339
  misc_feature 1..122: note = hypo
  source 1..122: mol_type = genomic DNA
gcctggctccccacccgaccccaacgtagacgcttcctctgactccagcacagccccagtggtccctacgggaaccgagcccccgccagccgggtcgcctgccaccacgtgcctgtgttctg

SEQ ID NO: 46394 - DNA, 38 bp, Homo sapiens; identical to SEQ ID NO: 16678
  misc_feature 1..38: note = chr20:62054264-62054302
  misc_feature 1..38: note = hypo
  source 1..38: mol_type = genomic DNA

SEQ ID NO: 46395 - DNA, 42 bp, Homo sapiens
  misc_feature 1..42: note = chr20:62058718-62058760
  misc_feature 1..42: note = hypo
  source 1..42: mol_type = genomic DNA
ttctgatgtcacacccgcgcttgtaggcgtttgccacagccg

SEQ ID NO: 46396 - DNA, 30 bp, Homo sapiens
  misc_feature 1..30: note = chr20:62090117-62090147
  misc_feature 1..30: note = hypo
  source 1..30: mol_type = genomic DNA
caagttgaacctgctcgagagcccaggctg

SEQ ID NO: 46397 - DNA, 222 bp, Homo sapiens
  misc_feature 1..222: note = chr20:62090414-62090636
  misc_feature 1..222: note = hypo
  source 1..222: mol_type = genomic DNA
tgaggtccgtccgtgcggccacaggaaggacgaggcagcggcccccagacacggagaggatgaaggagtaccctaaacacgaaggaacctgagggcaggctcggcaaggaaagccaggcacaaaacggcaccacgatgacaactccacttacacgaaacatccgaagcaaacaggccaggcccggcggccacgcctgtactcccagagcttggcgaggccga

SEQ ID NO: 46398 - DNA, 39 bp, Homo sapiens; identical to SEQ ID NO: 16681
  misc_feature 1..39: note = chr20:62097848-62097887
  misc_feature 1..39: note = hypo
  source 1..39: mol_type = genomic DNA

SEQ ID NO: 46399 - DNA, 163 bp, Homo sapiens
  misc_feature 1..163: note = chr20:62115182-62115345
  misc_feature 1..163: note = hypo
  source 1..163: mol_type = genomic DNA
ggcgacagagcgagactcaaaaaaaaaaaaaaaaattattcaccaacccaagtagggtggagctccttccgccacccatgccctccctgacttcaggacctgctctggggcctcagcggccccaggactgaccctgagtcccagtggccgccagtcagagcca

SEQ ID NO: 46400 - DNA, 413 bp, Homo sapiens
  misc_feature 1..413: note = chr20:62126061-62126474
  misc_feature 1..413: note = hypo
  source 1..413: mol_type = genomic DNA
ggccctcgacctccccgtgccacctgccggtgcctcgctctgggccagggggtccagccagctcccgtggcccgccccgccctagccgccactcacgttgggggagggctccagcatgttgtcaccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccgccacgatcagcactgcgcagtccgcctgcccggcaggggacacag

SEQ ID NO: 46401 - DNA, 30 bp, Homo sapiens
  misc_feature 1..30: note = chr20:62132074-62132104
  misc_feature 1..30: note = hypo
  source 1..30: mol_type = genomic DNA
tcgagtggcccaggccggggtcccggggat

SEQ ID NO: 46402 - DNA, 96 bp, Homo sapiens
  misc_feature 1..96: note = chr20:62153366-62153462
  misc_feature 1..96: note = hypo
  source 1..96: mol_type = genomic DNA
cagcaagcagaccttcgcatcaacacagcagacaccaaaaaccagtgagagccccgctctctaccgcccggccccagcactcgctagctttcctga

SEQ ID NO: 46403 - DNA, 257 bp, Homo sapiens
  misc_feature 1..257: note = chr20:62165598-62165855
  misc_feature 1..257: note = hypo
  source 1..257: mol_type = genomic DNA
tcgttcaggtgcagccggcccccggcacgccgccagatcttgtagtgccgcacagcctgcgtgtcccgcactgggagggagagcgtgagctgtgtggccaccccaactccgacgcctccctgcgtccccagccctgctggccacacctgcgcagagtttctgggtccccacagttgctgttggtgcttcctcagtaccacccctgcctcccctccctcagaacggctccctcctgccctgcacgctctggccaagct

SEQ ID NO: 46404 - DNA, 30 bp, Homo sapiens; identical to SEQ ID NO: 16686
  misc_feature 1..30: note = chr20:62167765-62167795
  misc_feature 1..30: note = hypo
  source 1..30: mol_type = genomic DNA

SEQ ID NO: 46405 - DNA, 237 bp, Homo sapiens
  misc_feature 1..237: note = chr20:62168240-62168477
  misc_feature 1..237: note = hypo
  source 1..237: mol_type = genomic DNA
ctgggcactcctgggcgccagcgcatggggcctgcagggaggatcaagcgggatgcccagcctggactttggggtgcaggaagatggaaccggggtccccaccttcttgggcctccctgagcagcccagagccctgtccctcccctgtgcctagagggtggcctgtgccaaagctcccagcagcctaggacacgcacggttccgactccaccgtctccctctcggccaggtagttgt

SEQ ID NO: 46406 - DNA, 46 bp, Homo sapiens
  misc_feature 1..46: note = chr20:62170163-62170209
  misc_feature 1..46: note = hypo
  source 1..46: mol_type = genomic DNA
atgtccaggaagcctcgagtatccctgagttcggacgtgcaggact

SEQ ID NO: 46407 - DNA, 252 bp, Homo sapiens
  misc_feature 1..252: note = chr20:62172062-62172314
  misc_feature 1..252: note = hypo
  source 1..252: mol_type = genomic DNA
cagccagaggctcctcggtccggcagaccggcatcccttcgagttggcgctctgcagggaggaggggctggcctggctggagcccagagcgttgggtcacgtgaggactcaggggtggcatctgtggatggcgtgcagcttctcccgcagcgtggcgaaggagggccgttcctcggggctgctcctccagcactccagcatgagcacgtagacctccgccgggcaggcagccgggcgcggcagccggtaccc

SEQ ID NO: 46408 - DNA, 366 bp, Homo sapiens
  misc_feature 1..366: note = chr20:62172667-62173033
  misc_feature 1..366: note = hypo
  source 1..366: mol_type = genomic DNA
cttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggcggcagacgcagggcccggccctcgggggctgcaggagacagcgcggggtcttttagggcacggggccaacggccggtgaggccagcgt

SEQ ID NO: 46409 - DNA, 83 bp, Homo sapiens
  misc_feature 1..83: note = chr20:62204292-62204375
  misc_feature 1..83: note = hypo
  source 1..83: mol_type = genomic DNA
gggccagcaggatctcgcgggagcagtcatgctccaccctacggaggacgtaggtgctttcattgagccgctgggtgcagcgg

SEQ ID NO: 46410 - DNA, 56 bp, Homo sapiens
  misc_feature 1..56: note = chr20:62221347-62221403
  misc_feature 1..56: note = hypo
  source 1..56: mol_type = genomic DNA
cccgagccagccctgcggcctctgcccgctccctgctgccgcggctgagagacagc

SEQ ID NO: 46411 - DNA, 35 bp, Homo sapiens
  misc_feature 1..35: note = chr20:62274577-62274612
  misc_feature 1..35: note = hypo
  source 1..35: mol_type = genomic DNA
ctccttccaggtggccgcctcggaacccttcctcc

SEQ ID NO: 46412 - DNA, 87 bp, Homo sapiens
  misc_feature 1..87: note = chr20:62281540-62281627
  misc_feature 1..87: note = hypo
  source 1..87: mol_type = genomic DNA
tcccttctttctcaccgccccctccccaccatccttccccttcactgacttcagggagttaaaaacaattctcgcagtgagctgggc

SEQ ID NO: 46413 - DNA, 30 bp, Homo sapiens
  misc_feature 1..30: note = chr20:62310644-62310674
  misc_feature 1..30: note = hypo
  source 1..30: mol_type = genomic DNA
agccactgtcctcagcgtaatgctcaaggc

SEQ ID NO: 46414 - DNA, 30 bp, Homo sapiens
  misc_feature 1..30: note = chr20:62311251-62311281
  misc_feature 1..30: note = hypo
  source 1..30: mol_type = genomic DNA
gctgcatcctggactcgctggaccagatca

SEQ ID NO: 46415 - DNA, 958 bp, Homo sapiens
  misc_feature 1..958: note = chr20:62320923-62321881
  misc_feature 1..958: note = hypo
  source 1..958: mol_type = genomic DNA
ccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggagg

SEQ ID NO: 46416 - DNA, 30 bp, Homo sapiens; identical to SEQ ID NO: 16693
  misc_feature 1..30: note = chr20:62329526-62329556
  misc_feature 1..30: note = hypo
  source 1..30: mol_type = genomic DNA

SEQ ID NO: 46417 - DNA, 30 bp, Homo sapiens
  misc_feature 1..30: note = chr20:62331916-62331946
  misc_feature 1..30: note = hypo
  source 1..30: mol_type = genomic DNA
ggtccccaaagcccccgcaggtgcagcccc

SEQ ID NO: 46418 - DNA, 45 bp, Homo sapiens
  misc_feature 1..45: note = chr20:62340242-62340287
  misc_feature 1..45: note = hypo
  source 1..45: mol_type = genomic DNA
ttcctaaagcagaggcggggccagaatctgcggcaggtgggcagg

SEQ ID NO: 46419 - DNA, 579 bp, Homo sapiens
  misc_feature 1..579: note = chr20:62383137-62383716
  misc_feature 1..579: note = hypo
  source 1..579: mol_type = genomic DNA
atgaagccccgcccccggtgggtctccccatgaagccccgccccccggtgggtctcccatgaagccccgccccccggtgggtctcccggtggagctcggctcctgcaggtccgctccggaacctgctgactctcctgcgattcctaaactggcagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccccgaacccttggggccgccccgctctgggctgcctgtgccccacccgcctcactggttgatctcacccacttgagatgccctcgccaggccttttttggcaaatctgcctccctgttcccaggctgcctttttctattatttcctccccaagcaaatccatccactccacacctgctacctgacaacgacctgccagtgctgagctccagggtgggcgcggtgggtgcagacaggtcggcaggcacaaggacagggttctccctcccgaggcagggcgggg

SEQ ID NO: 46420 - DNA, 266 bp, Homo sapiens
  misc_feature 1..266: note = chr20:62383922-62384188
  misc_feature 1..266: note = hypo
  source 1..266: mol_type = genomic DNA
tgtgcagagtggacccggtgtggggtccggggcggtctgcgccctcatcaggacccgcctgcccggacatcgtggccacgcgcagcgcgcggcacgcggaccctccccgcactcaccagcgtgtggcgcttcatgtgctcgcgccgcgtgaacttcttcccgcagatctcgcaggggtagggccgctctcccgtgtgcgagcgcatgtgtcgcttgaggatgcactggtgcatggccgagaagctgcagtacggacacttgaactt

SEQ ID NO: 46421 - DNA, 30 bp, Homo sapiens
  misc_feature 1..30: note = chr20:62398516-62398546
  misc_feature 1..30: note = hypo
  source 1..30: mol_type = genomic DNA
caccgccaaggacgccgtggcaggctttgt

SEQ ID NO: 46422 - DNA, 98 bp, Homo sapiens
  misc_feature 1..98: note = chr20:62400802-62400900
  misc_feature 1..98: note = hypo
  source 1..98: mol_type = genomic DNA
ttccagaagcactgacgatcttcccggcatgcggtgtgagcccggtgatgccccaagggtctcgctggaggcaggtgtttgaacgctttgatcagctg

SEQ ID NO: 46423 - DNA, 212 bp, Homo sapiens
  misc_feature 1..212: note = chr20:62481430-62481642
  misc_feature 1..212: note = hypo
  source 1..212: mol_type = genomic DNA
ttttgggattcaccccgtagcggcggccttgtcttcccaccgtagggatgagccactgttcgcttatccactcgccagctgatggatacttggttttctcagctttgcgaacgctgctgctacaaaggtttgaggcgagtcttcctgcggacgtgtttcatctcttctgggtaaatacctgggcgcgggatgctgagtcacgctacgtctcc

SEQ ID NO: 46424 - DNA, 222 bp, Homo sapiens
  misc_feature 1..222: note = chr20:62488224-62488446
  misc_feature 1..222: note = hypo
  source 1..222: mol_type = genomic DNA
aaaaaaagaaaagaaaagaagaaaagaaaagcccctagaggccagggtccttgaacaaaagtgcgcgatgccctgtgtctgcagcggggagaggtctggagcccgtgtgtccgacagcagaagtggacacagtggtgccagggcaggaaccctgggggcatttgcaggcctgtgctgcgagactgcagtggcgctcaggacacacctcggagaagagcaagc

SEQ ID NO: 46425 - DNA, 36 bp, Homo sapiens
  misc_feature 1..36: note = chr20:62662189-62662225
  misc_feature 1..36: note = hypo
  source 1..36: mol_type = genomic DNA
gtttggcaactgagacgaacccgaacagctgcccgg

SEQ ID NO: 46426 - DNA, 171 bp, Homo sapiens
  misc_feature 1..171: note = chr20:62722776-62722947
  misc_feature 1..171: note = hypo
  source 1..171: mol_type = genomic DNA
acacctctgaggcttcgtgctctcagcagtggccgggtatggtgggggtgactgagctccaggagcacacagcaggtgctgggccagtgccgtgtcctggacccaagcatcttacccgcttgtttacgacgaagctttgatctgtcgagagctggccgggtgggggcattt

SEQ ID NO: 46427 - DNA, 30 bp, Homo sapiens
  misc_feature 1..30: note = chr20:62737760-62737790
  misc_feature 1..30: note = hypo
  source 1..30: mol_type = genomic DNA
ggtccacgctcatcacggctaggaagtaga

SEQ ID NO: 46428 - DNA, 36 bp, Homo sapiens; identical to SEQ ID NO: 16700
  misc_feature 1..36: note = chr20:62762699-62762735
  misc_feature 1..36: note = hypo
  source 1..36: mol_type = genomic DNA

SEQ ID NO: 46429 - DNA, 100 bp, Homo sapiens
  misc_feature 1..100: note = chr20:62766351-62766451
  misc_feature 1..100: note = hypo
  source 1..100: mol_type = genomic DNA
tccctcagttttgtgcgtcacacacacgctccctcagttttgtgcgccacaaacacgcgcactccctcagttatgtgcgtcacaaacacagacgctccct

SEQ ID NO: 46430 - DNA, 45 bp, Homo sapiens
  misc_feature 1..45: note = chr20:62871836-62871881
  misc_feature 1..45: note = hypo
  source 1..45: mol_type = genomic DNA
accgtttacctccctcgccctgccccgcaccgtggggatgcccaa

SEQ ID NO: 46431 - DNA, 30 bp, Homo sapiens
  misc_feature 1..30: note = chr20:62873290-62873320
  misc_feature 1..30: note = hypo
  source 1..30: mol_type = genomic DNA
cttttgtttcaggcacggataacagcaaat

SEQ ID NO: 46432 - DNA, 33 bp, Homo sapiens
  misc_feature 1..33: note = chr21:15442571-15442604
  misc_feature 1..33: note = hypo
  source 1..33: mol_type = genomic DNA
ccttgtcgggacaagcgacgctgttagtgacat

SEQ ID NO: 46433 - DNA, 30 bp, Homo sapiens
  misc_feature 1..30: note = chr21:15444814-15444844
  misc_feature 1..30: note = hypo
  source 1..30: mol_type = genomic DNA
gaaggcactgtcctccgtgggaggaacccg

SEQ ID NO: 46434 - DNA, 60 bp, Homo sapiens
  misc_feature 1..60: note = chr21:15446528-15446588
  misc_feature 1..60: note = hypo
  source 1..60: mol_type = genomic DNA
cggaggacttcttgccgctttggggtgtcccccatggacgtgacacgcaccctgggtgca

SEQ ID NO: 46435 - DNA, 85 bp, Homo sapiens
  misc_feature 1..85: note = chr21:15694247-15694332
  misc_feature 1..85: note = hypo
  source 1..85: mol_type = genomic DNA
acgcccagcctaggctaattcttacacaagctaattatactgatgatagcttgtatgtcgtggatagtaacgatctcaatatatt

SEQ ID NO: 46436 - DNA, 30 bp, Homo sapiens
  misc_feature 1..30: note = chr21:15762808-15762838
  misc_feature 1..30: note = hypo
  source 1..30: mol_type = genomic DNA
tagacactgggaactcgaaagggtgagagg

SEQ ID NO: 46437 - DNA, 19 bp, Homo sapiens
  misc_feature 1..19: note = chr21:15869848-15869867
  misc_feature 1..19: note = hypo
  source 1..19: mol_type = genomic DNA
gtcgcggtgagccgagatc

SEQ ID NO: 46438 - DNA, 81 bp, Homo sapiens
  misc_feature 1..81: note = chr21:19274379-19274460
  misc_feature 1..81: note = hypo
  source 1..81: mol_type = genomic DNA
atgtttttccaagtgcggcatttctaggatacagcatctggacagggaaaatgtttctgagcagtggagtagttaattttt

SEQ ID NO: 46439 - DNA, 172 bp, Homo sapiens
  misc_feature 1..172: note = chr21:20359980-20360152
  misc_feature 1..172: note = hypo
  source 1..172: mol_type = genomic DNA
attcctgcacccactcgcctgcgcgctccctcagtggaggggtggaatgcagcaggtccaagttaatggagtttgatgccgctggtgctgaggcagctggctgcttccactgctggtttactccggttcccgcacttgtttgctagcaagcttcctccggggagctgttgag

SEQ ID NO: 46440 - DNA, 33 bp, Homo sapiens
  misc_feature 1..33: note = chr21:23970030-23970063
  misc_feature 1..33: note = hypo
  source 1..33: mol_type = genomic DNA
aaaagcacttcagtccgccgctgcatgatggga

SEQ ID NO: 46441 - DNA, 41 bp, Homo sapiens
  misc_feature 1..41: note = chr21:25338183-25338224
  misc_feature 1..41: note = hypo
  source 1..41: mol_type = genomic DNA
cacttgagtgcatgacgggcacttctcgcaggcctcccaaa

SEQ ID NO: 46442 - DNA, 23 bp, Homo sapiens
  misc_feature 1..23: note = chr21:26737215-26737238
  misc_feature 1..23: note = hypo
  source 1..23: mol_type = genomic DNA
actgcgcccggccgagggatttt

SEQ ID NO: 46443 - DNA, 1300 bp, Homo sapiens; identical to SEQ ID NO: 38320
  misc_feature 1..1300: note = chr21:28216633-28217933
  misc_feature 1..1300: note = hypo
  source 1..1300: mol_type = genomic DNA

SEQ ID NO: 46444 - DNA, 17 bp, Homo sapiens
  misc_feature 1..17: note = chr21:30266890-30266907
  misc_feature 1..17: note = hypo
  source 1..17: mol_type = genomic DNA
tccgtctcaaaaaaaaa

SEQ ID NO: 46445 - DNA, 38 bp, Homo sapiens
  misc_feature 1..38: note = chr21:31057101-31057139
  misc_feature 1..38: note = hypo
  source 1..38: mol_type = genomic DNA
ttataggcgtgagccaccacacccggctgcaaaaacgc

SEQ ID NO: 46446 - DNA, 139 bp, Homo sapiens
  misc_feature 1..139: note = chr21:31059342-31059481
  misc_feature 1..139: note = hypo
  source 1..139: mol_type = genomic DNA
agagacgaggcgagacgaaactttgctcctcctaagagttctccagagtctttcgacattttatcttctagaggacagaattctgcttgctagtatttagcgaattgaattttgtccttagagacgtgcacactgctcc

SEQ ID NO: 46447 - DNA, 30 bp, Homo sapiens
  misc_feature 1..30: note = chr21:32592616-32592646
  misc_feature 1..30: note = hypo
  source 1..30: mol_type = genomic DNA
caaggataaaactgacggatgccaggcact

SEQ ID NO: 46448 - DNA, 30 bp, Homo sapiens
  misc_feature 1..30: note = chr21:33630406-33630436
  misc_feature 1..30: note = hypo
  source 1..30: mol_type = genomic DNA
ctgccacctctcagccggcaactccaaact

SEQ ID NO: 46449 - DNA, 30 bp, Homo sapiens
  misc_feature 1..30: note = chr21:33694588-33694618
  misc_feature 1..30: note = hypo
  source 1..30: mol_type = genomic DNA
ttttaaggtttgaggcgccatgtagaagtg

SEQ ID NO: 46450 - DNA, 30 bp, Homo sapiens
  misc_feature 1..30: note = chr21:33721794-33721824
  misc_feature 1..30: note = hypo
  source 1..30: mol_type = genomic DNA
gtgaggacaagagcacgagcctcagcaggg

SEQ ID NO: 46451 - DNA, 278 bp, Homo sapiens
  misc_feature 1..278: note = chr21:33954157-33954435
  misc_feature 1..278: note = hypo
  source 1..278: mol_type = genomic DNA
catagagagtaagaccgtaaagctccgtacctagcccatgtaaagtccacagtaagggtttgctgctgttgtcctgagacatcatgagatgtcttagaattctggacttgagacacacggcctgggggcggcaatgcttctgtctgctggagtgccaggtgagaggcctgatgtatccagttcttattaatcattacttacgggaaatggagttgatggaaagatagcaacccctcccaccacccggagcgtgagtgataccgcgtcattcagcaata

SEQ ID NO: 46452 - DNA, 84 bp, Homo sapiens
  misc_feature 1..84: note = chr21:33983236-33983320
  misc_feature 1..84: note = hypo
  source 1..84: mol_type = genomic DNA
caggaagtatcatcccgtcaagttcaaaaactatgctgtctaatgcggcagctactcgctccacttggcgatttaaatttattt

SEQ ID NO: 46453 - DNA, 30 bp, Homo sapiens
  misc_feature 1..30: note = chr21:34127723-34127753
  misc_feature 1..30: note = hypo
  source 1..30: mol_type = genomic DNA
gttccatactatttccggatttctgaaaaa

SEQ ID NO: 46454 - DNA, 95 bp, Homo sapiens; identical to SEQ ID NO: 16704
  misc_feature 1..95: note = chr21:34459377-34459472
  misc_feature 1..95: note = hypo
  source 1..95: mol_type = genomic DNA

SEQ ID NO: 46455 - DNA, 30 bp, Homo sapiens
  misc_feature 1..30: note = chr21:34466163-34466193
  misc_feature 1..30: note = hypo
  source 1..30: mol_type = genomic DNA
agccttctgatgagacgctaccagattaga

SEQ ID NO: 46456 - DNA, 62 bp, Homo sapiens
  misc_feature 1..62: note = chr21:34471025-34471087
  misc_feature 1..62: note = hypo
  source 1..62: mol_type = genomic DNA
caaattgcccgtctacgttcttagaagactgaggaggatgtatgagacgaagatttaaaaaa

SEQ ID NO: 46457 - DNA, 222 bp, Homo sapiens
  misc_feature 1..222: note = chr21:34508376-34508598
  misc_feature 1..222: note = hypo
  source 1..222: mol_type = genomic DNA
agcaggtggatggttcgtttccaagaagctgagctgggctgaagcacgcagcgtgtccgttgctgctccactgaacctccagctggatttccatgtggtggtgcaggcgaggggccgtgccgattcattatgacaaaatgacatatcaaaaaggttttgctggcctgcgaaagatgcccaacagcagatatgcattatcttataagttaagaatgctgtctt

SEQ ID NO: 46458 - DNA, 94 bp, Homo sapiens
  misc_feature 1..94: note = chr21:37527928-37528022
  misc_feature 1..94: note = hypo
  source 1..94: mol_type = genomic DNA
acaagtggcccacttcgggttggctggagccacagctgggtggggacagggcctgtgctcaggtgagcactgcctaccgcgcaccctccaggtg

SEQ ID NO: 46459 - DNA, 19 bp, Homo sapiens
  misc_feature 1..19: note = chr21:37699121-37699140
  misc_feature 1..19: note = hypo
  source 1..19: mol_type = genomic DNA
ttttttttttgagaccgag

SEQ ID NO: 46460 - DNA, 133 bp, Homo sapiens
  misc_feature 1..133: note = chr21:37750031-37750164
  misc_feature 1..133: note = hypo
  source 1..133: mol_type = genomic DNA
aggtccagttggtgacgctgcctgtgatctcagacgcttgattcttgctgtcacatgagacgtcttaaacttgggtcatacatcattgaggaatcatttaagttctcacctctggctgcgtagtagaattact

SEQ ID NO: 46461 - DNA, 108 bp, Homo sapiens; identical to SEQ ID NO: 16706
  misc_feature 1..108: note = chr21:37758492-37758600
  misc_feature 1..108: note = hypo
  source 1..108: mol_type = genomic DNA

SEQ ID NO: 46462 - DNA, 106 bp, Homo sapiens
  misc_feature 1..106: note = chr21:37775052-37775158
  misc_feature 1..106: note = hypo
  source 1..106: mol_type = genomic DNA
caggcaagaagctaccggatgtttcacgacgacagcatgaagtctttcttccgtagactgagtttcactcccgacggatctttgcttctcacgccaggtgtgtttc

SEQ ID NO: 46463 - DNA, 30 bp, Homo sapiens
  misc_feature 1..30: note = chr21:37781662-37781692
  misc_feature 1..30: note = hypo
  source 1..30: mol_type = genomic DNA
atccattaggcccatcgctcatcttccatg

SEQ ID NO: 46464 - DNA, 189 bp, Homo sapiens
  misc_feature 1..189: note = chr21:38092100-38092289
  misc_feature 1..189: note = hypo
  source 1..189: mol_type = genomic DNA
gacccttcccttccacggcaggtggagctcacgggcaacagtatttatgaatacatccatccttctgaccacgatgagatgaccgctgtcctcacggcccaccagccgctgcaccaccacctgctccaaggtattccatccagagggaaaaaaaaaaacagactaaaagcaaggcgacattcttaaatg

SEQ ID NO: 46465 - DNA, 40 bp, Homo sapiens
  misc_feature 1..40: note = chr21:38363098-38363138
  misc_feature 1..40: note = hypo
  source 1..40: mol_type = genomic DNA
gtaaagaacacaactcggtaacagccgagtgcaagagatg

SEQ ID NO: 46466 - DNA, 37 bp, Homo sapiens
  misc_feature 1..37: note = chr21:38638489-38638526
  misc_feature 1..37: note = hypo
  source 1..37: mol_type = genomic DNA
aatacaagcgtgagccaccgcgcgggccagatttttc

SEQ ID NO: 46467 - DNA, 30 bp, Homo sapiens
  misc_feature 1..30: note = chr21:38823635-38823665
  misc_feature 1..30: note = hypo
  source 1..30: mol_type = genomic DNA
atctctcttcctctccgtccctccatccct

SEQ ID NO: 46468 - DNA, 72 bp, Homo sapiens
  misc_feature 1..72: note = chr21:38918489-38918561
  misc_feature 1..72: note = hypo
  source 1..72: mol_type = genomic DNA
ggtgggcagctctttcggggttggtacccatcaggtgctgtggccagaactcagattcggagtctaaattca

SEQ ID NO: 46469 - DNA, 142 bp, Homo sapiens
  misc_feature 1..142: note = chr21:38935380-38935522
  misc_feature 1..142: note = hypo
  source 1..142: mol_type = genomic DNA
ggagaccatttttcacgcctggccggctctgtgcttaagtggccccatcgcagccagagtagcctcattacagctgaagtccctggtaggtctcctccttcctctgagcccagcgcagtgccaaggccggggactctggctg

SEQ ID NO: 46470 - DNA, 30 bp, Homo sapiens
  misc_feature 1..30: note = chr21:38987670-38987700
  misc_feature 1..30: note = hypo
  source 1..30: mol_type = genomic DNA
cctgcctcagcctcccgagtacccagcatt

SEQ ID NO: 46471 - DNA, 30 bp, Homo sapiens
  misc_feature 1..30: note = chr21:40510674-40510704
  misc_feature 1..30: note = hypo
  source 1..30: mol_type = genomic DNA
ctataaagagaagttcgggccgggcgcagt

SEQ ID NO: 46472 - DNA, 39 bp, Homo sapiens
  misc_feature 1..39: note = chr21:42448116-42448155
  misc_feature 1..39: note = hypo
  source 1..39: mol_type = genomic DNA
agccacagcctcacacggagccagcgctgtgccagcacc

SEQ ID NO: 46473 - DNA, 30 bp, Homo sapiens; identical to SEQ ID NO: 16710
  misc_feature 1..30: note = chr21:42613756-42613786
  misc_feature 1..30: note = hypo
  source 1..30: mol_type = genomic DNA

SEQ ID NO: 46474 - DNA, 30 bp, Homo sapiens
  misc_feature 1..30: note = chr21:42953643-42953673
  misc_feature 1..30: note = hypo
  source 1..30: mol_type = genomic DNA
tataagggacctcagcgcaggggctggatg

SEQ ID NO: 46475 - DNA, 30 bp, Homo sapiens
  misc_feature 1..30: note = chr21:43033404-43033434
  misc_feature 1..30: note = hypo
  source 1..30: mol_type = genomic DNA
acaggccccaggaaacgcagatctcatggg

SEQ ID NO: 46476 - DNA, 382 bp, Homo sapiens
  misc_feature 1..382: note = chr21:43248539-43248921
  misc_feature 1..382: note = hypo
  source 1..382: mol_type = genomic DNA
ggtggtccagcatgacgtccttgcggtagaacatcttgctgcagacctcacaggcaaacttcttgtcgccgtgcttcttcttgtgcttggagaggttgctgttggtggagaagaatctgaaacacatctcacattggaacgtcttgtcatctgtccagagagcaaacaaacacacaacgattttgaggtaaataacatctcacgcaggcacgcacgtgtggcctgaacgtcaataaagcgcgggtgacgggcatgagagtcacggggatgcgtggccaggaagaaaacagcacctgtgtgtcatacactgtctaccccaggaactcacgatgcagagacgggaaccccggtgcttgaaaagcagacacggagctcacctttc

SEQ ID NO: 46477 - DNA, 42 bp, Homo sapiens
  misc_feature 1..42: note = chr21:43255693-43255735
  misc_feature 1..42: note = hypo
  source 1..42: mol_type = genomic DNA
ccccgacgtgctgcccgggcgactccacgcctgtgtctgtta

SEQ ID NO: 46478 - DNA, 30 bp, Homo sapiens
  misc_feature 1..30: note = chr21:43376373-43376403
  misc_feature 1..30: note = hypo
  source 1..30: mol_type = genomic DNA
tgcagtcagataattcgagtcctgctggtc

SEQ ID NO: 46479 - DNA, 38 bp, Homo sapiens
  misc_feature 1..38: note = chr21:43493035-43493073
  misc_feature 1..38: note = hypo
  source 1..38: mol_type = genomic DNA
aggcttgggatggcacgtgacctcggataaaatgttaa

SEQ ID NO: 46480 - DNA, 70 bp, Homo sapiens
  misc_feature 1..70: note = chr21:43725826-43725896
  misc_feature 1..70: note = hypo
  source 1..70: mol_type = genomic DNA
gaaaaggctgggcaccgcccacactccatgcagctctctttccctggctcggaatcgctgcaggcgccac

SEQ ID NO: 46481 - DNA, 245 bp, Homo sapiens
  misc_feature 1..245: note = chr21:43786496-43786741
  misc_feature 1..245: note = hypo
  source 1..245: mol_type = genomic DNA
gagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgag

SEQ ID NO: 46482 - DNA, 45 bp, Homo sapiens
  misc_feature 1..45: note = chr21:43864728-43864773
  misc_feature 1..45: note = hypo
  source 1..45: mol_type = genomic DNA
ggattttgcccaactcgtgagaaaggtacgcgcccactcttggct

SEQ ID NO: 46483 - DNA, 30 bp, Homo sapiens
  misc_feature 1..30: note = chr21:43991300-43991330
  misc_feature 1..30: note = hypo
  source 1..30: mol_type = genomic DNA
agccaagtcccttcccgaaggaggtgcccg

SEQ ID NO: 46484 - DNA, 30 bp, Homo sapiens
  misc_feature 1..30: note = chr21:44093215-44093245
  misc_feature 1..30: note = hypo
  source 1..30: mol_type = genomic DNA
taacattcctgtgggcgaggtaggatttgt

SEQ ID NO: 46485 - DNA, 30 bp, Homo sapiens
  misc_feature 1..30: note = chr21:44283686-44283716
  misc_feature 1..30: note = hypo
  source 1..30: mol_type = genomic DNA
tacacctccttgccacggtcctagaaggcc

SEQ ID NO: 46486 - DNA, 378 bp, Homo sapiens
  misc_feature 1..378: note = chr21:44338174-44338552
  misc_feature 1..378: note = hypo
  source 1..378: mol_type = genomic DNA
ttaggcggaggtatgcggcataagggttagtggtgttcgtacagtaccaggccttttttgacaagacacaattgaggtagcttaagttagaaggagaccaggctccagggggtaaccttggccaccactcagctatggaggcattgactgttagggtttggtgacgggttttcacctacggcgcgatgggttttatcagtccacttgcgggatatgcacaccgtccctcatactgggttggtaagtgtccaggactgcgggcattcctgaggagtgaaagtgagtctggggttttgggatgcctgtaagtaagggggaatgtctatcccgtcccacagccactgttcactcataaagctcccccgcatacccaacaat

SEQ ID NO: 46487 - DNA, 46 bp, Homo sapiens
  misc_feature 1..46: note = chr21:44480679-44480725
  misc_feature 1..46: note = hypo
  source 1..46: mol_type = genomic DNA
acgcgccagggtgagcgtgcgtgggtgcacacgtatgcatgaattg

SEQ ID NO: 46488 - DNA, 30 bp, Homo sapiens
  misc_feature 1..30: note = chr21:44482657-44482687
  misc_feature 1..30: note = hypo
  source 1..30: mol_type = genomic DNA
tttccagttccaacacgttttgcagacagc

SEQ ID NO: 46489 - DNA, 34 bp, Homo sapiens
  misc_feature 1..34: note = chr21:44482920-44482954
  misc_feature 1..34: note = hypo
  source 1..34: mol_type = genomic DNA
cagcttctcaccatgcgtgcggggcttgcccttc

SEQ ID NO: 46490 - DNA, 303 bp, Homo sapiens
  misc_feature 1..303: note = chr21:44836846-44837149
  misc_feature 1..303: note = hypo
  source 1..303: mol_type = genomic DNA
cagcagcgggagccccgacgtgaggagggtgctggggagcggggcagccccagggccatcacagggggcgatcacaaacggggcaggggccggctggggggcctgggagcagccgggtgcagcggccgggtggtgctgtaactggagcagcctgtgggaacagaggacaggtggtcactgcgccggctcgcagggttctcgggtttccgagtgcccgtgtggcagggcccgcccgaggagctgccagccgcggctgccgagggcaggtgcgtggctgatccctgaccgcgccccacctttcat

SEQ ID NO: 46491 - DNA, 43 bp, Homo sapiens
  misc_feature 1..43: note = chr21:44837378-44837421
  misc_feature 1..43: note = hypo
  source 1..43: mol_type = genomic DNA
tgccgtgtgcccacccggggtcccagggcgggggcaggcccta

SEQ ID NO: 46492 - DNA, 351 bp, Homo sapiens
  misc_feature 1..351: note = chr21:44866552-44866903
  misc_feature 1..351: note = hypo
  source 1..351: mol_type = genomic DNA
tactggcacttgggccggtgtgaagccacccccctgccatgaaaaatggctcttccctgccacagccggcccagcgggagccaggtcagggcctggagacacagcgccccccaccggagccactgcccggcccagcagcacctgcggagaatcccaccagctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcac

SEQ ID NO: 46493 - DNA, 30 bp, Homo sapiens
  misc_feature 1..30: note = chr21:44871839-44871869
  misc_feature 1..30: note = hypo
  source 1..30: mol_type = genomic DNA
tgcctgctgaagccacgcagccagtgcctc

SEQ ID NO: 46494 - DNA, 58 bp, Homo sapiens
  misc_feature 1..58: note = chr21:45140870-45140928
  misc_feature 1..58: note = hypo
  source 1..58: mol_type = genomic DNA
cctcaggtggagcctcgaaaggatggcgctgctgttcctacctcgggtctccccagtg

SEQ ID NO: 46495 - DNA, 57 bp, Homo sapiens; identical to SEQ ID NO: 16716
  misc_feature 1..57: note = chr21:45170351-45170408
  misc_feature 1..57: note = hypo
  source 1..57: mol_type = genomic DNA

SEQ ID NO: 46496 - DNA, 152 bp, Homo sapiens
  misc_feature 1..152: note = chr21:45195176-45195328
  misc_feature 1..152: note = hypo
  source 1..152: mol_type = genomic DNA
accatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaag

SEQ ID NO: 46497 - DNA, 36 bp, Homo sapiens
  misc_feature 1..36: note = chr21:45201243-45201279
  misc_feature 1..36: note = hypo
  source 1..36: mol_type = genomic DNA
gggattataggtgtgagccaccgtgcctgacaatta

SEQ ID NO: 46498 - DNA, 30 bp, Homo sapiens; identical to SEQ ID NO: 16718
  misc_feature 1..30: note = chr21:45232947-45232977
  misc_feature 1..30: note = hypo
  source 1..30: mol_type = genomic DNA

SEQ ID NO: 46499 - DNA, 30 bp, Homo sapiens; identical to SEQ ID NO: 16719
  misc_feature 1..30: note = chr21:45247147-45247177
  misc_feature 1..30: note = hypo
  source 1..30: mol_type = genomic DNA

SEQ ID NO: 46500 - DNA, 30 bp, Homo sapiens
  misc_feature 1..30: note = chr21:45268919-45268949
  misc_feature 1..30: note = hypo
  source 1..30: mol_type = genomic DNA
ggcttgttcacagggcgggataacagggtt

SEQ ID NO: 46501 - DNA, 30 bp, Homo sapiens
  misc_feature 1..30: note = chr21:45273343-45273373
  misc_feature 1..30: note = hypo
  source 1..30: mol_type = genomic DNA
tgttccaattatttacgaggggttgagcaa

SEQ ID NO: 46502 - DNA, 334 bp, Homo sapiens
  misc_feature 1..334: note = chr21:45273579-45273913
  misc_feature 1..334: note = hypo
  source 1..334: mol_type = genomic DNA
ggtgatcctatgaaccgccccagagaaacactcctgcatctcacagcgttctccctcgtgctcttgtcttctctttcctaccagattccaaattctcttcccaagaggtggcatgaacctgtgagtcccagctgcaaccaacagagaagcaagcgagccgtgaacctcatcgatccggccagtcagcacctccgtctctccacgcaggccaggtggctccagatgcgggacttgctcctggcagcttggcagctttgcagctttgcatctgtaaggcgtatattaccgtagagtgcttttcagcgttacataagtcattcgtatgtattgcaga

SEQ ID NO: 46503 - DNA, 99 bp, Homo sapiens
  misc_feature 1..99: note = chr21:45276620-45276719
  misc_feature 1..99: note = hypo
  source 1..99: mol_type = genomic DNA
agtgaaatattttataatcatgatctatgtctatgcctaaatcgccctgcctaagacactgaatagcctgagaaaactccctttcgtgctaactcactg

SEQ ID NO: 46504 - DNA, 30 bp, Homo sapiens
  misc_feature 1..30: note = chr21:45299990-45300020
  misc_feature 1..30: note = hypo
  source 1..30: mol_type = genomic DNA
tgtggacttgagcttcgacatcagttggca

SEQ ID NO: 46505 - DNA, 30 bp, Homo sapiens
  misc_feature 1..30: note = chr21:45352946-45352976
  misc_feature 1..30: note = hypo
  source 1..30: mol_type = genomic DNA
aacacctgttacattcgtctttttgataat

SEQ ID NO: 46506 - DNA, 97 bp, Homo sapiens
  misc_feature 1..97: note = chr21:45365737-45365834
  misc_feature 1..97: note = hypo
  source 1..97: mol_type = genomic DNA
atgcttgcacaggagcgtggctttgtcagaactcatccccaggcagccctgtgggcacctggtgggggctggacaggggtcacgaggagaagccagc

SEQ ID NO: 46507 - DNA, 34 bp, Homo sapiens
  misc_feature 1..34: note = chr21:45411880-45411914
  misc_feature 1..34: note = hypo
  source 1..34: mol_type = genomic DNA
gctggtggagctcctcgggcgcttggagccaggg

SEQ ID NO: 46508 - DNA, 65 bp, Homo sapiens
  misc_feature 1..65: note = chr21:45516505-45516570
  misc_feature 1..65: note = hypo
  source 1..65: mol_type = genomic DNA
cagattccagctggccgtcagtgctcgcgtgtctctctgaagaggctctgcggttctggtccctg

SEQ ID NO: 46509 - DNA, 88 bp, Homo sapiens
  misc_feature 1..88: note = chr21:45583747-45583835
  misc_feature 1..88: note = hypo
  source 1..88: mol_type = genomic DNA
atgaggctggacaagcgcctccgccagaagcagcacaggcctgacacaggcaaacctcccggagaccaccccacggaccccagcccct

SEQ ID NO: 46510 - DNA, 30 bp, Homo sapiens
  misc_feature 1..30: note = chr21:45657028-45657058
  misc_feature 1..30: note = hypo
  source 1..30: mol_type = genomic DNA
ttccttcagggcaagcgcagctgagctcca

SEQ ID NO: 46511 - DNA, 131 bp, Homo sapiens
  misc_feature 1..131: note = chr21:45681620-45681751
  misc_feature 1..131: note = hypo
  source 1..131: mol_type = genomic DNA
acagggctgctgccacggctccgggtacagccagctggtgggttcaaggttccagtggtccggggcttccaggctcagggtccccggggaggactgggccatggaacgagggacggcgcaggcaaagaatg

SEQ ID NO: 46512 - DNA, 79 bp, Homo sapiens
  misc_feature 1..79: note = chr21:45682528-45682607
  misc_feature 1..79: note = hypo
  source 1..79: mol_type = genomic DNA
tgagggtgggcactccggggcagggctcagtggcgggggtcggggctcagggcaagggtagagacggggtgaaagtagg

SEQ ID NO: 46513 - DNA, 30 bp, Homo sapiens
  misc_feature 1..30: note = chr21:45710106-45710136
  misc_feature 1..30: note = hypo
  source 1..30: mol_type = genomic DNA
tttttcctgataatacgcaatggtaatagt

SEQ ID NO: 46514 - DNA, 30 bp, Homo sapiens
  misc_feature 1..30: note = chr21:45713048-45713078
  misc_feature 1..30: note = hypo
  source 1..30: mol_type = genomic DNA
gggtcagcaggtgagcggggagtgggggtc

SEQ ID NO: 46515 - DNA, 34 bp, Homo sapiens
  misc_feature 1..34: note = chr21:45713421-45713455
  misc_feature 1..34: note = hypo
  source 1..34: mol_type = genomic DNA
agcaggagagaggtgcgggcgccaggcttgcagg

SEQ ID NO: 46516 - DNA, 30 bp, Homo sapiens
  misc_feature 1..30: note = chr21:45727181-45727211
  misc_feature 1..30: note = hypo
  source 1..30: mol_type = genomic DNA
gggagatttggggctcgccctccgtcctgg

SEQ ID NO: 46517 - DNA, 30 bp, Homo sapiens
  misc_feature 1..30: note = chr21:45749126-45749156
  misc_feature 1..30: note = hypo
  source 1..30: mol_type = genomic DNA
tcacgcatcaccgctcggcggaggatggga

SEQ ID NO: 46518 - DNA, 106 bp, Homo sapiens
  misc_feature 1..106: note = chr21:45750020-45750126
  misc_feature 1..106: note = hypo
  source 1..106: mol_type = genomic DNA
gggggctggggaagacgctggggtccccgtggaggctggagcggcgttcaggtcctgcggtcactcggcgtgctcctgcacctcttccccacgcagggcctgcagc

SEQ ID NO: 46519 - DNA, 30 bp, Homo sapiens
  misc_feature 1..30: note = chr21:45753810-45753840
  misc_feature 1..30: note = hypo
  source 1..30: mol_type = genomic DNA
ggcgcctcagaagggcggtcaccaggcccc

SEQ ID NO: 46520 - DNA, 66 bp, Homo sapiens
  misc_feature 1..66: note = chr21:45791088-45791154
  misc_feature 1..66: note = hypo
  source 1..66: mol_type = genomic DNA
tccagtcgctgcctccgtgtcccatggccgcctccctccagtctctgcctccgtgtcccgtggccg

SEQ ID NO: 46521 - DNA, 30 bp, Homo sapiens
  misc_feature 1..30: note = chr21:45824465-45824495
  misc_feature 1..30: note = hypo
  source 1..30: mol_type = genomic DNA
ttcggatttgctgaccgtgatgatagtgat

SEQ ID NO: 46522 - DNA, 68 bp, Homo sapiens
  misc_feature 1..68: note = chr21:45844751-45844819
  misc_feature 1..68: note = hypo
  source 1..68: mol_type = genomic DNA
agccctgcactggatcgtgaggacgctgcgggccagcggcttcagctcggaggcggacgtccccactc

SEQ ID NO: 46523 - DNA, 196 bp, Homo sapiens
  misc_feature 1..196: note = chr21:45929175-45929371
  misc_feature 1..196: note = hypo
  source 1..196: mol_type = genomic DNA
cttgcatctccacatcgtagctgtgactgtttgccacagcgaggaagatcctctccccgatctggaagacctcccagtctgcagcaccgaacgtctaggaccaaaggagagcaggtgcagaggtgtgggggagcgggcgcagaggtgtgggggagcgggcgcagaggtgtgggggagcgggcgcagaggtgtgggg

SEQ ID NO: 46524 - DNA, 30 bp, Homo sapiens
  misc_feature 1..30: note = chr21:45939784-45939814
  misc_feature 1..30: note = hypo
  source 1..30: mol_type = genomic DNA
tcagccagtgtgagccgctaccaccaccta

SEQ ID NO: 46525 - DNA, 135 bp, Homo sapiens
  misc_feature 1..135: note = chr21:45959906-45960041
  misc_feature 1..135: note = hypo
  source 1..135: mol_type = genomic DNA
ggcagggggccggggcgcagcagctgagggcgcagcagtggggctcacagcagctctctgggcaggcatccacctgccaggagtcggagcaagcgctggagcagacggacatggtggacgcggccatgctggggt

SEQ ID NO: 46526 - DNA, 30 bp, Homo sapiens; identical to SEQ ID NO: 16724
  misc_feature 1..30: note = chr21:46015435-46015465
  misc_feature 1..30: note = hypo
  source 1..30: mol_type = genomic DNA

SEQ ID NO: 46527 - DNA, 38 bp, Homo sapiens
  misc_feature 1..38: note = chr21:46035197-46035235
  misc_feature 1..38: note = hypo
  source 1..38: mol_type = genomic DNA
tgcgctcacccgacccgcacacacgcaggagcgcgagt

SEQ ID NO: 46528 - DNA, 255 bp, Homo sapiens
  misc_feature 1..255: note = chr21:46036572-46036827
  misc_feature 1..255: note = hypo
  source 1..255: mol_type = genomic DNA
ggtcagcacccaattcgagagctctgctcagcagtgagaatgagacaccgtgacaatgcggctgcgcaccggacacctggctcagcgcaggcagcgcacggacagagtctgcggtgtgaccacaccaagcagccctaaggcagcacgtgcccgcacaagcctcagcctctgctccggtcacgcctgcccacttgggtgtattttttgtctgacttttgcttctggggccgaacaacccagcgaattcaacacagc

SEQ ID NO: 46529 - DNA, 58 bp, Homo sapiens
  misc_feature 1..58: note = chr21:46068645-46068703
  misc_feature 1..58: note = hypo
  source 1..58: mol_type = genomic DNA
cctcccgatggctcccgaggggaaaggcagggacagccatggccgagcacagcttgtg

SEQ ID NO: 46530 - DNA, 30 bp, Homo sapiens
  misc_feature 1..30: note = chr21:46169786-46169816
  misc_feature 1..30: note = hypo
  source 1..30: mol_type = genomic DNA
cgcactgtgcccacccgccactggtgagga

SEQ ID NO: 46531 - DNA, 33 bp, Homo sapiens
  misc_feature 1..33: note = chr21:46184045-46184078
  misc_feature 1..33: note = hypo
  source 1..33: mol_type = genomic DNA
ggcatccagcacacccggggcatctacacactc

SEQ ID NO: 46532 - DNA, 102 bp, Homo sapiens
  misc_feature 1..102: note = chr21:46184437-46184539
  misc_feature 1..102: note = hypo
  source 1..102: mol_type = genomic DNA
acacccagcacatgccgccccaggcccatggaactcgtgctctgatctgaaagttctcttcagactcagactggaatgttgaggatccgagatggtggccgc

SEQ ID NO: 46533 - DNA, 30 bp, Homo sapiens
  misc_feature 1..30: note = chr21:46206196-46206226
  misc_feature 1..30: note = hypo
  source 1..30: mol_type = genomic DNA
atacaagtatacagccgcacagtccactaa

SEQ ID NO: 46534 - DNA, 202 bp, Homo sapiens
  misc_feature 1..202: note = chr21:46238872-46239074
  misc_feature 1..202: note = hypo
  source 1..202: mol_type = genomic DNA
tccctcaggagtgcccgggtggtgccagccggggcgtggcggaggtctcatctgatggtgagcccggccgaaggcgggggaggccgcacttcaggctcagctgggaaatggcagggcctggatttgaacctaagcgtctgagccgtttctgtcctgcctgggaaaggctcagccaactgagcaacgtcgcaaagccatggag

SEQ ID NO: 46535 - DNA, 399 bp, Homo sapiens
  misc_feature 1..399: note = chr21:46256917-46257316
  misc_feature 1..399: note = hypo
  source 1..399: mol_type = genomic DNA
agtcacgcgaggctccgaggcagcaggtttcaggggcacctccgtgcagtccccggcacccagggtgcagcccccagcacctccgtgtagcccccgacacccagggtgcagcccccggcacctccgtgtagcccccggcacccaggcagtccccggcacctccgtgtagctcccggcacccagggtgcagctcctggcccggcctctgctttgccggttgcttccagtcctagcagcaaagatcgcagagcctctgtcctcttggggtgcggggcagagcacgggcaccatctcctcagggctgggcccccgttcttgccctacgactctgcagagacaatcgtgtgactcgcagctcatgaattagcctggtagacaggaggccggagaagcccggat

SEQ ID NO: 46536 - DNA, 175 bp, Homo sapiens
  misc_feature 1..175: note = chr21:46257708-46257883
  misc_feature 1..175: note = hypo
  source 1..175: mol_type = genomic DNA
ctgggaacctgcctgcggtgcaggcgtctgcccttcctagaggaggcgctgggtgagaccctccagggtgtttggggccaagctgtgcgcacctctgatgccagctgttctcggtttggaaagcgctcactgtgcatgtggcgctgggggctgagctgcacgttccaggcccccc

SEQ ID NO: 46537 - DNA, 78 bp, Homo sapiens
  misc_feature 1..78: note = chr21:46273062-46273140
  misc_feature 1..78: note = hypo
  source 1..78: mol_type = genomic DNA
gctgggcagtgtgtgcgtgtgtgcgcgtgtgcgtgtgtgtgtatccaccttgtcttttatttacattaacattagtct

SEQ ID NO: 46538 - DNA, 353 bp, Homo sapiens
  misc_feature 1..353: note = chr21:46308526-46308879
  misc_feature 1..353: note = hypo
  source 1..353: mol_type = genomic DNA
cttccgcaccaccctcgcctctgcggagaccccgcagccggagctctggagccggtccccgctgcaccccagcggcctcacctcggctctcatccacatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggggagccaggtgtgagcatcggtgccagggtgtgcgggggctccggcaacgggggctcgggctt

SEQ ID NO: 46539 - DNA, 40 bp, Homo sapiens
  misc_feature 1..40: note = chr21:46309364-46309404
  misc_feature 1..40: note = hypo
  source 1..40: mol_type = genomic DNA
aagcccgggtggcagcggcacttcccgcagaagcagagcc

SEQ ID NO: 46540 - DNA, 355 bp, Homo sapiens
  misc_feature 1..355: note = chr21:46310428-46310783
  misc_feature 1..355: note = hypo
  source 1..355: mol_type = genomic DNA
cctgtgctgcgataccggtgctctgtgagtggctggtgtctgctcctgcgtgccccacatggtggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccc

SEQ ID NO: 46541 - DNA, 122 bp, Homo sapiens
  misc_feature 1..122: note = chr21:46311753-46311875
  misc_feature 1..122: note = hypo
  source 1..122: mol_type = genomic DNA
ccatggcagaggctgcggtctctgctctggtcccggcaccggcactcacactggggaagaacctgcacggtcactatgtccgtgaagcccagcgcccggatgacaaacgactgctcctggat

SEQ ID NO: 46542 - DNA, 58 bp, Homo sapiens
  misc_feature 1..58: note = chr21:46317030-46317088
  misc_feature 1..58: note = hypo
  source 1..58: mol_type = genomic DNA
ccatcccgtgtctcccgcagggtcctgctcccactccagagcccggggaacctatggc

SEQ ID NO: 46543 - DNA, 37 bp, Homo sapiens
  misc_feature 1..37: note = chr21:46318286-46318323
  misc_feature 1..37: note = hypo
  source 1..37: mol_type = genomic DNA
tgtatcctcccacctcgggcagcggctggcacccagg

SEQ ID NO: 46544 - DNA, 54 bp, Homo sapiens
  misc_feature 1..54: note = chr21:46318785-46318839
  misc_feature 1..54: note = hypo
  source 1..54: mol_type = genomic DNA
ctatcgacacgcaggcgtcctgtccccgacgggaagcctcgggctcctcaccta

SEQ ID NO: 46545 - DNA, 362 bp, Homo sapiens
  misc_feature 1..362: note = chr21:46319143-46319505
  misc_feature 1..362: note = hypo
  source 1..362: mol_type = genomic DNA
gtctgccccgctcagcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtc

SEQ ID NO: 46546 - DNA, 38 bp, Homo sapiens
  misc_feature 1..38: note = chr21:46321598-46321636
  misc_feature 1..38: note = hypo
  source 1..38: mol_type = genomic DNA
gtgcgtgttcacgaacggcagcacggtcttgtccacga

SEQ ID NO: 46547 - DNA, 201 bp, Homo sapiens
  misc_feature 1..201: note = chr21:46359164-46359365
  misc_feature 1..201: note = hypo
  source 1..201: mol_type = genomic DNA
gatgagcagggctcccgttcccagcacgggacccagcccgttacctcgctgctatgtttcccacgtaaacggagcaatacccaattctaaagaactgttctgaggactaaatggaatagtgtaaaaaataaattgacatgaagtgaaggtcaattaaaatgcactagcttggccaggcgcagtgtggctcatgcctgtaat

SEQ ID NO: 46548 - DNA, 33 bp, Homo sapiens
  misc_feature 1..33: note = chr21:46424460-46424493
  misc_feature 1..33: note = hypo
  source 1..33: mol_type = genomic DNA
caccatccccacagccggcgctcctgtgccccc

SEQ ID NO: 46549 - DNA, 65 bp, Homo sapiens
  misc_feature 1..65: note = chr21:46431841-46431906
  misc_feature 1..65: note = hypo
  source 1..65: mol_type = genomic DNA
gccccacagaagcttcgagcccacacctgggttctggcccattgtgttcacgccccccacacccc

SEQ ID NO: 46550 - DNA, 46 bp, Homo sapiens
  misc_feature 1..46: note = chr21:46439310-46439356
  misc_feature 1..46: note = hypo
  source 1..46: mol_type = genomic DNA
gggccctggagggagcggctcggaggggcgccggtgcctgggcagg

SEQ ID NO: 46551 - DNA, 259 bp, Homo sapiens; identical to SEQ ID NO: 16734
  misc_feature 1..259: note = chr21:46452280-46452539
  misc_feature 1..259: note = hypo
  source 1..259: mol_type = genomic DNA

SEQ ID NO: 46552 - DNA, 34 bp, Homo sapiens
  misc_feature 1..34: note = chr21:46549475-46549509
  misc_feature 1..34: note = hypo
  source 1..34: mol_type = genomic DNA
atggcagggaccaggcgctcgcttggcagctctc

SEQ ID NO: 46553 - DNA, 85 bp, Homo sapiens
  misc_feature 1..85: note = chr21:46677808-46677893
  misc_feature 1..85: note = hypo
  source 1..85: mol_type = genomic DNA
gtcctcgtgggaaaccgcgggggcacgtggggcggctgcagggtccgcaaagccggctgtttgcgaagggcgcagctccacctgg

SEQ ID NO: 46554 - DNA, 30 bp, Homo sapiens
  misc_feature 1..30: note = chr21:46839039-46839069
  misc_feature 1..30: note = hypo
  source 1..30: mol_type = genomic DNA
ctgggccctgacacacgatgccgtgtgtag

SEQ ID NO: 46555 - DNA, 62 bp, Homo sapiens
  misc_feature 1..62: note = chr21:46844701-46844763
  misc_feature 1..62: note = hypo
  source 1..62: mol_type = genomic DNA
ggaccctgggaggcccgtggcgcagccccttcccgcctcctgcccgtcggtttccattgctc

SEQ ID NO: 46556 - DNA, 30 bp, Homo sapiens
  misc_feature 1..30: note = chr21:46848585-46848615
  misc_feature 1..30: note = hypo
  source 1..30: mol_type = genomic DNA
atcggcggttctggacgttcatgcaggtgg

SEQ ID NO: 46557 - DNA, 30 bp, Homo sapiens
  misc_feature 1..30: note = chr21:46853427-46853457
  misc_feature 1..30: note = hypo
  source 1..30: mol_type = genomic DNA
tgatccaacagatgccggcccagggcctgc

SEQ ID NO: 46558 - DNA, 83 bp, Homo sapiens
  misc_feature 1..83: note = chr21:46863752-46863835
  misc_feature 1..83: note = hypo
  source 1..83: mol_type = genomic DNA
atgatcccctagatgcgtccgagggacactggacatctggtggccctccagactcctaggaaggggaccgtcctcccagtggc

SEQ ID NO: 46559 - DNA, 305 bp, Homo sapiens
  misc_feature 1..305: note = chr21:46864146-46864451
  misc_feature 1..305: note = hypo
  source 1..305: mol_type = genomic DNA
gcatcttcagtgctgcgagcaggctgggcttgcagcaggagcacgggtgtgcgtgtggagtgaatgaagggccgtgtgcccgagtaggtggcgtgcaggggtgtagtgaggtgcgtgcaggggtgtagtgaggtgtgggatgtgcagagtgaatgaaggacgttgtgctcgtgtgggtgatgtgcggggttgtggtgaggcgtagggctggggtcagctggtcgtccggacttttggttttctggctgtaaaatgcacatgccaggatagttgtgaggtgcacgctcactcgtgcatggagggtg

SEQ ID NO: 46560 - DNA, 79 bp, Homo sapiens
  misc_feature 1..79: note = chr21:46894771-46894850
  misc_feature 1..79: note = hypo
  source 1..79: mol_type = genomic DNA
tttgcccaataagcccgttgtttttgcctggaacatgccagaagacgccagatcgttcacatggcggccatgacaaggc

SEQ ID NO: 46561 - DNA, 30 bp, Homo sapiens
  misc_feature 1..30: note = chr21:46895400-46895430
  misc_feature 1..30: note = hypo
  source 1..30: mol_type = genomic DNA
ctctggcagcgggctcggggacgcccggga

SEQ ID NO: 46562 - DNA, 106 bp, Homo sapiens
  misc_feature 1..106: note = chr21:46908905-46909011
  misc_feature 1..106: note = hypo
  source 1..106: mol_type = genomic DNA
cctttcaccccgctgcgtgctcatcaaagcgtcctctgctgcgtgcggggccaagggcgcacggggcccaccctggggctgcactctcacgcgtcaccagcccctg

SEQ ID NO: 46563 - DNA, 30 bp, Homo sapiens
  misc_feature 1..30: note = chr21:46909213-46909243
  misc_feature 1..30: note = hypo
  source 1..30: mol_type = genomic DNA
gccagcctgggcccacggggtccctgcaca

SEQ ID NO: 46564 - DNA, 35 bp, Homo sapiens
  misc_feature 1..35: note = chr21:46909499-46909534
  misc_feature 1..35: note = hypo
  source 1..35: mol_type = genomic DNA
ctgcggagatcagctcggggcggccttccccgctc

SEQ ID NO: 46565 - DNA, 388 bp, Homo sapiens
  misc_feature 1..388: note = chr21:46912094-46912482
  misc_feature 1..388: note = hypo
  source 1..388: mol_type = genomic DNA
aggccacagggacctcggcgtgacggtcaagacatcagaacatcagaaaagcctcccgtaggccgagccacctccgccggcaagcaagggagcgtctagcagaggcaggagcattttaaaacaaaatggaagtaaaaaccatggcccttagggcgtctggagtctgcatccagctgctctgagctgaggggcgtctgtgctgcaggagggatgccccaggcccaggaagactggaaagcaacattttccttgaatttcctggtttggtgttttgttgatctgtaagtcgctcgagtccagttgaattttaaacgcggctctttgtttccgatttttccttttgctcgtggacagggatccgtcctgagcgtgccgggacctgaggtat

SEQ ID NO: 46566 - DNA, 163 bp, Homo sapiens
  misc_feature 1..163: note = chr21:46921470-46921633
  misc_feature 1..163: note = hypo
  source 1..163: mol_type = genomic DNA
ctgggagcttaggtgcgtccagggcatcctcagccctcacactgcagccgcaggggccttgccctgcacaatccccggtctcccaggtggtggggcctccacagccggtcacctccctctgcagaaggacccccaggggctccacagccggtcacctccctct

SEQ ID NO: 46567 - DNA, 84 bp, Homo sapiens
  misc_feature 1..84: note = chr21:46925361-46925445
  misc_feature 1..84: note = hypo
  source 1..84: mol_type = genomic DNA
ccggctgggcacctgcgtcccgtgccctggctggttctgcagcccctgcccctcagagacactctcccacggaccccacaggga

SEQ ID NO: 46568 - DNA, 146 bp, Homo sapiens
  misc_feature 1..146: note = chr21:46925754-46925900
  misc_feature 1..146: note = hypo
  source 1..146: mol_type = genomic DNA
aggctctgggctacacgccaggccatgctgggccaggtgcacgaggttcccgagggctggctcatcttcgtggccgagcaggaggagctctacgtccgcgtgcagaacgggttccggaaggtccaggtgagcgctctgtgtgacgg

SEQ ID NO: 46569 - DNA, 145 bp, Homo sapiens
  misc_feature 1..145: note = chr21:46926439-46926584
  misc_feature 1..145: note = hypo
  source 1..145: mol_type = genomic DNA
ggtggcaggagtggccgctctgatccaggtgggtgcggccatgcttgcagggccccgggaaggtttaccttcgtgtggcaaaggtgaggacgggtagaagccccatgccgccgaaacggcctgtgacatccgtgggagcctccat

SEQ ID NO: 46570 - DNA, 89 bp, Homo sapiens
  misc_feature 1..89: note = chr21:46934071-46934160
  misc_feature 1..89: note = hypo
  source 1..89: mol_type = genomic DNA
gggcctccccagtgacgctctagcccatggcacaggcccagcccacctccacccatcacatcctgctagatctacgagcccaggaaatg

SEQ ID NO: 46571 - DNA, 141 bp, Homo sapiens
  misc_feature 1..141: note = chr21:46935829-46935970
  misc_feature 1..141: note = hypo
  source 1..141: mol_type = genomic DNA
gtcttctggggaaagcggcgggctctgggctggctgcaggcctccgaggcccttgtcctgcacgctcagtgcctgtgctgccttctcctccgcggcactcctcaggccctgggccgggggctgccgcgggtggtggccccg

SEQ ID NO: 46572 - DNA, 30 bp, Homo sapiens
  misc_feature 1..30: note = chr21:46978498-46978528
  misc_feature 1..30: note = hypo
  source 1..30: mol_type = genomic DNA
tgtgtgagaggactgcgtttggtttgagcg

SEQ ID NO: 46573 - DNA, 54 bp, Homo sapiens
  misc_feature 1..54: note = chr21:46999805-46999859
  misc_feature 1..54: note = hypo
  source 1..54: mol_type = genomic DNA
gggacgcgggtgccccgggatgcgggtgcccctgagatgcgggtgcacctggga

SEQ ID NO: 46574 - DNA, 77 bp, Homo sapiens
  misc_feature 1..77: note = chr21:47013235-47013312
  misc_feature 1..77: note = hypo
  source 1..77: mol_type = genomic DNA
atcaccccatggccccgtcatttcagcactggcggctgctctgccctgggatgcgcctgtcacgtgcagtgatttaa

SEQ ID NO: 46575 - DNA, 49 bp, Homo sapiens
  misc_feature 1..49: note = chr21:47019157-47019206
  misc_feature 1..49: note = hypo
  source 1..49: mol_type = genomic DNA
ccccagctggctgcacgctgggcctccgggaagccggcaagcccacctg

SEQ ID NO: 46576 - DNA, 39 bp, Homo sapiens
  misc_feature 1..39: note = chr21:47026381-47026420
  misc_feature 1..39: note = hypo
  source 1..39: mol_type = genomic DNA
cagtgcagtcacacgctgcacgggcgtctggctacacaa

SEQ ID NO: 46577 - DNA, 67 bp, Homo sapiens
  misc_feature 1..67: note = chr21:47026666-47026733
  misc_feature 1..67: note = hypo
  source 1..67: mol_type = genomic DNA
cagtcacactctgcacgggcgtttagctacacaaatgccatggcgtcacagtcgcctgcagtattca

SEQ ID NO: 46578 - DNA, 30 bp, Homo sapiens
  misc_feature 1..30: note = chr21:47036096-47036126
  misc_feature 1..30: note = hypo
  source 1..30: mol_type = genomic DNA
actcctgcactgtcccgaaatgaggacaat

SEQ ID NO: 46579 - DNA, 120 bp, Homo sapiens
  misc_feature 1..120: note = chr21:47213460-47213580
  misc_feature 1..120: note = hypo
  source 1..120: mol_type = genomic DNA
tccccgagcacagagcgcatcacaggactgaccagtattgagtgggcgcggggaaaacatggctgccaggacctgtgaggaccgagtttcagatactgtggacagcggagactccacagg

SEQ ID NO: 46580 - DNA, 69 bp, Homo sapiens
  misc_feature 1..69: note = chr21:47287081-47287150
  misc_feature 1..69: note = hypo
  source 1..69: mol_type = genomic DNA
cctaggcagagcaggcgtggaagggaaggcggcggacggaacaaaacgcgggcacgcaacggctgctgc

SEQ ID NO: 46581 - DNA, 32 bp, Homo sapiens
  misc_feature 1..32: note = chr21:47287393-47287425
  misc_feature 1..32: note = hypo
  source 1..32: mol_type = genomic DNA
cccgcattcaccgcacgcggagggtgcgggcc

SEQ ID NO: 46582 - DNA, 30 bp, Homo sapiens
  misc_feature 1..30: note = chr21:47328429-47328459
  misc_feature 1..30: note = hypo
  source 1..30: mol_type = genomic DNA
cctgttgccctgaatcgtaactcaggcata

SEQ ID NO: 46583 - DNA, 30 bp, Homo sapiens
  misc_feature 1..30: note = chr21:47365874-47365904
  misc_feature 1..30: note = hypo
  source 1..30: mol_type = genomic DNA
cggtcatttgatacacggctgcaaaagtaa

SEQ ID NO: 46584 - DNA, 162 bp, Homo sapiens
  misc_feature 1..162: note = chr21:47404017-47404179
  misc_feature 1..162: note = hypo
  source 1..162: mol_type = genomic DNA
gccttccaggagggccggcctcagggccacagggcaagtccagctgtgtgtcagccacggccagggtggggcagcctgtccatctgggtgacgtcgcgccctgggacgggtagcgatggcgccaggggccgcccgcctcacgcccgccgtgcctgttcctgg

SEQ ID NO: 46585 - DNA, 35 bp, Homo sapiens
  misc_feature 1..35: note = chr21:47417760-47417795
  misc_feature 1..35: note = hypo
  source 1..35: mol_type = genomic DNA
cctggggtccctgaccgggccgggagtgcccgcag

SEQ ID NO: 46586 - DNA, 30 bp, Homo sapiens
  misc_feature 1..30: note = chr21:47418458-47418488
  misc_feature 1..30: note = hypo
  source 1..30: mol_type = genomic DNA
gtacacaggcacccacggctgccccactgt

SEQ ID NO: 46587 - DNA, 30 bp, Homo sapiens
  misc_feature 1..30: note = chr21:47420466-47420496
  misc_feature 1..30: note = hypo
  source 1..30: mol_type = genomic DNA
tgagagtccccggtgcggtgcagagctgcc

SEQ ID NO: 46588 - DNA, 34 bp, Homo sapiens
  misc_feature 1..34: note = chr21:47421299-47421333
  misc_feature 1..34: note = hypo
  source 1..34: mol_type = genomic DNA
ggtgaggcctcgccccgcccggctttctcaagcc

SEQ ID NO: 46589 - DNA, 92 bp, Homo sapiens
  misc_feature 1..92: note = chr21:47422662-47422754
  misc_feature 1..92: note = hypo
  source 1..92: mol_type = genomic DNA
aggtgcgcgcggggccgcccgggcagtcccagatctgcgtaggtgcacgcggggccgcccgggcagtcccagatctgcgtaggtgcacgcgg

SEQ ID NO: 46590 - DNA, 142 bp, Homo sapiens
  misc_feature 1..142: note = chr21:47425521-47425663
  misc_feature 1..142: note = hypo
  source 1..142: mol_type = genomic DNA
ggctgttctgggggccgctaggggactaagaggatcggccgagggctgggctggaggagggcagcagggatgggcggcgagggtgagggtggggcttcctgaaggccttcacctgcggggaccccggcgagcccctcaggtg

SEQ ID NO: 46591 - DNA, 53 bp, Homo sapiens
  misc_feature 1..53: note = chr21:47457442-47457495
  misc_feature 1..53: note = hypo
  source 1..53: mol_type = genomic DNA
agtggctctctgtgccggggacgtcgcgtgctgggtcccggtctgaatgcttc

SEQ ID NO: 46592 - DNA, 35 bp, Homo sapiens
  misc_feature 1..35: note = chr21:47459822-47459857
  misc_feature 1..35: note = hypo
  source 1..35: mol_type = genomic DNA
gctggaatcagcactcgcgacgaatcccaggtgct

SEQ ID NO: 46593 - DNA, 65 bp, Homo sapiens
  misc_feature 1..65: note = chr21:47471074-47471139
  misc_feature 1..65: note = hypo
  source 1..65: mol_type = genomic DNA
ctgcagatccctcaccggtagcccccactccaggccagactgaaacaccgcggtgggctcctgga

SEQ ID NO: 46594 - DNA, 67 bp, Homo sapiens
  misc_feature 1..67: note = chr21:47475296-47475363
  misc_feature 1..67: note = hypo
  source 1..67: mol_type = genomic DNA
tggtgagctgggaggcgaggccctgggacgggacaagtagcagacgtctcagcgcacacaggctcct

SEQ ID NO: 46595 - DNA, 30 bp, Homo sapiens
  misc_feature 1..30: note = chr21:47487782-47487812
  misc_feature 1..30: note = hypo
  source 1..30: mol_type = genomic DNA
tccctccctccattccgaatccccccaccc

SEQ ID NO: 46596 - DNA, 78 bp, Homo sapiens
  misc_feature 1..78: note = chr21:47489936-47490014
  misc_feature 1..78: note = hypo
  source 1..78: mol_type = genomic DNA
gccgagctgagggggcggccagaggcgcttggcctgcagggagccgtggaggctggcggagcacggcaccctgggaaa

SEQ ID NO: 46597 - DNA, 30 bp, Homo sapiens; identical to SEQ ID NO: 16747
  misc_feature 1..30: note = chr21:47501864-47501894
  misc_feature 1..30: note = hypo
  source 1..30: mol_type = genomic DNA

SEQ ID NO: 46598 - DNA, 34 bp, Homo sapiens; identical to SEQ ID NO: 16748
  misc_feature 1..34: note = chr21:47503061-47503095
  misc_feature 1..34: note = hypo
  source 1..34: mol_type = genomic DNA

SEQ ID NO: 46599 - DNA, 30 bp, Homo sapiens
  misc_feature 1..30: note = chr21:47504861-47504891
  misc_feature 1..30: note = hypo
  source 1..30: mol_type = genomic DNA
tcctcacgggcagctcgcccgacccaggtg

SEQ ID NO: 46600 - DNA, 93 bp, Homo sapiens
  misc_feature 1..93: note = chr21:47531922-47532015
  misc_feature 1..93: note = hypo
  source 1..93: mol_type = genomic DNA
tcgtgctggacacctcggagagcgtcaccatgcagtcccccacggacatcctgctcttccacatgaagcagttcgtgccgcagttcatcagcc

SEQ ID NO: 46601 - DNA, 30 bp, Homo sapiens
  misc_feature 1..30: note = chr21:47539603-47539633
  misc_feature 1..30: note = hypo
  source 1..30: mol_type = genomic DNA
gtagagaaggagcatcggccccggcacagc

SEQ ID NO: 46602 - DNA, 30 bp, Homo sapiens
  misc_feature 1..30: note = chr21:47546044-47546074
  misc_feature 1..30: note = hypo
  source 1..30: mol_type = genomic DNA
ctactccatcgcctgcgacaagccacagca

SEQ ID NO: 46603 - DNA, 43 bp, Homo sapiens
  misc_feature 1..43: note = chr21:47565176-47565219
  misc_feature 1..43: note = hypo
  source 1..43: mol_type = genomic DNA
tcaaggtccagacagcggccagtggtgacgccctcaggcccct

SEQ ID NO: 46604 - DNA, 62 bp, Homo sapiens
  misc_feature 1..62: note = chr21:47570296-47570358
  misc_feature 1..62: note = hypo
  source 1..62: mol_type = genomic DNA
ctcacctgtgcttctcggcaggtctcctcgtagaccgtgtgcagtgccgtgacctcaaagtc

SEQ ID NO: 46605 - DNA, 30 bp, Homo sapiens
  misc_feature 1..30: note = chr21:47689638-47689668
  misc_feature 1..30: note = hypo
  source 1..30: mol_type = genomic DNA
gcagcagagtgtgtgcgaggtgaggtggcg

SEQ ID NO: 46606 - DNA, 37 bp, Homo sapiens; identical to SEQ ID NO: 16750
  misc_feature 1..37: note = chr21:47737928-47737965
  misc_feature 1..37: note = hypo
  source 1..37: mol_type = genomic DNA

SEQ ID NO: 46607 - DNA, 236 bp, Homo sapiens
  misc_feature 1..236: note = chr21:47746178-47746414
  misc_feature 1..236: note = hypo
  source 1..236: mol_type = genomic DNA
gactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggagg

SEQ ID NO: 46608 - DNA, 30 bp, Homo sapiens
  misc_feature 1..30: note = chr21:47771781-47771811
  misc_feature 1..30: note = hypo
  source 1..30: mol_type = genomic DNA
agtgctgtccaagtgcgggctcacctggtg

SEQ ID NO: 46609 - DNA, 30 bp, Homo sapiens
  misc_feature 1..30: note = chr21:47772056-47772086
  misc_feature 1..30: note = hypo
  source 1..30: mol_type = genomic DNA
gagggtgagccactgcgtgtctcctggcat

SEQ ID NO: 46610 - DNA, 44 bp, Homo sapiens
  misc_feature 1..44: note = chr21:47799181-47799225
  misc_feature 1..44: note = hypo
  source 1..44: mol_type = genomic DNA
ctgcgtgtcgtgagccgcgcccgtcttcccgggccgcgtgtcgt

SEQ ID NO: 46611 - DNA, 37 bp, Homo sapiens
  misc_feature 1..37: note = chr22:17330739-17330776
  misc_feature 1..37: note = hypo
  source 1..37: mol_type = genomic DNA
caaaaaaaaaaaaaaaaagtgtcggggtttggtatga

SEQ ID NO: 46612 - DNA, 120 bp, Homo sapiens
  misc_feature 1..120: note = chr22:18009965-18010085
  misc_feature 1..120: note = hypo
  source 1..120: mol_type = genomic DNA
ggctggagtgcagtggtgccgcgcccggcacatgactgcatactttcaaggagaggactcagagcttttatttatttaaagaaacttgaaaggaggaaagtggattaagaaaaaaaaaat

SEQ ID NO: 46613 - DNA, 97 bp, Homo sapiens
  misc_feature 1..97: note = chr22:18110592-18110689
  misc_feature 1..97: note = hypo
  source 1..97: mol_type = genomic DNA
aaaaaagaaaaaaagaaaaaaacacagttcataaagtgaacgaccttgtcaaaacactggttggaagcaggtctcttccctccgcactgtttcctat

SEQ ID NO: 46614 - DNA, 30 bp, Homo sapiens
  misc_feature 1..30: note = chr22:18265801-18265831
  misc_feature 1..30: note = hypo
  source 1..30: mol_type = genomic DNA
gtgctgatggagaagcggggggggggggcc

SEQ ID NO: 46615 - DNA, 64 bp, Homo sapiens
  misc_feature 1..64: note = chr22:18328093-18328157
  misc_feature 1..64: note = hypo
  source 1..64: mol_type = genomic DNA
gggtaacgtggggaacgcatactgtctggcaagaattctactaggaccacgggaaacaaagcag

SEQ ID NO: 46616 - DNA, 30 bp, Homo sapiens
  misc_feature 1..30: note = chr22:18355680-18355710
  misc_feature 1..30: note = hypo
  source 1..30: mol_type = genomic DNA
taaattaagaagacacggggaaaaaaagaa

SEQ ID NO: 46617 - DNA, 30 bp, Homo sapiens; identical to SEQ ID NO: 16753
  misc_feature 1..30: note = chr22:18553893-18553923
  misc_feature 1..30: note = hypo
  source 1..30: mol_type = genomic DNA

SEQ ID NO: 46618 - DNA, 53 bp, Homo sapiens
  misc_feature 1..53: note = chr22:18634479-18634532
  misc_feature 1..53: note = hypo
  source 1..53: mol_type = genomic DNA
caaagtgttgtaatccgtgtgttctaacccgcatattacgattactcaagaaa

SEQ ID NO: 46619 - DNA, 139 bp, Homo sapiens
  misc_feature 1..139: note = chr22:19117537-19117676
  misc_feature 1..139: note = hypo
  source 1..139: mol_type = genomic DNA
catgcactgcagccccgacccacccatacacaggcccttgctcgctggagcagcagcgactcacctgcccggctctctaccctgaggggcctgccgcctctgctcccaaacacagagctgctttcgtctaccaggcttg

SEQ ID NO: 46620 - DNA, 30 bp, Homo sapiens
  misc_feature 1..30: note = chr22:19444363-19444393
  misc_feature 1..30: note = hypo
  source 1..30: mol_type = genomic DNA
gataacacttactgtcgactcctcatgctg

SEQ ID NO: 46621 - DNA, 43 bp, Homo sapiens
  misc_feature 1..43: note = chr22:19771799-19771842
  misc_feature 1..43: note = hypo
  source 1..43: mol_type = genomic DNA
gagacacgcacagcacgtcaacatggagcgcccagcagcggcg

SEQ ID NO: 46622 - DNA, 78 bp, Homo sapiens
  misc_feature 1..78: note = chr22:19965000-19965078
  misc_feature 1..78: note = hypo
  source 1..78: mol_type = genomic DNA
cactgcccaggggcccgggctcggcctcctggtacctgtcggccccgggcacctccttgtgcacgtggtaggacaggt

SEQ ID NO: 46623 - DNA, 151 bp, Homo sapiens
  misc_feature 1..151: note = chr22:20166058-20166209
  misc_feature 1..151: note = hypo
  source 1..151: mol_type = genomic DNA
tggcccaggggtgagcggagaggggacctgagcaggcaacacgggcctggagaggagctttgtctctctaggagaaggcagcctgtcctgccagacctggtatcacgccaccccaaggcaggccccgcagagccctcgggagctccactcg

SEQ ID NO: 46624 - DNA, 33 bp, Homo sapiens
  misc_feature 1..33: note = chr22:20308760-20308793
  misc_feature 1..33: note = hypo
  source 1..33: mol_type = genomic DNA
ccagagctggtcatgcgccgggcaccctggcct

SEQ ID NO: 46625 - DNA, 39 bp, Homo sapiens
  misc_feature 1..39: note = chr22:20749338-20749377
  misc_feature 1..39: note = hypo
  source 1..39: mol_type = genomic DNA
ggcctcctgcttctttcttccccgcgcccaatcatttgt

SEQ ID NO: 46626 - DNA, 22 bp, Homo sapiens
  misc_feature 1..22: note = chr22:20765425-20765447
  misc_feature 1..22: note = hypo
  source 1..22: mol_type = genomic DNA
ccgtgcccggccaaaaaggact

SEQ ID NO: 46627 - DNA, 20 bp, Homo sapiens
  misc_feature 1..20: note = chr22:20851286-20851306
  misc_feature 1..20: note = hypo
  source 1..20: mol_type = genomic DNA
gggcttggtggctggcgcct

SEQ ID NO: 46628 - DNA, 34 bp, Homo sapiens
  misc_feature 1..34: note = chr22:21024902-21024936
  misc_feature 1..34: note = hypo
  source 1..34: mol_type = genomic DNA
ggtccaccgcgttgccgtgcgagaagaagaccgt

SEQ ID NO: 46629 - DNA, 88 bp, Homo sapiens
  misc_feature 1..88: note = chr22:21105305-21105393
  misc_feature 1..88: note = hypo
  source 1..88: mol_type = genomic DNA
ctttggcagctaaaccgagaacacagctgagtcaacatggctgaggtgggggagctgggcttggaagacagagcgacctgggggcagc

SEQ ID NO: 46630 - DNA, 30 bp, Homo sapiens
  misc_feature 1..30: note = chr22:21150528-21150558
  misc_feature 1..30: note = hypo
  source 1..30: mol_type = genomic DNA
catccaccaggtgctcgtcttggatgttgg

SEQ ID NO: 46631 - DNA, 30 bp, Homo sapiens
  misc_feature 1..30: note = chr22:21153993-21154023
  misc_feature 1..30: note = hypo
  source 1..30: mol_type = genomic DNA
caggctggccaagaacgcctccacaatcac

SEQ ID NO: 46632 - DNA, 91 bp, Homo sapiens
  misc_feature 1..91: note = chr22:21214252-21214343
  misc_feature 1..91: note = hypo
  source 1..91: mol_type = genomic DNA
tagacaaatagtgtgcgggttaagagtttgttgctccaactcatcttcatcagttcttcccatccttagatttcagagagtagtaccttca

SEQ ID NO: 46633 - DNA, 34 bp, Homo sapiens
  misc_feature 1..34: note = chr22:21380309-21380343
  misc_feature 1..34: note = hypo
  source 1..34: mol_type = genomic DNA
tcgggctcatccccacggccgtcacactgggcac

SEQ ID NO: 46634 - DNA, 58 bp, Homo sapiens
  misc_feature 1..58: note = chr22:21982983-21983041
  misc_feature 1..58: note = hypo
  source 1..58: mol_type = genomic DNA
gtaccttccaggacccgcgccagggccccggacacgcggtgagcggacatgtgccggc

SEQ ID NO: 46635 - DNA, 87 bp, Homo sapiens
  misc_feature 1..87: note = chr22:21986707-21986794
  misc_feature 1..87: note = hypo
  source 1..87: mol_type = genomic DNA
caaccaaggaggacacgaggaaggtgcttgtgccaccggtggaagacgtggctttggcttttaggctcccctcggggcaggagcaga

SEQ ID NO: 46636 - DNA, 30 bp, Homo sapiens
  misc_feature 1..30: note = chr22:22058379-22058409
  misc_feature 1..30: note = hypo
  source 1..30: mol_type = genomic DNA
tggctgattctgctgcgtcaacattctgca

SEQ ID NO: 46637 - DNA, 30 bp, Homo sapiens
  misc_feature 1..30: note = chr22:22344036-22344066
  misc_feature 1..30: note = hypo
  source 1..30: mol_type = genomic DNA
tccacccctcagcagcgggccccactccct

SEQ ID NO: 46638 - DNA, 321 bp, Homo sapiens
  misc_feature 1..321: note = chr22:22899633-22899954
  misc_feature 1..321: note = hypo
  source 1..321: mol_type = genomic DNA
cgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggc

SEQ ID NO: 46639 - DNA, 330 bp, Homo sapiens
  misc_feature 1..330: note = chr22:22901123-22901453
  misc_feature 1..330: note = hypo
  source 1..330: mol_type = genomic DNA
ggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccct

SEQ ID NO: 46640 - DNA, 153 bp, Homo sapiens
  misc_feature 1..153: note = chr22:23453131-23453284
  misc_feature 1..153: note = hypo
  source 1..153: mol_type = genomic DNA
tccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtg

SEQ ID NO: 46641 - DNA, 30 bp, Homo sapiens
  misc_feature 1..30: note = chr22:23791417-23791447
  misc_feature 1..30: note = hypo
  source 1..30: mol_type = genomic DNA
cgctcctgctgccctcggggccagtccctg

SEQ ID NO: 46642 - DNA, 82 bp, Homo sapiens
  misc_feature 1..82: note = chr22:23915601-23915683
  misc_feature 1..82: note = hypo
  source 1..82: mol_type = genomic DNA
gcgtggtcatctccacgccctgggtgatgggggtaccatctgccttccaggtcaccgtcaagattcccggataaaagtcatt

SEQ ID NO: 46643 - DNA, 42 bp, Homo sapiens; identical to SEQ ID NO: 16758
  misc_feature 1..42: note = chr22:24374229-24374271
  misc_feature 1..42: note = hypo
  source 1..42: mol_type = genomic DNA

SEQ ID NO: 46644 - DNA, 34 bp, Homo sapiens
  misc_feature 1..34: note = chr22:24560385-24560419
  misc_feature 1..34: note = hypo
  source 1..34: mol_type = genomic DNA
gtggacgagattgaccggccgggcagctttgcct

SEQ ID NO: 46645 - DNA, 42 bp, Homo sapiens
  misc_feature 1..42: note = chr22:24646515-24646557
  misc_feature 1..42: note = hypo
  source 1..42: mol_type = genomic DNA
gacagaggatggacccgaaggccgaagaaaatgcctcaaggg

SEQ ID NO: 46646 - DNA, 30 bp, Homo sapiens
  misc_feature 1..30: note = chr22:25091239-25091269
  misc_feature 1..30: note = hypo
  source 1..30: mol_type = genomic DNA
tcacaccacctgggccgcaggtgacaggca

SEQ ID NO: 46647 - DNA, 21 bp, Homo sapiens
  misc_feature 1..21: note = chr22:25171155-25171176
  misc_feature 1..21: note = hypo
  source 1..21: mol_type = genomic DNA
tcctcacgtggaagagtggaa

SEQ ID NO: 46648 - DNA, 30 bp, Homo sapiens
  misc_feature 1..30: note = chr22:26763231-26763261
  misc_feature 1..30: note = hypo
  source 1..30: mol_type = genomic DNA
gccctagacagctctcgccttgccctagtc

SEQ ID NO: 46649 - DNA, 38 bp, Homo sapiens
  misc_feature 1..38: note = chr22:26932483-26932521
  misc_feature 1..38: note = hypo
  source 1..38: mol_type = genomic DNA
ggcagacccagatggcgcctgagcggattccctgctca

SEQ ID NO: 46650 - DNA, 19 bp, Homo sapiens
  misc_feature 1..19: note = chr22:26965186-26965205
  misc_feature 1..19: note = hypo
  source 1..19: mol_type = genomic DNA
accccgttccagtaacagt

SEQ ID NO: 46651 - DNA, 21 bp, Homo sapiens
  misc_feature 1..21: note = chr22:26991250-26991271
  misc_feature 1..21: note = hypo
  source 1..21: mol_type = genomic DNA
gcctgtgaggccaggcgcagt

SEQ ID NO: 46652 - DNA, 20 bp, Homo sapiens
  misc_feature 1..20: note = chr22:27010657-27010677
  misc_feature 1..20: note = hypo
  source 1..20: mol_type = genomic DNA
taaaaacaagtaaatcggcc

SEQ ID NO: 46653 - DNA, 71 bp, Homo sapiens
  misc_feature 1..71: note = chr22:27045927-27045998
  misc_feature 1..71: note = hypo
  source 1..71: mol_type = genomic DNA
catgtcgggtgtgtccgacagtctcccagaagacctcagcaggactgagttctagtcgctaacaacttgct

SEQ ID NO: 46654 - DNA, 64 bp, Homo sapiens
  misc_feature 1..64: note = chr22:28007163-28007227
  misc_feature 1..64: note = hypo
  source 1..64: mol_type = genomic DNA
ccgcactgcgtctcgcgcgagattaacccgtcccgcactgcgtctcacgcgagattaacccgtc

SEQ ID NO: 46655 - DNA, 75 bp, Homo sapiens
  misc_feature 1..75: note = chr22:28371649-28371724
  misc_feature 1..75: note = hypo
  source 1..75: mol_type = genomic DNA
ctggaccctgaaaggcgttattttgtattttcatatatagtggcataaaatcgtttgtagcgttttcttattctt

SEQ ID NO: 46656 - DNA, 30 bp, Homo sapiens
  misc_feature 1..30: note = chr22:29167679-29167709
  misc_feature 1..30: note = hypo
  source 1..30: mol_type = genomic DNA
agacatgcactaccacggtgggctaattgt

SEQ ID NO: 46657 - DNA, 30 bp, Homo sapiens
  misc_feature 1..30: note = chr22:29168256-29168286
  misc_feature 1..30: note = hypo
  source 1..30: mol_type = genomic DNA
ataactgataatgagcgtgtattgtatgtc

SEQ ID NO: 46658 - DNA, 733 bp, Homo sapiens
  misc_feature 1..733: note = chr22:29445592-29446325
  misc_feature 1..733: note = hypo
  source 1..733: mol_type = genomic DNA
agggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctc

SEQ ID NO: 46659 - DNA, 20 bp, Homo sapiens
  misc_feature 1..20: note = chr22:29701033-29701053
  misc_feature 1..20: note = hypo
  source 1..20: mol_type = genomic DNA
ccggccgggaatgttaagac

SEQ ID NO: 46660 - DNA, 30 bp, Homo sapiens
  misc_feature 1..30: note = chr22:29736031-29736061
  misc_feature 1..30: note = hypo
  source 1..30: mol_type = genomic DNA
cccccgtgctgccaccgtgcggacctgagc

SEQ ID NO: 46661 - DNA, 120 bp, Homo sapiens
  misc_feature 1..120: note = chr22:29977639-29977759
  misc_feature 1..120: note = hypo
  source 1..120: mol_type = genomic DNA
catgcccagcctaccaagggttcttaacaaggctgtccgggatgtgcagcagagggtcagtgtaaccaccccatgggttcattttgcccgtttcccagacagcggatttatcaagacaga

SEQ ID NO: 46662 - DNA, 24 bp, Homo sapiens
  misc_feature 1..24: note = chr22:29977939-29977963
  misc_feature 1..24: note = hypo
  source 1..24: mol_type = genomic DNA
agtggaagccgtcctcttgtgctg

SEQ ID NO: 46663 - DNA, 34 bp, Homo sapiens
  misc_feature 1..34: note = chr22:29997189-29997223
  misc_feature 1..34: note = hypo
  source 1..34: mol_type = genomic DNA
cctttttttttgagacggagtctcgcactctcgc

SEQ ID NO: 46664 - DNA, 36 bp, Homo sapiens
  misc_feature 1..36: note = chr22:29998650-29998686
  misc_feature 1..36: note = hypo
  source 1..36: mol_type = genomic DNA
aataataattctaggcggggcgtggtggctcacgcc

SEQ ID NO: 46665 - DNA, 30 bp, Homo sapiens
  misc_feature 1..30: note = chr22:30091110-30091140
  misc_feature 1..30: note = hypo
  source 1..30: mol_type = genomic DNA
agagctgacctccaccgcccagcctgggaa

SEQ ID NO: 46666 - DNA, 33 bp, Homo sapiens
  misc_feature 1..33: note = chr22:30158330-30158363
  misc_feature 1..33: note = hypo
  source 1..33: mol_type = genomic DNA
ccaacccccaggccccggaacggtacgggtcca

SEQ ID NO: 46667 - DNA, 29 bp, Homo sapiens
  misc_feature 1..29: note = chr22:30233129-30233158
  misc_feature 1..29: note = hypo
  source 1..29: mol_type = genomic DNA
gtaggcagggctgggcgcgatggctcacg

SEQ ID NO: 46668 - DNA, 30 bp, Homo sapiens
  misc_feature 1..30: note = chr22:30768004-30768034
  misc_feature 1..30: note = hypo
  source 1..30: mol_type = genomic DNA
tctgaggtagtacagcgctcccctgcccta

SEQ ID NO: 46669 - DNA, 102 bp, Homo sapiens
  misc_feature 1..102: note = chr22:30783894-30783996
  misc_feature 1..102: note = hypo
  source 1..102: mol_type = genomic DNA
gggggcaaggcaaaacgaagcaggcagggactcagtgcctcagtgggaccgagaggctgggtcacttccctcatctgtgaaatgggcaccataggccgggcg

SEQ ID NO: 46670 - DNA, 319 bp, Homo sapiens
  misc_feature 1..319: note = chr22:30857340-30857659
  misc_feature 1..319: note = hypo
  source 1..319: mol_type = genomic DNA
atgtgggcgttatagcgctggctgggtagaacatctgtcatctcccctgcccgctgtcgctcccccatcttggtcttcaggaaaactccgaagccgatgtccgcaccatcagatgagaactgccacctgtcagggggagggggaggagacaggttgctgctcagcctgatgggtctctgaggggttagggcctgcccctacctgagaacgcagcctggaaataggatctcgtattccacttggtgtgatgagccgcggttgatctgcaccgagtgctcgtactgagtcttcacctggtcccgcacgtacatggacttgg

SEQ ID NO: 46671 - DNA, 30 bp, Homo sapiens
  misc_feature 1..30: note = chr22:30924831-30924861
  misc_feature 1..30: note = hypo
  source 1..30: mol_type = genomic DNA
ctcctaacctcaaatcgggatctctaccca

SEQ ID NO: 46672 - DNA, 30 bp, Homo sapiens
  misc_feature 1..30: note = chr22:30940902-30940932
  misc_feature 1..30: note = hypo
  source 1..30: mol_type = genomic DNA
ttaaaacaacaacaacgtgaaaaaaagaaa

SEQ ID NO: 46673 - DNA, 30 bp, Homo sapiens
  misc_feature 1..30: note = chr22:31460423-31460453
  misc_feature 1..30: note = hypo
  source 1..30: mol_type = genomic DNA
ggagaagatagcatccgaaagaattaaata

SEQ ID NO: 46674 - DNA, 35 bp, Homo sapiens; identical to SEQ ID NO: 16768
  misc_feature 1..35: note = chr22:32014233-32014268
  misc_feature 1..35: note = hypo
  source 1..35: mol_type = genomic DNA

SEQ ID NO: 46675 - DNA, 29 bp, Homo sapiens
  misc_feature 1..29: note = chr22:32356777-32356806
  misc_feature 1..29: note = hypo
  source 1..29: mol_type = genomic DNA
aaaaactccgtccccgccccccccccccc

SEQ ID NO: 46676 - DNA, 80 bp, Homo sapiens
  misc_feature 1..80: note = chr22:32701637-32701717
  misc_feature 1..80: note = hypo
  source 1..80: mol_type = genomic DNA
atcaactgtgttcagcgtgagggacacacggtcccagtgtgagggacggtggcttttcaggagcacggtgctcattaaag

SEQ ID NO: 46677 - DNA, 30 bp, Homo sapiens
  misc_feature 1..30: note = chr22:32748880-32748910
  misc_feature 1..30: note = hypo
  source 1..30: mol_type = genomic DNA
tttagtctccatggccgccaccaaccacag

SEQ ID NO: 46678 - DNA, 24 bp, Homo sapiens
  misc_feature 1..24: note = chr22:33170623-33170647
  misc_feature 1..24: note = hypo
  source 1..24: mol_type = genomic DNA
gctggagtgcaatggcgcacgatc

SEQ ID NO: 46679 - DNA, 149 bp, Homo sapiens
  misc_feature 1..149: note = chr22:33255195-33255344
  misc_feature 1..149: note = hypo
  source 1..149: mol_type = genomic DNA
tgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatca

SEQ ID NO: 46680 - DNA, 35 bp, Homo sapiens
  misc_feature 1..35: note = chr22:35079349-35079384
  misc_feature 1..35: note = hypo
  source 1..35: mol_type = genomic DNA
agactggagctgttcctattcggccatcttggctc

SEQ ID NO: 46681 - DNA, 30 bp, Homo sapiens; identical to SEQ ID NO: 5266
  misc_feature 1..30: note = chr22:35768487-35768517
  misc_feature 1..30: note = hypo
  source 1..30: mol_type = genomic DNA

SEQ ID NO: 46682 - DNA, 96 bp, Homo sapiens
  misc_feature 1..96: note = chr22:35822686-35822782
  misc_feature 1..96: note = hypo
  source 1..96: mol_type = genomic DNA
agctgggcctggccccggggaggtgctcccaggaagggctgggtgcctgtggttttccctgcctcacagcctctgccatctcggatttcacctttt

SEQ ID NO: 46683 - DNA, 64 bp, Homo sapiens
  misc_feature 1..64: note = chr22:35848324-35848388
  misc_feature 1..64: note = hypo
  source 1..64: mol_type = genomic DNA
gtcacaccctggaaccgtgtggtgtttctgttgtctgcctacagtaggacgtaggctccacgcc

SEQ ID NO: 46684 - DNA, 30 bp, Homo sapiens
  misc_feature 1..30: note = chr22:35964914-35964944
  misc_feature 1..30: note = hypo
  source 1..30: mol_type = genomic DNA
tggcacttactgacccgtaggggaggcaga

SEQ ID NO: 46685 - DNA, 25 bp, Homo sapiens
  misc_feature 1..25: note = chr22:36246202-36246227
  misc_feature 1..25: note = hypo
  source 1..25: mol_type = genomic DNA
ccgtgtgcacgcatgcgcattctct

SEQ ID NO: 46686 - DNA, 25 bp, Homo sapiens
  misc_feature 1..25: note = chr22:36246287-36246312
  misc_feature 1..25: note = hypo
  source 1..25: mol_type = genomic DNA
tcactgtctccggcagagacaggtg

SEQ ID NO: 46687 - DNA, 70 bp, Homo sapiens
  misc_feature 1..70: note = chr22:36585930-36586000
  misc_feature 1..70: note = hypo
  source 1..70: mol_type = genomic DNA
ccataaactttacctcgccctctttattcccctaaaaaatgtctgcgttttgtcccggcctgtgtctggc

SEQ ID NO: 46688 - DNA, 150 bp, Homo sapiens
  misc_feature 1..150: note = chr22:36684196-36684346
  misc_feature 1..150: note = hypo
  source 1..150: mol_type = genomic DNA
accctgccaggttcccgccctgggccgagccctggcaccttcatatgtagttggctcagtcgggtgccgcccaccctcacctgggccccgcccacccttacctgcagcttccgcagctgtttgatggcttcgtcccggttcttgttggcc

SEQ ID NO: 46689 - DNA, 30 bp, Homo sapiens; identical to SEQ ID NO: 16776
  misc_feature 1..30: note = chr22:36878964-36878994
  misc_feature 1..30: note = hypo
  source 1..30: mol_type = genomic DNA

SEQ ID NO: 46690 - DNA, 126 bp, Homo sapiens
  misc_feature 1..126: note = chr22:36902430-36902556
  misc_feature 1..126: note = hypo
  source 1..126: mol_type = genomic DNA
cgggggaccccacaacggggccgcagcggagaggcccatcctgcagcagatcagaggggtaaggcctcgcacccggcccggcggctgggagacacgaggcccagaaagaggcggggcctgcgggaa

SEQ ID NO: 46691 - DNA, 41 bp, Homo sapiens
  misc_feature 1..41: note = chr22:36906156-36906197
  misc_feature 1..41: note = hypo
  source 1..41: mol_type = genomic DNA
tagtttacatagcctcggctgggtgcggtggctcacgcctg

SEQ ID NO: 46692 - DNA, 117 bp, Homo sapiens
  misc_feature 1..117: note = chr22:37321872-37321989
  misc_feature 1..117: note = hypo
  source 1..117: mol_type = genomic DNA
ccaggatggcagctccgtgggcaggatttttgtgtgttttatcactgctggcccctgattctgaacagagccaggcatgtggtgagcactcgaggaacctttcgtgagtcagtgata

SEQ ID NO: 46693 - DNA, 82 bp, Homo sapiens
  misc_feature 1..82: note = chr22:37328816-37328898
  misc_feature 1..82: note = hypo
  source 1..82: mol_type = genomic DNA
ccctccatccctcaacgtgaccaaggatggagacagctacagcctgcgctgggaaacaatgaaaatgcgatacgaacacata

SEQ ID NO: 46694 - DNA, 30 bp, Homo sapiens
  misc_feature 1..30: note = chr22:37334157-37334187
  misc_feature 1..30: note = hypo
  source 1..30: mol_type = genomic DNA
cctccaattgagggccggtcccccaggtca

SEQ ID NO: 46695 - DNA, 50 bp, Homo sapiens
  misc_feature 1..50: note = chr22:37335158-37335208
  misc_feature 1..50: note = hypo
  source 1..50: mol_type = genomic DNA
catggtattgggggtcgggggggcggtgcaagggacgcacatgagagact

SEQ ID NO: 46696 - DNA, 30 bp, Homo sapiens
  misc_feature 1..30: note = chr22:37348896-37348926
  misc_feature 1..30: note = hypo
  source 1..30: mol_type = genomic DNA
aggcagaggggacaccgtagcccctacccg

SEQ ID NO: 46697 - DNA, 30 bp, Homo sapiens
  misc_feature 1..30: note = chr22:37367531-37367561
  misc_feature 1..30: note = hypo
  source 1..30: mol_type = genomic DNA
caagcgtttgcacatcgttataaattatgt

SEQ ID NO: 46698 - DNA, 30 bp, Homo sapiens
  misc_feature 1..30: note = chr22:37367799-37367829
  misc_feature 1..30: note = hypo
  source 1..30: mol_type = genomic DNA
aggctgagcaggttgcgcaccataaataca

SEQ ID NO: 46699 - DNA, 30 bp, Homo sapiens
  misc_feature 1..30: note = chr22:37395982-37396012
  misc_feature 1..30: note = hypo
  source 1..30: mol_type = genomic DNA
cccttttctggccctcgaagacttcatcaa

SEQ ID NO: 46700 - DNA, 30 bp, Homo sapiens
  misc_feature 1..30: note = chr22:37770782-37770812
  misc_feature 1..30: note = hypo
  source 1..30: mol_type = genomic DNA
gtcggtggagtagggcgtggggtggctcac

SEQ ID NO: 46701 - DNA, 30 bp, Homo sapiens
  misc_feature 1..30: note = chr22:38085235-38085265
  misc_feature 1..30: note = hypo
  source 1..30: mol_type = genomic DNA
agccccactgctgagcggctgaggagcttg

SEQ ID NO: 46702 - DNA, 313 bp, Homo sapiens
  misc_feature 1..313: note = chr22:38199680-38199993
  misc_feature 1..313: note = hypo
  source 1..313: mol_type = genomic DNA
gaccataccgggatgcgttcatcattttgaccagcaacaaactcccactcccagggtattgtttaagtgaacagtgaccggcctctatgcttagggaataaaagcggggttgtgggagaggggcccagggagcaaacgtcgcagaatctcagcccagggccgctgccaagcggacccggcacgtgagtaggaggtcggccgcagacaaggggtcctagggtctctgaggtctctcctgctggcctctgggcccctaaagcccctcgagcttcagaactccctacagacagtggcgccccgtgtccgcctcgtc

SEQ ID NO: 46703 - DNA, 30 bp, Homo sapiens; identical to SEQ ID NO: 16779
  misc_feature 1..30: note = chr22:38520276-38520306
  misc_feature 1..30: note = hypo
  source 1..30: mol_type = genomic DNA

SEQ ID NO: 46704 - DNA, 84 bp, Homo sapiens
  misc_feature 1..84: note = chr22:38578330-38578414
  misc_feature 1..84: note = hypo
  source 1..84: mol_type = genomic DNA
caatacatttttttccgatagaacagaaattgattatagcttttttatttttcacaactaaggccaaattccctaggggaatta

SEQ ID NO: 46705 - DNA, 24 bp, Homo sapiens
  misc_feature 1..24: note = chr22:38578714-38578738
  misc_feature 1..24: note = hypo
  source 1..24: mol_type = genomic DNA
gcccggctccgaaatttttaacat

SEQ ID NO: 46706 - DNA, 136 bp, Homo sapiens
  misc_feature 1..136: note = chr22:38679362-38679498
  misc_feature 1..136: note = hypo
  source 1..136: mol_type = genomic DNA
aagttaattacactacgtgctttcaagatgctgggatgaaagtccttgggaggcataattacttgagaagacattcttcaagggccgtggaggagcccaggttactatctgtaggcatcctttgccccaggtgggc

SEQ ID NO: 46707 - DNA, 89 bp, Homo sapiens
  misc_feature 1..89: note = chr22:38694504-38694593
  misc_feature 1..89: note = hypo
  source 1..89: mol_type = genomic DNA
acccatgccctgctgcgggcacccaggagggaccccaggtgaagccagatcctccttgttccgacgggagacagcgccctgcctggccc

SEQ ID NO: 46708 - DNA, 30 bp, Homo sapiens
  misc_feature 1..30: note = chr22:38841845-38841875
  misc_feature 1..30: note = hypo
  source 1..30: mol_type = genomic DNA
tgaaatgggatccggcgtgtgtcttgaagc

SEQ ID NO: 46709 - DNA, 30 bp, Homo sapiens
  misc_feature 1..30: note = chr22:39228205-39228235
  misc_feature 1..30: note = hypo
  source 1..30: mol_type = genomic DNA
gtgtgagtccctccccgtcccagtgtctga

SEQ ID NO: 46710 - DNA, 32 bp, Homo sapiens
  misc_feature 1..32: note = chr22:39530973-39531005
  misc_feature 1..32: note = hypo
  source 1..32: mol_type = genomic DNA
gccccacagagcactcgcgtcccagcgtttac

SEQ ID NO: 46711 - DNA, 182 bp, Homo sapiens
  misc_feature 1..182: note = chr22:39756856-39757038
  misc_feature 1..182: note = hypo
  source 1..182: mol_type = genomic DNA
ctggcagagcagagacgaggctgtcgcccctgctggggtgtacgcttggagggcgagaactgcatctgtcatagccccaggactagattgcttccaggcatctccttagggccccaactatggatggacgtggcgggaactgcactgatcggtcgtccttctagccacggttcttcaggtgt

SEQ ID NO: 46712 - DNA, 79 bp, Homo sapiens
  misc_feature 1..79: note = chr22:39770483-39770562
  misc_feature 1..79: note = hypo
  source 1..79: mol_type = genomic DNA
tggacgtgtacttcccgcagatcagcagcgtcaaggaccgcaagaaagccgtcctgtccgacatcggtgtctcgggtga

SEQ ID NO: 46713 - DNA, 135 bp, Homo sapiens
  misc_feature 1..135: note = chr22:39877264-39877399
  misc_feature 1..135: note = hypo
  source 1..135: mol_type = genomic DNA
ctcacgtcgcctcctcggtgagcctgccctgcccactccattcatcactggacataatgacgcactcgctcctgcccgttacccgctttgtctttctccagagcacagcctctttgggcgcgcagttttctgagc

SEQ ID NO: 46714 - DNA, 30 bp, Homo sapiens
  misc_feature 1..30: note = chr22:39932533-39932563
  misc_feature 1..30: note = hypo
  source 1..30: mol_type = genomic DNA
tcttgtgctcacacacggttaggttggagg

SEQ ID NO: 46715 - DNA, 206 bp, Homo sapiens
  misc_feature 1..206: note = chr22:40018133-40018339
  misc_feature 1..206: note = hypo
  source 1..206: mol_type = genomic DNA
ccaaaaggtggcctccgtacactcagcacccagaactctgcctggcggacagaaggcgcgccaaagacacgtgtgaaatggacacagcaggtgtactgagctgtgtactgtgccaggaccacagagctatacatgctcctgtgccgggcatgaggaggcagggagaatggggctgggggtcgggaggcctccgggagaaggggatg

SEQ ID NO: 46716 - DNA, 50 bp, Homo sapiens
  misc_feature 1..50: note = chr22:40037034-40037084
  misc_feature 1..50: note = hypo
  source 1..50: mol_type = genomic DNA
gactttggggcggggcgccaggacctcaatgccagcggcctctgtgtcaa

SEQ ID NO: 46717 - DNA, 270 bp, Homo sapiens; identical to SEQ ID NO: 16784
  misc_feature 1..270: note = chr22:40042590-40042860
  misc_feature 1..270: note = hypo
  source 1..270: mol_type = genomic DNA

SEQ ID NO: 46718 - DNA, 41 bp, Homo sapiens
  misc_feature 1..41: note = chr22:40055020-40055061
  misc_feature 1..41: note = hypo
  source 1..41: mol_type = genomic DNA
ttcatgcctgccctgcggcgccagctcgtggtgctcatgaa

SEQ ID NO: 46719 - DNA, 30 bp, Homo sapiens
  misc_feature 1..30: note = chr22:40055554-40055584
  misc_feature 1..30: note = hypo
  source 1..30: mol_type = genomic DNA
ggtgagtggccgctgcgtgttcatgtttgc

SEQ ID NO: 46720 - DNA, 97 bp, Homo sapiens
  misc_feature 1..97: note = chr22:40073967-40074064
  misc_feature 1..97: note = hypo
  source 1..97: mol_type = genomic DNA
ggctgacctcctccccgcttccagtctgcaacgacgagaacccgtgcgagggcatgagccggcatgccaccttcgagaacttcggcatggccttcct

SEQ ID NO: 46721 - DNA, 37 bp, Homo sapiens
  misc_feature 1..37: note = chr22:40095526-40095563
  misc_feature 1..37: note = hypo
  source 1..37: mol_type = genomic DNA
atttggctgagcaaccgggcaccgtagcccagccagc

SEQ ID NO: 46722 - DNA, 30 bp, Homo sapiens
  misc_feature 1..30: note = chr22:40113507-40113537
  misc_feature 1..30: note = hypo
  source 1..30: mol_type = genomic DNA
agttataggataggccggtcagattaacca

SEQ ID NO: 46723 - DNA, 26 bp, Homo sapiens
  misc_feature 1..26: note = chr22:40548285-40548311
  misc_feature 1..26: note = hypo
  source 1..26: mol_type = genomic DNA
cctcaaaattttggacggaaaagttt

SEQ ID NO: 46724 - DNA, 20 bp, Homo sapiens
  misc_feature 1..20: note = chr22:40991418-40991438
  misc_feature 1..20: note = hypo
  source 1..20: mol_type = genomic DNA
ccggccgagaaatgcctttt

SEQ ID NO: 46725 - DNA, 150 bp, Homo sapiens
  misc_feature 1..150: note = chr22:41048813-41048963
  misc_feature 1..150: note = hypo
  source 1..150: mol_type = genomic DNA
aaccttcctgccttccgggtgctcagagtctagtctggagacaataagaaaaatggttaatcaccatggaatgtgctagcgccttagcccgaagcaggggtctggttattgaggtttgttgaaggaagatgcctgtaagggctgggtgcg

SEQ ID NO: 46726 - DNA, 81 bp, Homo sapiens
  misc_feature 1..81: note = chr22:41578499-41578580
  misc_feature 1..81: note = hypo
  source 1..81: mol_type = genomic DNA
aatagtgttatggaggtagaagatacggattaatccagagtcagcaatataataagatgatttcaacgtttgtagtttttt

SEQ ID NO: 46727 - DNA, 444 bp, Homo sapiens
  misc_feature 1..444: note = chr22:41634411-41634855
  misc_feature 1..444: note = hypo
  source 1..444: mol_type = genomic DNA
gcagagcctggagctcgttgtggtgtaggctgagccgtctcagggcgggcaggccagccagggcctcgggggccagcacgctgagcgcgttgtgcgacagccgcagccagcggacgcgcagtagcccctggaaggccatggcgggcaggtaaaccagggcgttgtgggccaggtttagcgtggccagcgcacccagtgccccgaacgtccccggccgcagctcctccagtgcgttcccctccagctccagccgccgcaacgagcccagcccgtccagcgcctcctggggcagctcacgcaggtggttggaggccaggttgagcaggagcaggcggcccaggccacggaaggcgccctcggccaccagctccacctcgcagtggcgcaggtccaggtgtgtgaggtgaggcacgccctggaaggcggctgcggggatcaccttca

SEQ ID NO: 46728 - DNA, 30 bp, Homo sapiens; identical to SEQ ID NO: 16787
  misc_feature 1..30: note = chr22:41637166-41637196
  misc_feature 1..30: note = hypo
  source 1..30: mol_type = genomic DNA

SEQ ID NO: 46729 - DNA, 101 bp, Homo sapiens
  misc_feature 1..101: note = chr22:41657315-41657416
  misc_feature 1..101: note = hypo
  source 1..101: mol_type = genomic DNA
ggcttggagagggcacgtgacgccccaggtctcttggttgagtgccagccctgggattagcatccagaactgtcagcctactatgccgagtgcacctcaag

SEQ ID NO: 46730 - DNA, 30 bp, Homo sapiens
  misc_feature 1..30: note = chr22:41668138-41668168
  misc_feature 1..30: note = hypo
  source 1..30: mol_type = genomic DNA
cttgatcccatgtgccgaaagcaagctcag

SEQ ID NO: 46731 - DNA, 44 bp, Homo sapiens
  misc_feature 1..44: note = chr22:41776124-41776168
  misc_feature 1..44: note = hypo
  source 1..44: mol_type = genomic DNA
ttttcctccttaccccgccgcaaaattatttttatttatttatt

SEQ ID NO: 46732 - DNA, 81 bp, Homo sapiens
  misc_feature 1..81: note = chr22:41839301-41839382
  misc_feature 1..81: note = hypo
  source 1..81: mol_type = genomic DNA
ctctaatgtcagaagcgaaggaagatttttttccccccctcgagacagtcttgctctgtagcccagagctggagtgcaatg

SEQ ID NO: 46733 - DNA, 21 bp, Homo sapiens
  misc_feature 1..21: note = chr22:41839922-41839943
  misc_feature 1..21: note = hypo
  source 1..21: mol_type = genomic DNA
cccggccggaaggtttttcag

SEQ ID NO: 46734 - DNA, 18 bp, Homo sapiens
  misc_feature 1..18: note = chr22:41939343-41939361
  misc_feature 1..18: note = hypo
  source 1..18: mol_type = genomic DNA
tgcattgacccgaggcga

SEQ ID NO: 46735 - DNA, 42 bp, Homo sapiens
  misc_feature 1..42: note = chr22:42109080-42109122
  misc_feature 1..42: note = hypo
  source 1..42: mol_type = genomic DNA
gggattacatgcgtgagccaccgcgcccggctgggcattaga

SEQ ID NO: 46736 - DNA, 127 bp, Homo sapiens
  misc_feature 1..127: note = chr22:42395163-42395290
  misc_feature 1..127: note = hypo
  source 1..127: mol_type = genomic DNA
ggcggggagggggtgcgagacgcgtgtgtccttcgaagagaggccggagctgaccggcggttgtgagcagccgggggccttcggtggcagcgtggctgcccttgggtgcctgcgactttgttggatg

SEQ ID NO: 46737 - DNA, 51 bp, Homo sapiens
  misc_feature 1..51: note = chr22:42667191-42667242
  misc_feature 1..51: note = hypo
  source 1..51: mol_type = genomic DNA
gtccctggcagcccccgcccatgggttccaggtgtccgtggaggaacgact

SEQ ID NO: 46738 - DNA, 30 bp, Homo sapiens
  misc_feature 1..30: note = chr22:42675831-42675861
  misc_feature 1..30: note = hypo
  source 1..30: mol_type = genomic DNA
ggcctccgtggcaatcgggctcacaaagcc

SEQ ID NO: 46739 - DNA, 30 bp, Homo sapiens
  misc_feature 1..30: note = chr22:42829925-42829955
  misc_feature 1..30: note = hypo
  source 1..30: mol_type = genomic DNA
gcattggaaaagcatcggtctgtgcctcta

SEQ ID NO: 46740 - DNA, 47 bp, Homo sapiens
  misc_feature 1..47: note = chr22:42963266-42963313
  misc_feature 1..47: note = hypo
  source 1..47: mol_type = genomic DNA
gtctgggaatgttaacgtgtttgtctttgatccgtgtgggatttgtt

SEQ ID NO: 46741 - DNA, 30 bp, Homo sapiens; identical to SEQ ID NO: 16790
  misc_feature 1..30: note = chr22:42995705-42995735
  misc_feature 1..30: note = hypo
  source 1..30: mol_type = genomic DNA

SEQ ID NO: 46742 - DNA, 21 bp, Homo sapiens
  misc_feature 1..21: note = chr22:43012543-43012564
  misc_feature 1..21: note = hypo
  source 1..21: mol_type = genomic DNA
agtgtagggcagatgcggagg

SEQ ID NO: 46743 - DNA, 30 bp, Homo sapiens; identical to SEQ ID NO: 16792
  misc_feature 1..30: note = chr22:43083005-43083035
  misc_feature 1..30: note = hypo
  source 1..30: mol_type = genomic DNA

SEQ ID NO: 46744 - DNA, 57 bp, Homo sapiens
  misc_feature 1..57: note = chr22:43434441-43434498
  misc_feature 1..57: note = hypo
  source 1..57: mol_type = genomic DNA
gcatgggaacaaccacgctcgcgcagcctgtcccgcagccatcgctcctcccacagc

SEQ ID NO: 46745 - DNA, 194 bp, Homo sapiens
  misc_feature 1..194: note = chr22:43524923-43525117
  misc_feature 1..194: note = hypo
  source 1..194: mol_type = genomic DNA
cccatggtgtccactcggcaccgcccaccacaagggcagctgactgccctcacctgtgcccaccgggtgtctttgcctgtgtcccgcagactggcaggcccaggccacgctggcctctctggccacgtcctcagggccactttccccctctcctgaactccttccttctctggtcccctcgagctccttcccag

SEQ ID NO: 46746 - DNA, 30 bp, Homo sapiens
  misc_feature 1..30: note = chr22:43570284-43570314
  misc_feature 1..30: note = hypo
  source 1..30: mol_type = genomic DNA
gccagggtgggccctcggggccacctgccc

SEQ ID NO: 46747 - DNA, 30 bp, Homo sapiens; identical to SEQ ID NO: 16795
  misc_feature 1..30: note = chr22:43581330-43581360
  misc_feature 1..30: note = hypo
  source 1..30: mol_type = genomic DNA

SEQ ID NO: 46748 - DNA, 262 bp, Homo sapiens
  misc_feature 1..262: note = chr22:43601093-43601355
  misc_feature 1..262: note = hypo
  source 1..262: mol_type = genomic DNA
ctggtccctggacctcgggaacatcgctttgctgctctgactttcattcttccctgcacagagaggtcacgatgcctcttcccggggctgcgaggaaaatgatctgcactggcgtgagcagagaacctctcctcagcggtgctcagtacaggtttgctgcagggatctaggcagcaaacggggctgtcctccggagcagtctctggagggcagatgcagtccccgccctctctgagccccagtgtctcgtctctctagtggg

SEQ ID NO: 46749 - DNA, 202 bp, Homo sapiens
  misc_feature 1..202: note = chr22:43603869-43604071
  misc_feature 1..202: note = hypo
  source 1..202: mol_type = genomic DNA
gcagaggccactaaccgctgtcttgcctgtaccacccggtaccaccctcagcctgtctggctctggcccctgacagtgttcgttctgcttccaggtctgtacctgccaggtcgcagctccctgagggcggggacgtgcgactcatctctgtgtctccagggccccgcctgagccgtgcacagtgggccgtgaagacagtgga

SEQ ID NO: 46750 - DNA, 30 bp, Homo sapiens
  misc_feature 1..30: note = chr22:43665130-43665160
  misc_feature 1..30: note = hypo
  source 1..30: mol_type = genomic DNA
aggttgggacagcgtcggggaagacgtgcc

SEQ ID NO: 46751 - DNA, 119 bp, Homo sapiens
  misc_feature 1..119: note = chr22:43677877-43677996
  misc_feature 1..119: note = hypo
  source 1..119: mol_type = genomic DNA
tgtccctctgagttccgccagctttgggcctggcttcaggctcctgggcccattgtctcccataggtaaccacagctgctgggacgaggactcctctggccaaccggaacaagctggaa

SEQ ID NO: 46752 - DNA, 30 bp, Homo sapiens
  misc_feature 1..30: note = chr22:43689691-43689721
  misc_feature 1..30: note = hypo
  source 1..30: mol_type = genomic DNA
ccctgggactcagttcggacccctctcatg

SEQ ID NO: 46753 - DNA, 30 bp, Homo sapiens
  misc_feature 1..30: note = chr22:43735330-43735360
  misc_feature 1..30: note = hypo
  source 1..30: mol_type = genomic DNA
tgcccgtccattgatcggtgggctcattgg

SEQ ID NO: 46754 - DNA, 154 bp, Homo sapiens
  misc_feature 1..154: note = chr22:44455600-44455754
  misc_feature 1..154: note = hypo
  source 1..154: mol_type = genomic DNA
aataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagca

SEQ ID NO: 46755 - DNA, 30 bp, Homo sapiens
  misc_feature 1..30: note = chr22:44484781-44484811
  misc_feature 1..30: note = hypo
  source 1..30: mol_type = genomic DNA
gtatgttctgtaatccgaggttgtgtgccc

SEQ ID NO: 46756 - DNA, 36 bp, Homo sapiens
  misc_feature 1..36: note = chr22:44527455-44527491
  misc_feature 1..36: note = hypo
  source 1..36: mol_type = genomic DNA
gtacatgacctgctgcggccccgaggctgggcgctc

SEQ ID NO: 46757 - DNA, 39 bp, Homo sapiens; identical to SEQ ID NO: 16798
  misc_feature 1..39: note = chr22:44538737-44538776
  misc_feature 1..39: note = hypo
  source 1..39: mol_type = genomic DNA

SEQ ID NO: 46758 - DNA, 60 bp, Homo sapiens
  misc_feature 1..60: note = chr22:44564136-44564196
  misc_feature 1..60: note = hypo
  source 1..60: mol_type = genomic DNA
tggggtttttggtcccggtaagtgtcattagccatgtcccccaaccggttcttagacatg

SEQ ID NO: 46759 - DNA, 63 bp, Homo sapiens
  misc_feature 1..63: note = chr22:44564434-44564497
  misc_feature 1..63: note = hypo
  source 1..63: mol_type = genomic DNA
gacaggaggatggcacgcctctgaagtttctctgtttccttctgcagacgtggttaacttgga

SEQ ID NO: 46760 - DNA, 62 bp, Homo sapiens
  misc_feature 1..62: note = chr22:44580537-44580599
  misc_feature 1..62: note = hypo
  source 1..62: mol_type = genomic DNA
gtaggtgttatggagcgagaactccagtgccaacagggtccctggcacggcagatgagaccc

SEQ ID NO: 46761 - DNA, 180 bp, Homo sapiens
  misc_feature 1..180: note = chr22:44664413-44664593
  misc_feature 1..180: note = hypo
  source 1..180: mol_type = genomic DNA
agtggaacgaggtgccgggactcccagcccagggttctgctctgcaccagcaccccccagaagactcagtccagtggaaacaggccacggagctctctgactgtgctgcaagtgggcagcagggagagggtgttttagaggatggggagaggcctcgggaaggagcgtgacctcagcgac

SEQ ID NO: 46762 - DNA, 30 bp, Homo sapiens
  misc_feature 1..30: note = chr22:44671280-44671310
  misc_feature 1..30: note = hypo
  source 1..30: mol_type = genomic DNA
agcgaggctgagtttcgggaagctcctggg

SEQ ID NO: 46763 - DNA, 93 bp, Homo sapiens
  misc_feature 1..93: note = chr22:44681409-44681502
  misc_feature 1..93: note = hypo
  source 1..93: mol_type = genomic DNA
tgcggctgtggggcccgctgacccggccgaggggcccgagcggggttcccccaccgccgggggtcctgtttcatccatcgtccttggatgccc

SEQ ID NO: 46764 - DNA, 70 bp, Homo sapiens
  misc_feature 1..70: note = chr22:44698506-44698576
  misc_feature 1..70: note = hypo
  source 1..70: mol_type = genomic DNA
gccctggggtgggtgcggtgaggaggcagcaggggcaaaggccctggggtgggtgcggtgaggaggcagc

SEQ ID NO: 46765 - DNA, 133 bp, Homo sapiens
  misc_feature 1..133: note = chr22:45020626-45020759
  misc_feature 1..133: note = hypo
  source 1..133: mol_type = genomic DNA
tggcctccagaactgcgatcgaataaatgtctgttgttttaagtcccccaggctgtggtcatctgtgagtccgcagaactgacttggggaccttgggtggcagcagctcccctgcacacggtcccacgggtcc

SEQ ID NO: 46766 - DNA, 163 bp, Homo sapiens
  misc_feature 1..163: note = chr22:45075725-45075888
  misc_feature 1..163: note = hypo
  source 1..163: mol_type = genomic DNA
gcccggaaaagatgccggcgcagcctgagggcttgtacaggtgccactgtgccgaagggtggctacgagggaggcaggtgtatgggtgagggtgagtgcagtgtggctggaggcttagggaaaggtgagtaggacggcgagagacccacggggaatgagggct

SEQ ID NO: 46767 - DNA, 73 bp, Homo sapiens; identical to SEQ ID NO: 16800
  misc_feature 1..73: note = chr22:45088693-45088766
  misc_feature 1..73: note = hypo
  source 1..73: mol_type = genomic DNA

SEQ ID NO: 46768 - DNA, 41 bp, Homo sapiens
  misc_feature 1..41: note = chr22:45093092-45093133
  misc_feature 1..41: note = hypo
  source 1..41: mol_type = genomic DNA
cctggtgcttggtgccggagtcaccgcgagtaccctgggct

SEQ ID NO: 46769 - DNA, 104 bp, Homo sapiens
  misc_feature 1..104: note = chr22:45137806-45137910
  misc_feature 1..104: note = hypo
  source 1..104: mol_type = genomic DNA
gccagccaggaaacaccacatactggatgattccattccgagatgttcagaataggcaaatccacggggacagaaagtagagtggtggtcgccagaccctgcgg

SEQ ID NO: 46770 - DNA, 191 bp, Homo sapiens
  misc_feature 1..191: note = chr22:45277292-45277483
  misc_feature 1..191: note = hypo
  source 1..191: mol_type = genomic DNA
tgaagacatggacatcgcaagccacgcggtaatgcatacttggcacagagtagccaatatagaagacgtgtgcctcacacggttcactttgttcatcaataaaagaatataaaaatcttgttcacccagtggtaagtgtattaaaatagatctgtatcatacagcacagtttctcccggagtcgtgagaat

SEQ ID NO: 46771 - DNA, 49 bp, Homo sapiens; identical to SEQ ID NO: 16801
  misc_feature 1..49: note = chr22:45593666-45593715
  misc_feature 1..49: note = hypo
  source 1..49: mol_type = genomic DNA

SEQ ID NO: 46772 - DNA, 30 bp, Homo sapiens
  misc_feature 1..30: note = chr22:45604343-45604373
  misc_feature 1..30: note = hypo
  source 1..30: mol_type = genomic DNA
aacaggcagaaccaccgactccacacgcac

SEQ ID NO: 46773 - DNA, 106 bp, Homo sapiens
  misc_feature 1..106: note = chr22:45931289-45931395
  misc_feature 1..106: note = hypo
  source 1..106: mol_type = genomic DNA
tagaatctgcggggccgcatggtatacagaacaggggttggcaaactttttgtgtaaagggctggacagcaaatagagcaaatactttagccgttgtgggccatat

SEQ ID NO: 46774 - DNA, 30 bp, Homo sapiens
  misc_feature 1..30: note = chr22:45981309-45981339
  misc_feature 1..30: note = hypo
  source 1..30: mol_type = genomic DNA
gtggagagtttggcccgggatcagtacaca

SEQ ID NO: 46775 - DNA, 36 bp, Homo sapiens
  misc_feature 1..36: note = chr22:46438085-46438121
  misc_feature 1..36: note = hypo
  source 1..36: mol_type = genomic DNA
aaaatcagctgggcacgttggctcacgcctgtaatc

SEQ ID NO: 46776 - DNA, 86 bp, Homo sapiens
  misc_feature 1..86: note = chr22:46521906-46521992
  misc_feature 1..86: note = hypo
  source 1..86: mol_type = genomic DNA
ctggtggctgtgagccgggccggctggctcattcagcccaggccccacccgccctgggatgatctggaccccggccctgctctcag

SEQ ID NO: 46777 - DNA, 38 bp, Homo sapiens
  misc_feature 1..38: note = chr22:46719152-46719190
  misc_feature 1..38: note = hypo
  source 1..38: mol_type = genomic DNA
ttggcaggtgagtgacgttggtccgcttcctctcttta

SEQ ID NO: 46778 - DNA, 120 bp, Homo sapiens
  misc_feature 1..120: note = chr22:46805005-46805125
  misc_feature 1..120: note = hypo
  source 1..120: mol_type = genomic DNA
ggtcactccaggacacgacgctctcaccgctgaagagctgggggtgaggcatggctgcggacacaggcccagggacctcaggtgtctcccgaaatcacacggccgcggacttggctgcag

SEQ ID NO: 46779 - DNA, 148 bp, Homo sapiens
  misc_feature 1..148: note = chr22:46929253-46929401
  misc_feature 1..148: note = hypo
  source 1..148: mol_type = genomic DNA
gaaggcgctgatccccggtcttgaacttgggagaaccgcaggcctgctcccaggaaaatgctgacggaagcggcgcggtgcctctccccctcgctgggcctaggccgggcgcccacccccagcatccaaccggcggcaacaaatcctt

SEQ ID NO: 46780 - DNA, 57 bp, Homo sapiens
  misc_feature 1..57: note = chr22:46929652-46929709
  misc_feature 1..57: note = hypo
  source 1..57: mol_type = genomic DNA
tgaggctgtctgacacgtcggggtcatgggccgggatgcagccgatcacgccggtgg

SEQ ID NO: 46781 - DNA, 252 bp, Homo sapiens
  misc_feature 1..252: note = chr22:46931788-46932040
  misc_feature 1..252: note = hypo
  source 1..252: mol_type = genomic DNA
ccaggagctggtactcggccgcctcctcccggtccagcaccgcccgtgtgctcaccacgccagagctctcgttgagctggaagacgtcccacgcgccccccaacacgcggtaacgcaagttggcgttgatgggcgagtcgcggtcgctggcgcggatggtcagcacctcgtagcccacctccaggttctcccgcacgcgctcgcggtactccgactgctcgaagaccgggctgtggtcgttggtgtctttga

SEQ ID NO: 46782 - DNA, 173 bp, Homo sapiens
  misc_feature 1..173: note = chr22:47005073-47005246
  misc_feature 1..173: note = hypo
  source 1..173: mol_type = genomic DNA
cccagagacatacatcgcagaccgctgagtggcgctggttgctgtctgggccggcttggcctcaggcgatcctgttgccctccgcgcaggagcctgggtccaccttctcctggctgtgtgcttccttaaacacggaaggtgttccgcagcctgctgtgcggggtagccctgtg

SEQ ID NO: 46783 - DNA, 57 bp, Homo sapiens
  misc_feature 1..57: note = chr22:47005505-47005562
  misc_feature 1..57: note = hypo
  source 1..57: mol_type = genomic DNA
tctttggtgccaggccgtgtgctgggccccagggacacggcacgctgatggtcagag

SEQ ID NO: 46784 - DNA, 77 bp, Homo sapiens
  misc_feature 1..77: note = chr22:47054535-47054612
  misc_feature 1..77: note = hypo
  source 1..77: mol_type = genomic DNA
tcatggctctgatcccggcctgctggtgaccccattctgtacatccacccagtgccccaccccgggggccagcccgg

SEQ ID NO: 46785 - DNA, 36 bp, Homo sapiens
  misc_feature 1..36: note = chr22:47193335-47193371
  misc_feature 1..36: note = hypo
  source 1..36: mol_type = genomic DNA
tgcagaaagtgccagcgatgccgcccctctgcagag

SEQ ID NO: 46786 - DNA, 36 bp, Homo sapiens
  misc_feature 1..36: note = chr22:47428866-47428902
  misc_feature 1..36: note = hypo
  source 1..36: mol_type = genomic DNA
ttcctctggggctgtcgctgtcgtcctggctgctct

SEQ ID NO: 46787 - DNA, 219 bp, Homo sapiens
  misc_feature 1..219: note = chr22:47525705-47525924
  misc_feature 1..219: note = hypo
  source 1..219: mol_type = genomic DNA
gtggggctgtgtcagcgtcactgccgctgagtcaccacgtgcactgtgcctgtcatccctttctgggacagcatgtcactttccttggtgtcaccaatcatctcccttaggagtctgtgaaccacccactccctccctccccaccagacaggttaccggagcgggcgtgtctggaggagcaggcagagcaggtgctgtacacctcgtgtcctctgggac

SEQ ID NO: 46788 - DNA, 30 bp, Homo sapiens
  misc_feature 1..30: note = chr22:47840461-47840491
  misc_feature 1..30: note = hypo
  source 1..30: mol_type = genomic DNA
ctctccctgcttccccgtgtgcgcctcact

SEQ ID NO: 46789 - DNA, 68 bp, Homo sapiens
  misc_feature 1..68: note = chr22:48027676-48027744
  misc_feature 1..68: note = hypo
  source 1..68: mol_type = genomic DNA
ggaggagtgtgtgtgcgcttgatgacgatgatggagcccagtgagccaccgtccgtggagtgtcagag

SEQ ID NO: 46790 - DNA, 34 bp, Homo sapiens
  misc_feature 1..34: note = chr22:48553477-48553511
  misc_feature 1..34: note = hypo
  source 1..34: mol_type = genomic DNA
gagcctcagtttccacgtgcgcaccatggtgtca

SEQ ID NO: 46791 - DNA, 30 bp, Homo sapiens
  misc_feature 1..30: note = chr22:48661129-48661159
  misc_feature 1..30: note = hypo
  source 1..30: mol_type = genomic DNA
gtcacaggtggaagccggggccactccttt

SEQ ID NO: 46792 - DNA, 30 bp, Homo sapiens
  misc_feature 1..30: note = chr22:48728717-48728747
  misc_feature 1..30: note = hypo
  source 1..30: mol_type = genomic DNA
ggctggggttgtcctcgttgtaccaagggt

SEQ ID NO: 46793 - DNA, 30 bp, Homo sapiens
  misc_feature 1..30: note = chr22:48793754-48793784
  misc_feature 1..30: note = hypo
  source 1..30: mol_type = genomic DNA
acacacctgcaccctcgcagcacacacaca

SEQ ID NO: 46794 - DNA, 119 bp, Homo sapiens
  misc_feature 1..119: note = chr22:48917425-48917544
  misc_feature 1..119: note = hypo
  source 1..119: mol_type = genomic DNA
tacaaatgtgagtttcggggagccatcccagccagccgcacgggagacggaggatgcgtggccacagatggacccgatccgttaggtgtaaaaggtaaatacggcgagaagtttccatc

SEQ ID NO: 46795 - DNA, 241 bp, Homo sapiens
  misc_feature 1..241: note = chr22:48931827-48932068
  misc_feature 1..241: note = hypo
  source 1..241: mol_type = genomic DNA
ccccccaggagtgcccgtgttgtcgagcccccgccacagagctgcaccgccgcttggtgccgcatgcagcgagttcccgcatgggttggttttcgtctcctgaaactaatttggcagaagcaagtgtccatatgtaggtgtgggtctctgtcttcatgcgtcccccatgccccgacacacacacacgtttccattaattagcagggacttggaaacctaccgtccccggctcaaggcaaat

SEQ ID NO: 46796 - DNA, 106 bp, Homo sapiens
  misc_feature 1..106: note = chr22:48976157-48976263
  misc_feature 1..106: note = hypo
  source 1..106: mol_type = genomic DNA
ccaatgcagagtgttcgtctatctgttagatggatcagtttattttttaagaaatggatagagaacttcttaggagacacagcacagttcccggccctaagactcc

SEQ ID NO: 46797 - DNA, 144 bp, Homo sapiens
  misc_feature 1..144: note = chr22:48987212-48987356
  misc_feature 1..144: note = hypo
  source 1..144: mol_type = genomic DNA
ctctcctcccacccccgtgcgtctgacccccagggcttgcgatgcctcagttgcctgcagccatggccttgccctggatggagagcacagacagaggcagctgggagtttctgggagtttctgaggcctcgcattggacagagt

SEQ ID NO: 46798 - DNA, 80 bp, Homo sapiens
  misc_feature 1..80: note = chr22:49048024-49048104
  misc_feature 1..80: note = hypo
  source 1..80: mol_type = genomic DNA
acctgctctattgtacgcaagagactgggagtgcgccaaggtccctaagatgcggtgtctgtggccgagtcagcctgcat

SEQ ID NO: 46799 - DNA, 177 bp, Homo sapiens
  misc_feature 1..177: note = chr22:49115640-49115817
  misc_feature 1..177: note = hypo
  source 1..177: mol_type = genomic DNA
aaaaacgtatatggccggcgccacatcagctagtattgtaagcagtgacactcttcattttctcagcagaaatgagcccagaaacaaaaaaaaattggtttgaccaaacccacattatttctgtctgcactttgggccacttttgtaatgggagacgtgacacgctgggcgccattt

SEQ ID NO: 46800 - DNA, 30 bp, Homo sapiens; identical to SEQ ID NO: 16811
  misc_feature 1..30: note = chr22:49117093-49117123
  misc_feature 1..30: note = hypo
  source 1..30: mol_type = genomic DNA

SEQ ID NO: 46801 - DNA, 30 bp, Homo sapiens
  misc_feature 1..30: note = chr22:49138471-49138501
  misc_feature 1..30: note = hypo
  source 1..30: mol_type = genomic DNA
ggcaacgtggtagaccgggcagtgtgatgg

SEQ ID NO: 46802 - DNA, 30 bp, Homo sapiens
  misc_feature 1..30: note = chr22:49145839-49145869
  misc_feature 1..30: note = hypo
  source 1..30: mol_type = genomic DNA
ccgacccgaggaggccggactcagacacat

SEQ ID NO: 46803 - DNA, 30 bp, Homo sapiens
  misc_feature 1..30: note = chr22:49147007-49147037
  misc_feature 1..30: note = hypo
  source 1..30: mol_type = genomic DNA
atttcctgcccctttcgccactcacggacc

SEQ ID NO: 46804 - DNA, 30 bp, Homo sapiens
  misc_feature 1..30: note = chr22:49247250-49247280
  misc_feature 1..30: note = hypo
  source 1..30: mol_type = genomic DNA
atctcgcgtggccaccgtgaagtatggaca

SEQ ID NO: 46805 - DNA, 30 bp, Homo sapiens
  misc_feature 1..30: note = chr22:49277436-49277466
  misc_feature 1..30: note = hypo
  source 1..30: mol_type = genomic DNA
cctcctcctgcctcacgcaccacacaaccc

SEQ ID NO: 46806 - DNA, 40 bp, Homo sapiens
  misc_feature 1..40: note = chr22:49387651-49387691
  misc_feature 1..40: note = hypo
  source 1..40: mol_type = genomic DNA
tctttctgatcatctcggttccaatcgaggtgagatggtg

SEQ ID NO: 46807 - DNA, 39 bp, Homo sapiens
  misc_feature 1..39: note = chr22:49447333-49447372
  misc_feature 1..39: note = hypo
  source 1..39: mol_type = genomic DNA
ttaggtcgtaaagaccgtctccatcgcttcttccgttcg

SEQ ID NO: 46808 - DNA, 36 bp, Homo sapiens
  misc_feature 1..36: note = chr22:49491699-49491735
  misc_feature 1..36: note = hypo
  source 1..36: mol_type = genomic DNA
acactcacacagacgcgtgaacgcactcacatacac

SEQ ID NO: 46809 - DNA, 100 bp, Homo sapiens
  misc_feature 1..100: note = chr22:49508009-49508109
  misc_feature 1..100: note = hypo
  source 1..100: mol_type = genomic DNA
gactatacccggccacgggaggaggatggcgagtcgcgcttgcaaatgtttgctcacccggcacgtgtcacgagtgtgcgctccgcgcccatcacctttc

SEQ ID NO: 46810 - DNA, 30 bp, Homo sapiens
  misc_feature 1..30: note = chr22:49510169-49510199
  misc_feature 1..30: note = hypo
  source 1..30: mol_type = genomic DNA
cagcttctaggataacgtggtgaggaaaaa

SEQ ID NO: 46811 - DNA, 253 bp, Homo sapiens
  misc_feature 1..253: note = chr22:49637528-49637781
  misc_feature 1..253: note = hypo
  source 1..253: mol_type = genomic DNA
tcactgagcttcacacgacgctagctctgtccaagtcggggtccctgtgcccctaggtttccggtcaccgggagagctgtctgtcgcgccataagctggaggtgcgcaggaggatagaaatagaaactcctcatccagccgggccagggcactgacagccacagcgatgtccacggtgtaatggtcacggactccgtccccaaattagcccattttttacaaagacgataatggggggcggttctctgtgaaa

SEQ ID NO: 46812 - DNA, 30 bp, Homo sapiens
  misc_feature 1..30: note = chr22:49694859-49694889
  misc_feature 1..30: note = hypo
  source 1..30: mol_type = genomic DNA
agcttctccaccgcccgcagcagcttctcc

SEQ ID NO: 46813 - DNA, 39 bp, Homo sapiens
  misc_feature 1..39: note = chr22:49785322-49785361
  misc_feature 1..39: note = hypo
  source 1..39: mol_type = genomic DNA
tagccagggtttgcccgcggacgccgcccagccctccct

SEQ ID NO: 46814 - DNA, 30 bp, Homo sapiens
  misc_feature 1..30: note = chr22:49814696-49814726
  misc_feature 1..30: note = hypo
  source 1..30: mol_type = genomic DNA
gcttgccaggtggagcgcacatctgttcag

SEQ ID NO: 46815 - DNA, 32 bp, Homo sapiens
  misc_feature 1..32: note = chr22:49831409-49831441
  misc_feature 1..32: note = hypo
  source 1..32: mol_type = genomic DNA
cacggtcttctcgtacgcgtgaggagccagtg

SEQ ID NO: 46816 - DNA, 40 bp, Homo sapiens
  misc_feature 1..40: note = chr22:49831947-49831987
  misc_feature 1..40: note = hypo
  source 1..40: mol_type = genomic DNA
tctggaatttggagccggtgacatacgctgaagtctctct

SEQ ID NO: 46817 - DNA, 30 bp, Homo sapiens
  misc_feature 1..30: note = chr22:49851741-49851771
  misc_feature 1..30: note = hypo
  source 1..30: mol_type = genomic DNA
ccacccacggctgtgcgtcccttaacaaag

SEQ ID NO: 46818 - DNA, 30 bp, Homo sapiens
  misc_feature 1..30: note = chr22:49852487-49852517
  misc_feature 1..30: note = hypo
  source 1..30: mol_type = genomic DNA
acggaccaacccgggcgctgacatcactct

SEQ ID NO: 46819 - DNA, 149 bp, Homo sapiens
  misc_feature 1..149: note = chr22:49864707-49864856
  misc_feature 1..149: note = hypo
  source 1..149: mol_type = genomic DNA
aaggtgtgactgcagcgtgactggtggaaacatatgtttgcgttaccactcccctgccagccacaaatacacacaaaagagactgggatggtggcaccaaagagcttcagagggcacgggcgtcatttccacatcgctttccaaaatgc

SEQ ID NO: 46820 - DNA, 43 bp, Homo sapiens
  misc_feature 1..43: note = chr22:49868142-49868185
  misc_feature 1..43: note = hypo
  source 1..43: mol_type = genomic DNA
gaaagagtgactccacgaagcaagcgtacgaatacaagctcac

SEQ ID NO: 46821 - DNA, 39 bp, Homo sapiens
  misc_feature 1..39: note = chr22:49888284-49888323
  misc_feature 1..39: note = hypo
  source 1..39: mol_type = genomic DNA
ccaggggtctccaggcggtgggagcgcaccccagcaggc

SEQ ID NO: 46822 - DNA, 58 bp, Homo sapiens
  misc_feature 1..58: note = chr22:49911506-49911564
  misc_feature 1..58: note = hypo
  source 1..58: mol_type = genomic DNA
tctctgtataaccttcgcggccactgcccccgtgcctgcagagcgggtttgcaggaga

SEQ ID NO: 46823 - DNA, 99 bp, Homo sapiens
  misc_feature 1..99: note = chr22:49934854-49934953
  misc_feature 1..99: note = hypo
  source 1..99: mol_type = genomic DNA
gggtgactggggcagcggagaaagcggagacagagacagggtgtgcccagggcgcgggcaccgggaggtccagcctgcgaggcacgtggcctgcccagc

SEQ ID NO: 46824 - DNA, 30 bp, Homo sapiens
  misc_feature 1..30: note = chr22:49937851-49937881
  misc_feature 1..30: note = hypo
  source 1..30: mol_type = genomic DNA
ttttgtttaatcccacgtgagcaaaatcac

SEQ ID NO: 46825 - DNA, 39 bp, Homo sapiens
  misc_feature 1..39: note = chr22:49941794-49941833
  misc_feature 1..39: note = hypo
  source 1..39: mol_type = genomic DNA
ccagacaagtcccgccgctgtcagcgcacctctgcattg

SEQ ID NO: 46826 - DNA, 51 bp, Homo sapiens
  misc_feature 1..51: note = chr22:49943168-49943219
  misc_feature 1..51: note = hypo
  source 1..51: mol_type = genomic DNA
tgcctgatgcagagtcgggggcggcttcctgcagaccgggcttccttggcc

SEQ ID NO: 46827 - DNA, 30 bp, Homo sapiens
  misc_feature 1..30: note = chr22:49948590-49948620
  misc_feature 1..30: note = hypo
  source 1..30: mol_type = genomic DNA
ccccgggtgcacccacggtgatcagggacc

SEQ ID NO: 46828 - DNA, 30 bp, Homo sapiens
  misc_feature 1..30: note = chr22:49959175-49959205
  misc_feature 1..30: note = hypo
  source 1..30: mol_type = genomic DNA
ctcttcactgcttctcggagtgggatccat

SEQ ID NO: 46829 - DNA, 30 bp, Homo sapiens
  misc_feature 1..30: note = chr22:49963888-49963918
  misc_feature 1..30: note = hypo
  source 1..30: mol_type = genomic DNA
ctcgtgcagcctctccgagcacccctgact

SEQ ID NO: 46830 - DNA, 175 bp, Homo sapiens
  misc_feature 1..175: note = chr22:49967997-49968172
  misc_feature 1..175: note = hypo
  source 1..175: mol_type = genomic DNA
gagcctcggggcctgcggggggccaggcagcagctgccctcacagttgcacggtacagtttgcagaacacaccctcctgccctgtggaagcttccaggctcccgggcaggtcgctgaaggatcctcttcctggcccctggagtccacaggtgcgacatcccgtcccgacatgggt

SEQ ID NO: 46831 - DNA, 74 bp, Homo sapiens
  misc_feature 1..74: note = chr22:49970518-49970592
  misc_feature 1..74: note = hypo
  source 1..74: mol_type = genomic DNA
accagctgatgacaacgtgtttccccctgtggctgcagccactcctgtcccatgggcagcgcagagctgtcctc

SEQ ID NO: 46832 - DNA, 30 bp, Homo sapiens
  misc_feature 1..30: note = chr22:49977657-49977687
  misc_feature 1..30: note = hypo
  source 1..30: mol_type = genomic DNA
ggctccgggcagctgcgtcagggccccaca

SEQ ID NO: 46833 - DNA, 40 bp, Homo sapiens; identical to SEQ ID NO: 16815
  misc_feature 1..40: note = chr22:49979613-49979653
  misc_feature 1..40: note = hypo
  source 1..40: mol_type = genomic DNA

SEQ ID NO: 46834 - DNA, 187 bp, Homo sapiens
  misc_feature 1..187: note = chr22:49980189-49980376
  misc_feature 1..187: note = hypo
  source 1..187: mol_type = genomic DNA
tctgtgtgacatcagcgtgtttagtgcatgacatcagcatgtttagcacagagtcactgggagacagtgtgagtctgtgtgacatcagcgtgcttagtgtatgacatcagcgtgtttagtgcatgacatcagcgtgcttggcacagagtcactggaaggtggcatgagtctgcgtgacgtcagcatg

SEQ ID NO: 46835 - DNA, 30 bp, Homo sapiens
  misc_feature 1..30: note = chr22:49980591-49980621
  misc_feature 1..30: note = hypo
  source 1..30: mol_type = genomic DNA
tgcacccactgctctcgtgggccccaggtt

SEQ ID NO: 46836 - DNA, 189 bp, Homo sapiens
  misc_feature 1..189: note = chr22:49983668-49983857
  misc_feature 1..189: note = hypo
  source 1..189: mol_type = genomic DNA
cggcagtgctggggccgggaattctccctgtgggctctgccctccggcgtgaccagtgcatgtgtctgtgctggaggtcggggcccttgagatgagacactgaatgctccctgctctgcccggctcccggcggcaggtggagcgtccagcgcacacagggtctgcacagccaggcgtttcttccccacc

SEQ ID NO: 46837 - DNA, 33 bp, Homo sapiens
  misc_feature 1..33: note = chr22:49992716-49992749
  misc_feature 1..33: note = hypo
  source 1..33: mol_type = genomic DNA
cagcatgagtaatgacgacggcccctccacggc

SEQ ID NO: 46838 - DNA, 35 bp, Homo sapiens
  misc_feature 1..35: note = chr22:49994264-49994299
  misc_feature 1..35: note = hypo
  source 1..35: mol_type = genomic DNA
cacaggccctggggccgcagcgtccacagccccgc

SEQ ID NO: 46839 - DNA, 30 bp, Homo sapiens
  misc_feature 1..30: note = chr22:49996899-49996929
  misc_feature 1..30: note = hypo
  source 1..30: mol_type = genomic DNA
taccccaggccctggcgaggccactctggt

SEQ ID NO: 46840 - DNA, 30 bp, Homo sapiens
  misc_feature 1..30: note = chr22:50000658-50000688
  misc_feature 1..30: note = hypo
  source 1..30: mol_type = genomic DNA
aagtatacaggagaacgtggaattcatctg

SEQ ID NO: 46841 - DNA, 169 bp, Homo sapiens
  misc_feature 1..169: note = chr22:50001661-50001830
  misc_feature 1..169: note = hypo
  source 1..169: mol_type = genomic DNA
taccatgattaatgtcgtgcgcaggcctctcctgggtgccggggattcagctgcgatgaacaggacaaagtccagatctcatgggaccggcatgggggtgatctcagggaggacaacagagaaaatggaagccaagaaccgggaacagggattccgacagatctgggtt

SEQ ID NO: 46842 - DNA, 233 bp, Homo sapiens
  misc_feature 1..233: note = chr22:50002568-50002801
  misc_feature 1..233: note = hypo
  source 1..233: mol_type = genomic DNA
agctggagacattctcgtgttcacggtcacagctctgctcctttgagaaataagcggcacgatgtttttctagtgggtttgcctttttctcagtgatggtaaaagtgctgtgtatgttaaggtgagtgactcaggaccaaggtgagtcttgactcctcttggctttgcgctgagagcacctgggagagtcaagggagcacacaggacagtccctgcttcggctccccaggaac

SEQ ID NO: 46843 - DNA, 78 bp, Homo sapiens; identical to SEQ ID NO: 16818
  misc_feature 1..78: note = chr22:50003204-50003282
  misc_feature 1..78: note = hypo
  source 1..78: mol_type = genomic DNA

SEQ ID NO: 46844 - DNA, 176 bp, Homo sapiens
  misc_feature 1..176: note = chr22:50007867-50008043
  misc_feature 1..176: note = hypo
  source 1..176: mol_type = genomic DNA
acacctggatccccacgaaactgcagaaactgtgactcagacccggcagctccttaccaagcccctccctggagccgcctcacctcccaaagggctcctctctcttgctcttcaaaagttagccccaacgacctgcggcacacggcacacgagactggcttcgcattttgcgttaa

SEQ ID NO: 46845 - DNA, 38 bp, Homo sapiens
  misc_feature 1..38: note = chr22:50008747-50008785
  misc_feature 1..38: note = hypo
  source 1..38: mol_type = genomic DNA
gatgcaggccccctccggcgctgcgctccacaatttga

SEQ ID NO: 46846 - DNA, 280 bp, Homo sapiens
  misc_feature 1..280: note = chr22:50010113-50010393
  misc_feature 1..280: note = hypo
  source 1..280: mol_type = genomic DNA
ggcttcagagctcctcgcagcctgcgccagcgcagagcaggacgggaaacagccccgggagcagaaggtcccagcagcggaattcccctccacttggaccaggcctgcgggagatccgggcactgacaggcggggacattttagaatcttttcaagaaaagataaagaaagaaacaagagtaacaggaggccagaagcaagggcatctactgcagacagcggtgccgcggggctggagctgaagctacccaaggagccccaggctcgggagcctccaggc

SEQ ID NO: 46847 - DNA, 30 bp, Homo sapiens; identical to SEQ ID NO: 16820
  misc_feature 1..30: note = chr22:50010606-50010636
  misc_feature 1..30: note = hypo
  source 1..30: mol_type = genomic DNA

SEQ ID NO: 46848 - DNA, 46 bp, Homo sapiens
  misc_feature 1..46: note = chr22:50013222-50013268
  misc_feature 1..46: note = hypo
  source 1..46: mol_type = genomic DNA
gaaggatcaaggcagcgagctcctcacggggcgggggcaggctcca

SEQ ID NO: 46849 - DNA, 158 bp, Homo sapiens
  misc_feature 1..158: note = chr22:50015975-50016133
  misc_feature 1..158: note = hypo
  source 1..158: mol_type = genomic DNA
gccctgagaagtgaccgtgctggtaggcgtggtgtaaggctggacactgccggctgacctgctcccgggggcccaggagaccctgcactggccactgggaagagtgggcagcagcagcctccctggaagctggggtggccgggcggtgtgggcagggc

SEQ ID NO: 46850 - DNA, 30 bp, Homo sapiens; identical to SEQ ID NO: 16821
  misc_feature 1..30: note = chr22:50024083-50024113
  misc_feature 1..30: note = hypo
  source 1..30: mol_type = genomic DNA

SEQ ID NO: 46851 - DNA, 30 bp, Homo sapiens
  misc_feature 1..30: note = chr22:50025118-50025148
  misc_feature 1..30: note = hypo
  source 1..30: mol_type = genomic DNA
tgtttcagggcacaccgggtgcaggtgttt

SEQ ID NO: 46852 - DNA, 30 bp, Homo sapiens
  misc_feature 1..30: note = chr22:50025649-50025679
  misc_feature 1..30: note = hypo
  source 1..30: mol_type = genomic DNA
cgggtgcaggtgtttcggggcacacgtgtt

SEQ ID NO: 46853 - DNA, 100 bp, Homo sapiens
  misc_feature 1..100: note = chr22:50031154-50031254
  misc_feature 1..100: note = hypo
  source 1..100: mol_type = genomic DNA
gaggccaggcctggacgccttctcgctgcaggccctcggagatgtttcccagcactgacggtgctgaggacagaacgctggaggccgggccacactcagg

SEQ ID NO: 46854 - DNA, 30 bp, Homo sapiens
  misc_feature 1..30: note = chr22:50031691-50031721
  misc_feature 1..30: note = hypo
  source 1..30: mol_type = genomic DNA
gaacaagccccaggtcgcacaagaaatgca

SEQ ID NO: 46855 - DNA, 46 bp, Homo sapiens
  misc_feature 1..46: note = chr22:50032443-50032489
  misc_feature 1..46: note = hypo
  source 1..46: mol_type = genomic DNA
cgcatctcccgagcacggctcttcgggcggacggagcccccagcag

SEQ ID NO: 46856 - DNA, 30 bp, Homo sapiens
  misc_feature 1..30: note = chr22:50041973-50042003
  misc_feature 1..30: note = hypo
  source 1..30: mol_type = genomic DNA
ttaccgtggccgagccgcagcctggatgca

SEQ ID NO: 46857 - DNA, 34 bp, Homo sapiens
  misc_feature 1..34: note = chr22:50054601-50054635
  misc_feature 1..34: note = hypo
  source 1..34: mol_type = genomic DNA
tgcagctccccatgacgatcgctcctcctctgag

SEQ ID NO: 46858 - DNA, 60 bp, Homo sapiens
  misc_feature 1..60: note = chr22:50119416-50119476
  misc_feature 1..60: note = hypo
  source 1..60: mol_type = genomic DNA
ataacacctgaaaaccggaacccgggtcctggggtcacacgcagccgaagggatgggctg

SEQ ID NO: 46859 - DNA, 171 bp, Homo sapiens
  misc_feature 1..171: note = chr22:50149299-50149470
  misc_feature 1..171: note = hypo
  source 1..171: mol_type = genomic DNA
ccctttccatggcaacgccccataaggtgccacccctttccatggcaacgacccataaggtgccacccctttccatggcaacgccccatacggtgccacccctttccatggcaacgccccatacggtgccacccctttacatggcaacgccccatacggtgccatcccttt

SEQ ID NO: 46860 - DNA, 152 bp, Homo sapiens
  misc_feature 1..152: note = chr22:50170583-50170735
  misc_feature 1..152: note = hypo
  source 1..152: mol_type = genomic DNA
ccatgctccctgagccggagtccagtccccagcagtcgagccctaagacgctaaccaggaggtgtggagagccatggaggcaggtccgggcgactcaccggctgcgatcctggccgccttggcgtagttcccattctcgatgcaggagatca

SEQ ID NO: 46861 - DNA, 65 bp, Homo sapiens
  misc_feature 1..65: note = chr22:50251106-50251171
  misc_feature 1..65: note = hypo
  source 1..65: mol_type = genomic DNA
tgctctggaaggtgccgtttccaagacgcccttacctgggttcctgagcacgtctgacagagcag

SEQ ID NO: 46862 - DNA, 30 bp, Homo sapiens
  misc_feature 1..30: note = chr22:50439060-50439090
  misc_feature 1..30: note = hypo
  source 1..30: mol_type = genomic DNA
actgcccaccccacccggccagctccactt

SEQ ID NO: 46863 - DNA, 155 bp, Homo sapiens
  misc_feature 1..155: note = chr22:50466890-50467045
  misc_feature 1..155: note = hypo
  source 1..155: mol_type = genomic DNA
ctgcaggaggaacttcgcctcccgtggggcaagaggcatctccgtgagtgggtcccagcccctgaatcgcagtgggaatcagggaggcggcaacacctgcgtgccgtcataaagacccccaccatgccctcgtaaagacccccatcacaccgtcc

SEQ ID NO: 46864 - DNA, 30 bp, Homo sapiens
  misc_feature 1..30: note = chr22:50470583-50470613
  misc_feature 1..30: note = hypo
  source 1..30: mol_type = genomic DNA
gagggcacccaaggccggtcctcccagccg

SEQ ID NO: 46865 - DNA, 92 bp, Homo sapiens
  misc_feature 1..92: note = chr22:50507025-50507117
  misc_feature 1..92: note = hypo
  source 1..92: mol_type = genomic DNA
gggagcccaggacagcgggcgtggccagggctgggggggcgggcatggccgggcactcatgggcatagtcccaagctggttccctgcatgac

SEQ ID NO: 46866 - DNA, 30 bp, Homo sapiens
  misc_feature 1..30: note = chr22:50509901-50509931
  misc_feature 1..30: note = hypo
  source 1..30: mol_type = genomic DNA
tgggtccctgttaatcggggagtccctcag

SEQ ID NO: 46867 - DNA, 57 bp, Homo sapiens
  misc_feature 1..57: note = chr22:50512688-50512745
  misc_feature 1..57: note = hypo
  source 1..57: mol_type = genomic DNA
aaactgagtcatccacgttcagggcaatgatccccccgaggacggcagagatgcctg

SEQ ID NO: 46868 - DNA, 30 bp, Homo sapiens
  misc_feature 1..30: note = chr22:50526328-50526358
  misc_feature 1..30: note = hypo
  source 1..30: mol_type = genomic DNA
tctgtgggcatctgccgggtctactgagtc

SEQ ID NO: 46869 - DNA, 75 bp, Homo sapiens
  misc_feature 1..75: note = chr22:50529523-50529598
  misc_feature 1..75: note = hypo
  source 1..75: mol_type = genomic DNA
tcctgctgcaggcagcgtgttcagggcctctggatccacgagggccgatgcccggggggccggctgtgttacctg

SEQ ID NO: 46870 - DNA, 45 bp, Homo sapiens
  misc_feature 1..45: note = chr22:50582635-50582680
  misc_feature 1..45: note = hypo
  source 1..45: mol_type = genomic DNA
catggtccgggtgaacgccacctgcaggttcgaggaggtgagccc

SEQ ID NO: 46871 - DNA, 287 bp, Homo sapiens
  misc_feature 1..287: note = chr22:50686625-50686912
  misc_feature 1..287: note = hypo
  source 1..287: mol_type = genomic DNA
ctgcagcctagcacccggccacactgaccttgctgctggaggctcttccagtgcggggcctgggcagcacgggcactctggatggactctagggcactgtgagggagacacaacagtcgtgacacctggtctcacaccccggccctgcccgccctacctcccctcgcacctctgacatggcgccattggccctgacaggggtggggccgggtcacccagcagcgtctgtactgtcatgcacactgactccgccagtgactccaggtggtagccgccctgggaggagg

SEQ ID NO: 46872 - DNA, 158 bp, Homo sapiens
  misc_feature 1..158: note = chr22:50695362-50695520
  misc_feature 1..158: note = hypo
  source 1..158: mol_type = genomic DNA
ctctgtggatgatgccggcagcgtggatatactgcggggggcagaggatttggcaggcttcagcgcaccctctcagagccacagggccctcctctgcccagccccgaggccctgcctgcctccctgcagcctcccccggggcccgtaccctcagcccc

SEQ ID NO: 46873 - DNA, 30 bp, Homo sapiens
  misc_feature 1..30: note = chr22:50764712-50764742
  misc_feature 1..30: note = hypo
  source 1..30: mol_type = genomic DNA
aggtgaacaaggaggcgctgcagggtttta

SEQ ID NO: 46874 - DNA, 439 bp, Homo sapiens
  misc_feature 1..439: note = chr22:50899269-50899708
  misc_feature 1..439: note = hypo
  source 1..439: mol_type = genomic DNA
tgtatctgtgtcacacgaaggcaagcgcttgtgtaaactcgaaatctcagtggctgtgagctgaggcctgggtttgcaaggcacacccaagacacggacttgagggccggcgccccaaggaaaggacaaggacccaaagaccgcacatcaaacagtggacatcaactcaagagccacagtgagggccccagacatgcaagcgtaacaacagggccactgctggagactggcctaaaaatggttcatacaagaaagaccggtttgcaggagaaagaccagggcgggggatgagagccccacccgcgcaccgcgccccacctggaatgtgcaggagcgcagctggagcccgtcctgcaggagctggtccacaggggtctggacgctgatgcgcttctccttggtcagcgcagccaccgggaaggagcggaccaccacctgc

SEQ ID NO: 46875 - DNA, 50 bp, Homo sapiens
  misc_feature 1..50: note = chr22:50922613-50922663
  misc_feature 1..50: note = hypo
  source 1..50: mol_type = genomic DNA
ggattgccgagtccacgtaactgacctgtactccacgaggccctgtggga

SEQ ID NO: 46876 - DNA, 110 bp, Homo sapiens
  misc_feature 1..110: note = chr22:50943215-50943325
  misc_feature 1..110: note = hypo
  source 1..110: mol_type = genomic DNA
cctgggagggctcaccgtccagtggtggccgtcgtaactgccctccagcaccacctcaggccgtccaccaagcccagtcatgcggcggaagaggccgtaggagttggcca

SEQ ID NO: 46877 - DNA, 96 bp, Homo sapiens
  misc_feature 1..96: note = chr22:50944404-50944500
  misc_feature 1..96: note = hypo
  source 1..96: mol_type = genomic DNA
agcagcgctgaaggccgagccctgtctgcctctctctgacagctgcggccctcacccacctgcgagtagaaagcagccaagcgcaggcgtcgaatg

SEQ ID NO: 46878 - DNA, 69 bp, Homo sapiens
  misc_feature 1..69: note = chr22:50954977-50955046
  misc_feature 1..69: note = hypo
  source 1..69: mol_type = genomic DNA
gtgggccctgcttgacgctggtcttggcattttggtggccagtgggaccacagtcggctctccttctgg

SEQ ID NO: 46879 - DNA, 41 bp, Homo sapiens
  misc_feature 1..41: note = chr22:50977129-50977170
  misc_feature 1..41: note = hypo
  source 1..41: mol_type = genomic DNA
tgctgaactgagaggcgtgcacaagccgtgggaatggatgg

SEQ ID NO: 46880 - DNA, 143 bp, Homo sapiens
  misc_feature 1..143: note = chrX:2836217-2836360
  misc_feature 1..143: note = hypo
  source 1..143: mol_type = genomic DNA
ggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaa

SEQ ID NO: 46881 - DNA, 128 bp, Homo sapiens
  misc_feature 1..128: note = chrX:2931204-2931332
  misc_feature 1..128: note = hypo
  source 1..128: mol_type = genomic DNA
gactcataggtatggcgccggaactctgcccgtggaaacgtgatcctgcagcctctctgtcatcgtgtctaaggtgtttccggggatgttggctttgtgcgcgccagtttgaccgacttctctttgag

SEQ ID NO: 46882 - DNA, 20 bp, Homo sapiens
  misc_feature 1..20: note = chrX:3478216-3478236
  misc_feature 1..20: note = hypo
  source 1..20: mol_type = genomic DNA
agtaacgcagttccccctcc

SEQ ID NO: 46883 - DNA, 47 bp, Homo sapiens
  misc_feature 1..47: note = chrX:3746571-3746618
  misc_feature 1..47: note = hypo
  source 1..47: mol_type = genomic DNA
ctcaccaagcaggagcgggcccctccctcacgcggagccgctggcac

SEQ ID NO: 46884 - DNA, 30 bp, Homo sapiens
  misc_feature 1..30: note = chrX:5757324-5757354
  misc_feature 1..30: note = hypo
  source 1..30: mol_type = genomic DNA
gtgagacaccgtgcccggcaaagattgggc

SEQ ID NO: 46885 - DNA, 30 bp, Homo sapiens
  misc_feature 1..30: note = chrX:11773720-11773750
  misc_feature 1..30: note = hypo
  source 1..30: mol_type = genomic DNA
atgcccgaatacagacgaaactactgtcca

SEQ ID NO: 46886 - DNA, 31 bp, Homo sapiens
  misc_feature 1..31: note = chrX:19435201-19435232
  misc_feature 1..31: note = hypo
  source 1..31: mol_type = genomic DNA
acgaacaactccagtcgacagcccccagcat

SEQ ID NO: 46887 - DNA, 43 bp, Homo sapiens
  misc_feature 1..43: note = chrX:20160928-20160971
  misc_feature 1..43: note = hypo
  source 1..43: mol_type = genomic DNA
cataacgcagtcctttcactcgcccagccgggttgggagcctg

SEQ ID NO: 46888 - DNA, 16 bp, Homo sapiens
  misc_feature 1..16: note = chrX:23714117-23714133
  misc_feature 1..16: note = hypo
  source 1..16: mol_type = genomic DNA
cacaactcagctgggc

SEQ ID NO: 46889 - DNA, 54 bp, Homo sapiens
  misc_feature 1..54: note = chrX:41331697-41331751
  misc_feature 1..54: note = hypo
  source 1..54: mol_type = genomic DNA
aggccgcggaggtaacgatcccgaagggcggctcgggcccgctgcttctgggat

SEQ ID NO: 46890 - DNA, 22 bp, Homo sapiens
  misc_feature 1..22: note = chrX:44136212-44136234
  misc_feature 1..22: note = hypo
  source 1..22: mol_type = genomic DNA
acttacagctgaggccgggcac

SEQ ID NO: 46891 - DNA, 21 bp, Homo sapiens
  misc_feature 1..21: note = chrX:44755607-44755628
  misc_feature 1..21: note = hypo
  source 1..21: mol_type = genomic DNA
tcaccgcgcccggccaaaaat

SEQ ID NO: 46892 - DNA, 52 bp, Homo sapiens
  misc_feature 1..52: note = chrX:44922962-44923014
  misc_feature 1..52: note = hypo
  source 1..52: mol_type = genomic DNA
ttacctgcagcgaaacgcactcactctacctcataaccgcacaaacctgacc

SEQ ID NO: 46893 - DNA, 40 bp, Homo sapiens
  misc_feature 1..40: note = chrX:58297213-58297253
  misc_feature 1..40: note = hypo
  source 1..40: mol_type = genomic DNA
aaagccgtgaccccccggggcctggcgcagaggctgctgg

SEQ ID NO: 46894 - DNA, 30 bp, Homo sapiens
  misc_feature 1..30: note = chrX:58304829-58304859
  misc_feature 1..30: note = hypo
  source 1..30: mol_type = genomic DNA
gagacagggaatccacgacacccccggttc

SEQ ID NO: 46895 - DNA, 32 bp, Homo sapiens
  misc_feature 1..32: note = chrX:78711051-78711083
  misc_feature 1..32: note = hypo
  source 1..32: mol_type = genomic DNA
tcgtgatccgcccgcctcggccttacaaccat

SEQ ID NO: 46896 - DNA, 30 bp, Homo sapiens
  misc_feature 1..30: note = chrX:97101386-97101416
  misc_feature 1..30: note = hypo
  source 1..30: mol_type = genomic DNA
caaggaggacttaggcgcccagggccccat

SEQ ID NO: 46897 - DNA, 128 bp, Homo sapiens
  misc_feature 1..128: note = chrX:97285068-97285196
  misc_feature 1..128: note = hypo
  source 1..128: mol_type = genomic DNA
tgcgggggtggggggcggctaacttcccgctttgctggagttgcaactacttttggtcggatgcctggaaagccagagtatctaaagctcctgagtctctgcgtgcacctgagcggctgctctgccaa

SEQ ID NO: 46898 - DNA, 35 bp, Homo sapiens
  misc_feature 1..35: note = chrX:122924429-122924464
  misc_feature 1..35: note = hypo
  source 1..35: mol_type = genomic DNA
ggattacaggtgtgagtcaccgcacctggccaaga

SEQ ID NO: 46899 - DNA, 30 bp, Homo sapiens
  misc_feature 1..30: note = chrY:14621298-14621328
  misc_feature 1..30: note = hypo
  source 1..30: mol_type = genomic DNA
tcatttgcatatggacgcaaaaggaaaggc

SEQ ID NO: 46900 - DNA, 35 bp, Homo sapiens
  misc_feature 1..35: note = chrY:22918547-22918582
  misc_feature 1..35: note = hypo
  source 1..35: mol_type = genomic DNA
ctgtcctttctcctccgatccggtattacccgtta

SEQ ID NO: 46901 - DNA, 30 bp, Homo sapiens
  misc_feature 1..30: note = chrY:23111758-23111788
  misc_feature 1..30: note = hypo
  source 1..30: mol_type = genomic DNA
ctggtgggagtgatccgattttccatgtgc

SEQ ID NO: 46902 - DNA, 45 bp, Homo sapiens
  misc_feature 1..45: note = AC225595.1_16282-19523:1184-1229
  misc_feature 1..45: note = hypo
  source 1..45: mol_type = genomic DNA
gcagaaggatagtctcggaagacatctgcccggccagatccaagc

SEQ ID NO: 46903 - DNA, 30 bp, Homo sapiens
  misc_feature 1..30: note = AC239873.3_5604-11530:5296-5326
  misc_feature 1..30: note = hypo
  source 1..30: mol_type = genomic DNA
gaggcagagggagagcgcccgcctgaaacc

SEQ ID NO: 46904 - DNA, 30 bp, Homo sapiens; identical to SEQ ID NO: 16832
  misc_feature 1..30: note = AEKP01139090.1_11256-14570:719-749
  misc_feature 1..30: note = hypo
  source 1..30: mol_type = genomic DNA

SEQ ID NO: 46905 - DNA, 41 bp, Homo sapiens
  misc_feature 1..41: note = AEKP01149800.1_88-7643:5268-5309
  misc_feature 1..41: note = hypo
  source 1..41: mol_type = genomic DNA
gtggagggttgtgagcggctgtcagactgggtgtgagtggg

SEQ ID NO: 46906 - DNA, 86 bp, Homo sapiens; identical to SEQ ID NO: 16833
  misc_feature 1..86: note = AEKP01153556.1_1-5252:404-490
  misc_feature 1..86: note = hypo
  source 1..86: mol_type = genomic DNA

SEQ ID NO: 46907 - DNA, 30 bp, Homo sapiens
  misc_feature 1..30: note = AEKP01166227.1_44013-111583:24167-24197
  misc_feature 1..30: note = hypo
  source 1..30: mol_type = genomic DNA
acctagactgttgaccgaggacctgaaaga

SEQ ID NO: 46908 - DNA, 58 bp, Homo sapiens
  misc_feature 1..58: note = AEKP01188815.1_1-4777:2612-2670
  misc_feature 1..58: note = hypo
  source 1..58: mol_type = genomic DNA
tgcgggtgcggaaggcgcctgcagaagaggcgcttcttgtttccgctccgtcctccca

SEQ ID NO: 46909 - DNA, 151 bp, Homo sapiens
  misc_feature 1..151: note = AEKP01196136.1_22995-25251:459-610
  misc_feature 1..151: note = hypo
  source 1..151: mol_type = genomic DNA
tgctggaagagtcaacggcgtttttaaagaggcagggcaacgcgcactacagtgagggatcttacaggcctgtttttgagggaaaatggtaagtgagctacagcgagcacacgtgtgtagatcccagttacaggtccgtcaagatggctag

SEQ ID NO: 46910 - DNA, 30 bp, Homo sapiens
  misc_feature 1..30: note = AEKP01229474.1_1-1021:874-904
  misc_feature 1..30: note = hypo
  source 1..30: mol_type = genomic DNA
tgctgcgtcagctggcgtgacctctcattc

SEQ ID NO: 46911 - DNA, 22 bp, Homo sapiens
  misc_feature 1..22: note = CR936360.14_69981-85448:11336-11358
  misc_feature 1..22: note = hypo
  source 1..22: mol_type = genomic DNA
ctagtttgagccagccggccgc

SEQ ID NO: 46912 - DNA, 30 bp, Homo sapiens
  misc_feature 1..30: note = FP565324.3_2001-29640:15187-15217
  misc_feature 1..30: note = hypo
  source 1..30: mol_type = genomic DNA
aggtggccagtggcacggacacaggtgttt

SEQ ID NO: 46913 - DNA, 47 bp, Homo sapiens
  misc_feature 1..47: note = FP565324.3_2001-29640:19686-19733
  misc_feature 1..47: note = hypo
  source 1..47: mol_type = genomic DNA
cggcaagtaggtggccggatcgccctccgtcccgcctcctgtgcccc

SEQ ID NO: 46914 - DNA, 18 bp, Homo sapiens
  misc_feature 1..18: note = JH636052.4:2022610-2022628
  misc_feature 1..18: note = hypo
  source 1..18: mol_type = genomic DNA
aacaataaaacaggccgg

SEQ ID NO: 46915 - DNA, 61 bp, Homo sapiens
  misc_feature 1..61: note = NW_001838014.1_249000-295694:3702-3763
  misc_feature 1..61: note = hypo
  source 1..61: mol_type = genomic DNA
cgaagcgggcagcgccgccaagcatccctgtgtgtacggccgcccgcgcttcccttcccca

SEQ ID NO: 46916 - DNA, 42 bp, Homo sapiens
  misc_feature 1..42: note = NW_001838014.1_249000-295694:4094-4136
  misc_feature 1..42: note = hypo
  source 1..42: mol_type = genomic DNA
agccagagccagagccgtgcggagacacggagccggccgaag

SEQ ID NO: 46917 - DNA, 60 bp, Homo sapiens
  misc_feature 1..60: note = NW_001838014.1_249000-295694:7207-7267
  misc_feature 1..60: note = hypo
  source 1..60: mol_type = genomic DNA
atgctcccgcacgcacgaggttccccagcgctctgggtctcaggccgccggagaggagta

SEQ ID NO: 46918 - DNA, 311 bp, Homo sapiens
  misc_feature 1..311: note = NW_001838014.1_249000-295694:13512-13823
  misc_feature 1..311: note = hypo
  source 1..311: mol_type = genomic DNA
ggcccctcggcagtgcggcccctcagcagtggggccaaagcgccattgccggcagccggtcgggaggagggtgaaagagaaatcctggctgcacacagaaggcaccaactgtttgctcatcgcagagcagggcagtggtgcccaggagggcggggcatcggatactgaaacacgagcaggtttccggcatcgagactggggctggagacttcaggaaacctcattttcttccccaaacatccacccttttctttaaagtaggccaaaggcctccgtttcacgctgtgtgagccaggcgtgtcaagccacag

SEQ ID NO: 46919 - DNA, 84 bp, Homo sapiens
  misc_feature 1..84: note = NW_001838056.1_145425-224902:42711-42795
  misc_feature 1..84: note = hypo
  source 1..84: mol_type = genomic DNA
ccacactgctttccccggactgtctgctgtttctgcatcctggtagcccctccgtgtagcatagtgtcccgaatctgttttgtc

SEQ ID NO: 46920 - DNA, 30 bp, Homo sapiens
  misc_feature 1..30: note = NW_001839407.1_42766-49957:1184-1214
  misc_feature 1..30: note = hypo
  source 1..30: mol_type = genomic DNA
ccaccatcgccggcccgctggtgcctctgc

SEQ ID NO: 46921 - DNA, 23 bp, Homo sapiens
  misc_feature 1..23: note = NW_001839609.1_1-3470:1139-1162
  misc_feature 1..23: note = hypo
  source 1..23: mol_type = genomic DNA
caaagcgaggcactgcgagcctg

SEQ ID NO: 46922 - DNA, 90 bp, Homo sapiens
  misc_feature 1..90: note = NW_001839760.1_243903-260476:6752-6842
  misc_feature 1..90: note = hypo
  source 1..90: mol_type = genomic DNA
ttgaatcatattaaccggaaaggaatgtactggaatagaatggactcgaatgtaatggataaaaaagtaattgatttgaatgccttggaa

SEQ ID NO: 46923 - DNA, 22 bp, Homo sapiens
  misc_feature 1..22: note = NW_001840754.1_117-3691:2515-2537
  misc_feature 1..22: note = hypo
  source 1..22: mol_type = genomic DNA
gggctaccgcagggagggtgcc

SEQ ID NO: 46924 - DNA, 30 bp, Homo sapiens
  misc_feature 1..30: note = NW_001840841.1_1-4205:1669-1699
  misc_feature 1..30: note = hypo
  source 1..30: mol_type = genomic DNA
ccgtgaaattccagccgggactccctgagt

SEQ ID NO: 46925 - DNA, 43 bp, Homo sapiens
  misc_feature 1..43: note = NW_001841011.1_96346-168555:37241-37284
  misc_feature 1..43: note = hypo
  source 1..43: mol_type = genomic DNA
tgcacatgtgtgaggcgcgagcggcttctcccgtcccagtgct

SEQ ID NO: 46926 - DNA, 140 bp, Homo sapiens
  misc_feature 1..140: note = NW_001841051.1_40144-46142:4777-4917
  misc_feature 1..140: note = hypo
  source 1..140: mol_type = genomic DNA
gcttgctgcgtctcccgggtcagggctgagattcacgctggagttgcctcagctggtgtgacctctcattctgaaacgaaatctgtacccttggctacggaatgccaaaggcctgggcgagccgttctctggtggtgatg

SEQ ID NO: 46927 - DNA, 46 bp, Homo sapiens
  misc_feature 1..46: note = NW_001841110.1_111-11841:9069-9115
  misc_feature 1..46: note = hypo
  source 1..46: mol_type = genomic DNA
agggaacggctgacacgggccattgtcattccggagagcagagtcc

SEQ ID NO: 46928 - DNA, 55 bp, Homo sapiens
  misc_feature 1..55: note = NW_001841145.1_177495-186900:5222-5277
  misc_feature 1..55: note = hypo
  source 1..55: mol_type = genomic DNA
atcaacctgctccctcgtgggtcgactttgcccacaccggcgcctggggaacagt

SEQ ID NO: 46929 - DNA, 69 bp, Homo sapiens
  misc_feature 1..69: note = NW_001842432.1_1-179261:101291-101360
  misc_feature 1..69: note = hypo
  source 1..69: mol_type = genomic DNA
tcaggacaagatgaccgagctagagtactcgccccaggaaatgcaggtccagagcgggtcacctcctta

SEQ ID NO: 46930 - DNA, 282 bp, Homo sapiens; identical to SEQ ID NO: 25985
  misc_feature 1..282: note = chr1:840722-841004
  misc_feature 1..282: note = hyper
  source 1..282: mol_type = genomic DNA

SEQ ID NO: 46931 - DNA, 49 bp, Homo sapiens; identical to SEQ ID NO: 25986
  misc_feature 1..49: note = chr1:975817-975866
  misc_feature 1..49: note = hyper
  source 1..49: mol_type = genomic DNA

SEQ ID NO: 46932 - DNA, 30 bp, Homo sapiens; identical to SEQ ID NO: 25987
  misc_feature 1..30: note = chr1:1355593-1355623
  misc_feature 1..30: note = hyper
  source 1..30: mol_type = genomic DNA

SEQ ID NO: 46933 - DNA, 19 bp, Homo sapiens
  misc_feature 1..19: note = chr1:1475537-1475556
  misc_feature 1..19: note = hyper
  source 1..19: mol_type = genomic DNA
ggccggggaggggagcgca

SEQ ID NO: 46934 - DNA, 187 bp, Homo sapiens; identical to SEQ ID NO: 25990
  misc_feature 1..187: note = chr1:1535001-1535188
  misc_feature 1..187: note = hyper
  source 1..187: mol_type = genomic DNA

SEQ ID NO: 46935 - DNA, 135 bp, Homo sapiens; identical to SEQ ID NO: 25991
  misc_feature 1..135: note = chr1:1535782-1535917
  misc_feature 1..135: note = hyper
  source 1..135: mol_type = genomic DNA

SEQ ID NO: 46936 - DNA, 39 bp, Homo sapiens; identical to SEQ ID NO: 25992
  misc_feature 1..39: note = chr1:1567286-1567325
  misc_feature 1..39: note = hyper
  source 1..39: mol_type = genomic DNA

SEQ ID NO: 46937 - DNA, 132 bp, Homo sapiens; identical to SEQ ID NO: 25993
  misc_feature 1..132: note = chr1:1567781-1567913
  misc_feature 1..132: note = hyper
  source 1..132: mol_type = genomic DNA

SEQ ID NO: 46938 - DNA, 95 bp, Homo sapiens
  misc_feature 1..95: note = chr1:1935459-1935554
  misc_feature 1..95: note = hyper
  source 1..95: mol_type = genomic DNA
agacagccaggcctggcccagggccaaggcttggaggtgacagacagacttggggggcctggaggagctcagcaccggcgcgttggcccagagga

SEQ ID NO: 46939 - DNA, 779 bp, Homo sapiens; identical to SEQ ID NO: 25995
  misc_feature 1..779: note = chr1:1950582-1951361
  misc_feature 1..779: note = hyper
  source 1..779: mol_type = genomic DNA

SEQ ID NO: 46940 - DNA, 44 bp, Homo sapiens; identical to SEQ ID NO: 25996
  misc_feature 1..44: note = chr1:2136044-2136088
  misc_feature 1..44: note = hyper
  source 1..44: mol_type = genomic DNA

SEQ ID NO: 46941 - DNA, 146 bp, Homo sapiens; identical to SEQ ID NO: 25997
  misc_feature 1..146: note = chr1:2136893-2137039
  misc_feature 1..146: note = hyper
  source 1..146: mol_type = genomic DNA

SEQ ID NO: 46942 - DNA, 198 bp, Homo sapiens
  misc_feature 1..198: note = chr1:2374950-2375148
  misc_feature 1..198: note = hyper
  source 1..198: mol_type = genomic DNA
gggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgg

SEQ ID NO: 46943 - DNA, 82 bp, Homo sapiens
  misc_feature 1..82: note = chr1:2375543-2375625
  misc_feature 1..82: note = hyper
  source 1..82: mol_type = genomic DNA
cggtggcacgggcaggggtgcgggcgcgggactgtgggcgggacgggcggagcggtcttgagctctccggatggcctcaggt

SEQ ID NO: 46944 - DNA, 482 bp, Homo sapiens; identical to SEQ ID NO: 26000
  misc_feature 1..482: note = chr1:2560443-2560925
  misc_feature 1..482: note = hyper
  source 1..482: mol_type = genomic DNA

SEQ ID NO: 46945 - DNA, 40 bp, Homo sapiens
  misc_feature 1..40: note = chr1:2984749-2984789
  misc_feature 1..40: note = hyper
  source 1..40: mol_type = genomic DNA
ggcccagctcgggcgctcgcgcagccgggtactcaccttg

SEQ ID NO: 46946 - DNA, 288 bp, Homo sapiens; identical to SEQ ID NO: 26003
  misc_feature 1..288: note = chr1:2985115-2985403
  misc_feature 1..288: note = hyper
  source 1..288: mol_type = genomic DNA

SEQ ID NO: 46947 - DNA, 82 bp, Homo sapiens; identical to SEQ ID NO: 26004
  misc_feature 1..82: note = chr1:2986416-2986498
  misc_feature 1..82: note = hyper
  source 1..82: mol_type = genomic DNA

SEQ ID NO: 46948 - DNA, 165 bp, Homo sapiens; identical to SEQ ID NO: 26005
  misc_feature 1..165: note = chr1:2987055-2987220
  misc_feature 1..165: note = hyper
  source 1..165: mol_type = genomic DNA

SEQ ID NO: 46949 - DNA, 44 bp, Homo sapiens; identical to SEQ ID NO: 26006
  misc_feature 1..44: note = chr1:2987457-2987501
  misc_feature 1..44: note = hyper
  source 1..44: mol_type = genomic DNA

SEQ ID NO: 46950 - DNA, 102 bp, Homo sapiens; identical to SEQ ID NO: 26007
  misc_feature 1..102: note = chr1:3087621-3087723
  misc_feature 1..102: note = hyper
  source 1..102: mol_type = genomic DNA

SEQ ID NO: 46951 - DNA, 192 bp, Homo sapiens; identical to SEQ ID NO: 26008
  misc_feature 1..192: note = chr1:3310353-3310545
  misc_feature 1..192: note = hyper
  source 1..192: mol_type = genomic DNA

SEQ ID NO: 46952 - DNA, 232 bp, Homo sapiens
  misc_feature 1..232: note = chr1:3568226-3568458
  misc_feature 1..232: note = hyper
  source 1..232: mol_type = genomic DNA
caagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacagga

SEQ ID NO: 46953 - DNA, 45 bp, Homo sapiens; identical to SEQ ID NO: 26012
  misc_feature 1..45: note = chr1:3663242-3663287
  misc_feature 1..45: note = hyper
  source 1..45: mol_type = genomic DNA

SEQ ID NO: 46954 - DNA, 288 bp, Homo sapiens
  misc_feature 1..288: note = chr1:3663586-3663874
  misc_feature 1..288: note = hyper
  source 1..288: mol_type = genomic DNA
ggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccat

SEQ ID NO: 46955 - DNA, 54 bp, Homo sapiens
  misc_feature 1..54: note = chr1:3663921-3663975
  misc_feature 1..54: note = hyper
  source 1..54: mol_type = genomic DNA
gagatcccgcaacaacccggatccggaagcgcggggtcgcggctgggcgagggc

SEQ ID NO: 46956 - DNA, 152 bp, Homo sapiens; identical to SEQ ID NO: 5289
  misc_feature 1..152: note = chr1:4712671-4712823
  misc_feature 1..152: note = hyper
  source 1..152: mol_type = genomic DNA

SEQ ID NO: 46957 - DNA, 184 bp, Homo sapiens; identical to SEQ ID NO: 26020
  misc_feature 1..184: note = chr1:6208628-6208812
  misc_feature 1..184: note = hyper
  source 1..184: mol_type = genomic DNA

SEQ ID NO: 46958 - DNA, 30 bp, Homo sapiens; identical to SEQ ID NO: 26021
  misc_feature 1..30: note = chr1:6221982-6222012
  misc_feature 1..30: note = hyper
  source 1..30: mol_type = genomic DNA

SEQ ID NO: 46959 - DNA, 507 bp, Homo sapiens; identical to SEQ ID NO: 26022
  misc_feature 1..507: note = chr1:6239505-6240012
  misc_feature 1..507: note = hyper
  source 1..507: mol_type = genomic DNA

SEQ ID NO: 46960 - DNA, 427 bp, Homo sapiens; identical to SEQ ID NO: 26023
  misc_feature 1..427: note = chr1:6240281-6240708
  misc_feature 1..427: note = hyper
  source 1..427: mol_type = genomic DNA

SEQ ID NO: 46961 - DNA, 280 bp, Homo sapiens; identical to SEQ ID NO: 26024
  misc_feature 1..280: note = chr1:6240931-6241211
  misc_feature 1..280: note = hyper
  source 1..280: mol_type = genomic DNA

SEQ ID NO: 46962 - DNA, 30 bp, Homo sapiens; identical to SEQ ID NO: 26025
  misc_feature 1..30: note = chr1:6266556-6266586
  misc_feature 1..30: note = hyper
  source 1..30: mol_type = genomic DNA

SEQ ID NO: 46963 - DNA, 262 bp, Homo sapiens; identical to SEQ ID NO: 26026
  misc_feature 1..262: note = chr1:6301710-6301972
  misc_feature 1..262: note = hyper
  source 1..262: mol_type = genomic DNA

SEQ ID NO: 46964 - DNA, 83 bp, Homo sapiens; identical to SEQ ID NO: 16857
  misc_feature 1..83: note = chr1:6304118-6304201
  misc_feature 1..83: note = hyper
  source 1..83: mol_type = genomic DNA

SEQ ID NO: 46965 - DNA, 68 bp, Homo sapiens; identical to SEQ ID NO: 16858
  misc_feature 1..68: note = chr1:6304242-6304310
  misc_feature 1..68: note = hyper
  source 1..68: mol_type = genomic DNA

SEQ ID NO: 46966 - DNA, 71 bp, Homo sapiens; identical to SEQ ID NO: 26028
  misc_feature 1..71: note = chr1:6304595-6304666
  misc_feature 1..71: note = hyper
  source 1..71: mol_type = genomic DNA

SEQ ID NO: 46967 - DNA, 775 bp, Homo sapiens; identical to SEQ ID NO: 26029
  misc_feature 1..775: note = chr1:6309246-6310021
  misc_feature 1..775: note = hyper
  source 1..775: mol_type = genomic DNA

SEQ ID NO: 46968 - DNA, 189 bp, Homo sapiens
  misc_feature 1..189: note = chr1:6480325-6480514
  misc_feature 1..189: note = hyper
  source 1..189: mol_type = genomic DNA
caggctcgggttcagcgtcttctctgagccccgccctgggccgcagcaggggacccagcggttacgggagctcccatgagggacagcagcgggagggacttgcacccccagctgctttatcgggtgaagggctgagctggacgggaaatccgagttccggagaaaggtcgtgacttgctccagtcctcg

SEQ ID NO: 46969 - DNA, 120 bp, Homo sapiens
  misc_feature 1..120: note = chr1:6480831-6480951
  misc_feature 1..120: note = hyper
  source 1..120: mol_type = genomic DNA
gctgcggcaaactggctggcgtcccccgcccatctgctccgggctcccctcccccgaccggctggcggggcaacggccacgcccgcgaaccacactgcgaactgccgggcagagagatga

SEQ ID NO: 46970 - DNA, 16 bp, Homo sapiens
  misc_feature 1..16: note = chr1:6484964-6484980
  misc_feature 1..16: note = hyper
  source 1..16: mol_type = genomic DNA
gcgtcctggggaaggc

SEQ ID NO: 46971 - DNA, 288 bp, Homo sapiens; identical to SEQ ID NO: 26032
  misc_feature 1..288: note = chr1:6484981-6485269
  misc_feature 1..288: note = hyper
  source 1..288: mol_type = genomic DNA

SEQ ID NO: 46972 - DNA, 48 bp, Homo sapiens; identical to SEQ ID NO: 26033
  misc_feature 1..48: note = chr1:6500940-6500988
  misc_feature 1..48: note = hyper
  source 1..48: mol_type = genomic DNA

SEQ ID NO: 46973 - DNA, 73 bp, Homo sapiens; identical to SEQ ID NO: 26035
  misc_feature 1..73: note = chr1:6507490-6507563
  misc_feature 1..73: note = hyper
  source 1..73: mol_type = genomic DNA

SEQ ID NO: 46974 - DNA, 987 bp, Homo sapiens
  misc_feature 1..987: note = chr1:6508126-6509113
  misc_feature 1..987: note = hyper
  source 1..987: mol_type = genomic DNA
ctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccc

SEQ ID NO: 46975 - DNA, 46 bp, Homo sapiens; identical to SEQ ID NO: 26037
  misc_feature 1..46: note = chr1:6545397-6545443
  misc_feature 1..46: note = hyper
  source 1..46: mol_type = genomic DNA

SEQ ID NO: 46976 - DNA, 171 bp, Homo sapiens; identical to SEQ ID NO: 26038
  misc_feature 1..171: note = chr1:6663729-6663900
  misc_feature 1..171: note = hyper
  source 1..171: mol_type = genomic DNA

SEQ ID NO: 46977 - DNA, 80 bp, Homo sapiens; identical to SEQ ID NO: 26039
  misc_feature 1..80: note = chr1:7023766-7023846
  misc_feature 1..80: note = hyper
  source 1..80: mol_type = genomic DNA

SEQ ID NO: 46978 - DNA, 30 bp, Homo sapiens; identical to SEQ ID NO: 26040
  misc_feature 1..30: note = chr1:7130249-7130279
  misc_feature 1..30: note = hyper
  source 1..30: mol_type = genomic DNA

SEQ ID NO: 46979 - DNA, 52 bp, Homo sapiens; identical to SEQ ID NO: 26041
  misc_feature 1..52: note = chr1:7764556-7764608
  misc_feature 1..52: note = hyper
  source 1..52: mol_type = genomic DNA

SEQ ID NO: 46980 - DNA, 85 bp, Homo sapiens; identical to SEQ ID NO: 26042
  misc_feature 1..85: note = chr1:7765187-7765272
  misc_feature 1..85: note = hyper
  source 1..85: mol_type = genomic DNA

SEQ ID NO: 46981 - DNA, 329 bp, Homo sapiens; identical to SEQ ID NO: 26043
  misc_feature 1..329: note = chr1:8002422-8002751
  misc_feature 1..329: note = hyper
  source 1..329: mol_type = genomic DNA

SEQ ID NO: 46982 - DNA, 30 bp, Homo sapiens; identical to SEQ ID NO: 9
  misc_feature 1..30: note = chr1:8277113-8277143
  misc_feature 1..30: note = hyper
  source 1..30: mol_type = genomic DNA

SEQ ID NO: 46983 - DNA, 60 bp, Homo sapiens; identical to SEQ ID NO: 26045
  misc_feature 1..60: note = chr1:8277775-8277835
  misc_feature 1..60: note = hyper
  source 1..60: mol_type = genomic DNA

SEQ ID NO: 46984 - DNA, 94 bp, Homo sapiens; identical to SEQ ID NO: 26046
  misc_feature 1..94: note = chr1:9243226-9243320
  misc_feature 1..94: note = hyper
  source 1..94: mol_type = genomic DNA

SEQ ID NO: 46985 - DNA, 426 bp, Homo sapiens
  misc_feature 1..426: note = chr1:9712135-9712561
  misc_feature 1..426: note = hyper
  source 1..426: mol_type = genomic DNA
ccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagat

SEQ ID NO: 46986 - DNA, 201 bp, Homo sapiens; identical to SEQ ID NO: 26048
  misc_feature 1..201: note = chr1:10057409-10057610
  misc_feature 1..201: note = hyper
  source 1..201: mol_type = genomic DNA

SEQ ID NO: 46987 - DNA, 23 bp, Homo sapiens
  misc_feature 1..23: note = chr1:10948529-10948552
  misc_feature 1..23: note = hyper
  source 1..23: mol_type = genomic DNA
cccgggtctcccaggcgagaggg

SEQ ID NO: 46988 - DNA, 38 bp, Homo sapiens; identical to SEQ ID NO: 16870
  misc_feature 1..38: note = chr1:10948582-10948620
  misc_feature 1..38: note = hyper
  source 1..38: mol_type = genomic DNA

SEQ ID NO: 46989 - DNA, 30 bp, Homo sapiens; identical to SEQ ID NO: 26050
  misc_feature 1..30: note = chr1:10948841-10948871
  misc_feature 1..30: note = hyper
  source 1..30: mol_type = genomic DNA

SEQ ID NO: 46990 - DNA, 235 bp, Homo sapiens
  misc_feature 1..235: note = chr1:11538940-11539175
  misc_feature 1..235: note = hyper
  source 1..235: mol_type = genomic DNA
gccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgg

SEQ ID NO: 46991 - DNA, 205 bp, Homo sapiens
  misc_feature 1..205: note = chr1:11539205-11539410
  misc_feature 1..205: note = hyper
  source 1..205: mol_type = genomic DNA
gtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctag

SEQ ID NO: 46992 - DNA, 556 bp, Homo sapiens
  misc_feature 1..556: note = chr1:11539440-11539996
  misc_feature 1..556: note = hyper
  source 1..556: mol_type = genomic DNA
gccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccag

SEQ ID NO: 46993 - DNA, 90 bp, Homo sapiens
  misc_feature 1..90: note = chr1:11540039-11540129
  misc_feature 1..90: note = hyper
  source 1..90: mol_type = genomic DNA
cgcgaacgagggtggaggtggagtgggcagccgggcagtggcggcgctgagggtcgggaaagattcccagcgcaaggggcgccaagtccc

SEQ ID NO: 46994 - DNA, 30 bp, Homo sapiens; identical to SEQ ID NO: 26053
  misc_feature 1..30: note = chr1:11611023-11611053
  misc_feature 1..30: note = hyper
  source 1..30: mol_type = genomic DNA

SEQ ID NO: 46995 - DNA, 61 bp, Homo sapiens; identical to SEQ ID NO: 26054
  misc_feature 1..61: note = chr1:11751330-11751391
  misc_feature 1..61: note = hyper
  source 1..61: mol_type = genomic DNA

SEQ ID NO: 46996 - DNA, 12 bp, Homo sapiens
  misc_feature 1..12: note = chr1:11752464-11752476
  misc_feature 1..12: note = hyper
  source 1..12: mol_type = genomic DNA
gcccggaaccag

SEQ ID NO: 46997 - DNA, 125 bp, Homo sapiens
  misc_feature 1..125: note = chr1:11752511-11752636
  misc_feature 1..125: note = hyper
  source 1..125: mol_type = genomic DNA
caggaaggtactcagcctggctcccccgacggcgctggtctttcgcctgtggtctcccgctctgtccctcctgctccccaccgccggcttttggcttttctccgtccgctcgtcaagggtctcag

SEQ ID NO: 46998 - DNA, 109 bp, Homo sapiens; identical to SEQ ID NO: 26056
  misc_feature 1..109: note = chr1:11919143-11919252
  misc_feature 1..109: note = hyper
  source 1..109: mol_type = genomic DNA

SEQ ID NO: 46999 - DNA, 19 bp, Homo sapiens
  misc_feature 1..19: note = chr1:11959074-11959093
  misc_feature 1..19: note = hyper
  source 1..19: mol_type = genomic DNA
ggacccacctggatccgag

SEQ ID NO: 47000 - DNA, 42 bp, Homo sapiens; identical to SEQ ID NO: 16874
  misc_feature 1..42: note = chr1:11959196-11959238
  misc_feature 1..42: note = hyper
  source 1..42: mol_type = genomic DNA

SEQ ID NO: 47001 - DNA, 121 bp, Homo sapiens
  misc_feature 1..121: note = chr1:12123122-12123243
  misc_feature 1..121: note = hyper
  source 1..121: mol_type = genomic DNA
ctactcacatttcaccgtttcttggggcaggagtggaggtgggggcattggaacccccttggggcctcctaatatcctgtgagtccccacctccagggccagaagctgcctgcctccgctc

SEQ ID NO: 47002 - DNA, 145 bp, Homo sapiens; identical to SEQ ID NO: 26059
  misc_feature 1..145: note = chr1:12123787-12123932
  misc_feature 1..145: note = hyper
  source 1..145: mol_type = genomic DNA

SEQ ID NO: 47003 - DNA, 309 bp, Homo sapiens; identical to SEQ ID NO: 26060
  misc_feature 1..309: note = chr1:13839460-13839769
  misc_feature 1..309: note = hyper
  source 1..309: mol_type = genomic DNA

SEQ ID NO: 47004 - DNA, 177 bp, Homo sapiens; identical to SEQ ID NO: 26061
  misc_feature 1..177: note = chr1:13840521-13840698
  misc_feature 1..177: note = hyper
  source 1..177: mol_type = genomic DNA

SEQ ID NO: 47005 - DNA, 106 bp, Homo sapiens; identical to SEQ ID NO: 16877
  misc_feature 1..106: note = chr1:13910330-13910436
  misc_feature 1..106: note = hyper
  source 1..106: mol_type = genomic DNA

SEQ ID NO: 47006 - DNA, 88 bp, Homo sapiens; identical to SEQ ID NO: 26065
  misc_feature 1..88: note = chr1:14027035-14027123
  misc_feature 1..88: note = hyper
  source 1..88: mol_type = genomic DNA

SEQ ID NO: 47007 - DNA, 30 bp, Homo sapiens; identical to SEQ ID NO: 26066
  misc_feature 1..30: note = chr1:14219099-14219129
  misc_feature 1..30: note = hyper
  source 1..30: mol_type = genomic DNA

SEQ ID NO: 47008 - DNA, 339 bp, Homo sapiens; identical to SEQ ID NO: 26067
  misc_feature 1..339: note = chr1:14219335-14219674
  misc_feature 1..339: note = hyper
  source 1..339: mol_type = genomic DNA

SEQ ID NO: 47009 - DNA, 679 bp, Homo sapiens; identical to SEQ ID NO: 26068
  misc_feature 1..679: note = chr1:14924519-14925198
  misc_feature 1..679: note = hyper
  source 1..679: mol_type = genomic DNA

SEQ ID NO: 47010 - DNA, 302 bp, Homo sapiens; identical to SEQ ID NO: 16881
  misc_feature 1..302: note = chr1:14925199-14925501
  misc_feature 1..302: note = hyper
  source 1..302: mol_type = genomic DNA

SEQ ID NO: 47011 - DNA, 18 bp, Homo sapiens
  misc_feature 1..18: note = chr1:14926050-14926068
  misc_feature 1..18: note = hyper
  source 1..18: mol_type = genomic DNA
tgccggggccttttcccc

SEQ ID NO: 47012 - DNA, 35 bp, Homo sapiens; identical to SEQ ID NO: 26070
  misc_feature 1..35: note = chr1:15251220-15251255
  misc_feature 1..35: note = hyper
  source 1..35: mol_type = genomic DNA

SEQ ID NO: 47013 - DNA, 81 bp, Homo sapiens; identical to SEQ ID NO: 26071
  misc_feature 1..81: note = chr1:15251499-15251580
  misc_feature 1..81: note = hyper
  source 1..81: mol_type = genomic DNA

SEQ ID NO: 47014 - DNA, 48 bp, Homo sapiens; identical to SEQ ID NO: 26072
  misc_feature 1..48: note = chr1:15479729-15479777
  misc_feature 1..48: note = hyper
  source 1..48: mol_type = genomic DNA

SEQ ID NO: 47015 - DNA, 156 bp, Homo sapiens; identical to SEQ ID NO: 26073
  misc_feature 1..156: note = chr1:15573605-15573761
  misc_feature 1..156: note = hyper
  source 1..156: mol_type = genomic DNA

SEQ ID NO: 47016 - DNA, 336 bp, Homo sapiens; identical to SEQ ID NO: 26074
  misc_feature 1..336: note = chr1:15930022-15930358
  misc_feature 1..336: note = hyper
  source 1..336: mol_type = genomic DNA

SEQ ID NO: 47017 - DNA, 30 bp, Homo sapiens; identical to SEQ ID NO: 26075
  misc_feature 1..30: note = chr1:16375412-16375442
  misc_feature 1..30: note = hyper
  source 1..30: mol_type = genomic DNA

SEQ ID NO: 47018 - DNA, 34 bp, Homo sapiens; identical to SEQ ID NO: 26076
  misc_feature 1..34: note = chr1:16533298-16533332
  misc_feature 1..34: note = hyper
  source 1..34: mol_type = genomic DNA

SEQ ID NO: 47019 - DNA, 51 bp, Homo sapiens; identical to SEQ ID NO: 26077
  misc_feature 1..51: note = chr1:16542965-16543016
  misc_feature 1..51: note = hyper
  source 1..51: mol_type = genomic DNA

SEQ ID NO: 47020 - DNA, 88 bp, Homo sapiens; identical to SEQ ID NO: 26078
  misc_feature 1..88: note = chr1:16553585-16553673
  misc_feature 1..88: note = hyper
  source 1..88: mol_type = genomic DNA

SEQ ID NO: 47021 - DNA, 54 bp, Homo sapiens
  misc_feature 1..54: note = chr1:16861468-16861522
  misc_feature 1..54: note = hyper
  source 1..54: mol_type = genomic DNA
tctccggggtggcgacgggaaagaaggtgggcttattgggtgcagctccacggg

SEQ ID NO: 47022 - DNA, 190 bp, Homo sapiens
  misc_feature 1..190: note = chr1:16861552-16861742
  misc_feature 1..190: note = hyper
  source 1..190: mol_type = genomic DNA
tgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaaga

SEQ ID NO: 47023 - DNA, 30 bp, Homo sapiens; identical to SEQ ID NO: 26080
  misc_feature 1..30: note = chr1:17033955-17033985
  misc_feature 1..30: note = hyper
  source 1..30: mol_type = genomic DNA

SEQ ID NO: 47024 - DNA, 138 bp, Homo sapiens; identical to SEQ ID NO: 26081
  misc_feature 1..138: note = chr1:18152717-18152855
  misc_feature 1..138: note = hyper
  source 1..138: mol_type = genomic DNA

SEQ ID NO: 47025 - DNA, 65 bp, Homo sapiens; identical to SEQ ID NO: 26082
  misc_feature 1..65: note = chr1:18434751-18434816
  misc_feature 1..65: note = hyper
  source 1..65: mol_type = genomic DNA

SEQ ID NO: 47026 - DNA, 33 bp, Homo sapiens; identical to SEQ ID NO: 26083
  misc_feature 1..33: note = chr1:18435496-18435529
  misc_feature 1..33: note = hyper
  source 1..33: mol_type = genomic DNA

SEQ ID NO: 47027 - DNA, 507 bp, Homo sapiens; identical to SEQ ID NO: 26084
  misc_feature 1..507: note = chr1:18436492-18436999
  misc_feature 1..507: note = hyper
  source 1..507: mol_type = genomic DNA

SEQ ID NO: 47028 - DNA, 388 bp, Homo sapiens; identical to SEQ ID NO: 26085
  misc_feature 1..388: note = chr1:18437043-18437431
  misc_feature 1..388: note = hyper
  source 1..388: mol_type = genomic DNA

SEQ ID NO: 47029 - DNA, 25 bp, Homo sapiens
  misc_feature 1..25: note = chr1:18437432-18437457
  misc_feature 1..25: note = hyper
  source 1..25: mol_type = genomic DNA
ggggtctccgggattgcgcgggcgg

SEQ ID NO: 47030 - DNA, 291 bp, Homo sapiens
  misc_feature 1..291: note = chr1:18437526-18437817
  misc_feature 1..291: note = hyper
  source 1..291: mol_type = genomic DNA
atgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatggg

SEQ ID NO: 47031 - DNA, 104 bp, Homo sapiens
  misc_feature 1..104: note = chr1:18956470-18956574
  misc_feature 1..104: note = hyper
  source 1..104: mol_type = genomic DNA
tgtatcaagtcttgacgggctccctccctcccatttcccacctctttgggcccccagatcctcacaccagcaccaactccctgtaaacccaactacctgctgga

SEQ ID NO: 47032 - DNA, 118 bp, Homo sapiens
  misc_feature 1..118: note = chr1:18956738-18956856
  misc_feature 1..118: note = hyper
  source 1..118: mol_type = genomic DNA
cggcaggaaggtagagtaagaaccggacaccggggctctgacattacacagaaaaggtcagaattcctcccttcaagtcaccctaggccggttcccggggagcctcactggaggaatt

SEQ ID NO: 47033 - DNA, 261 bp, Homo sapiens
  misc_feature 1..261: note = chr1:18957246-18957507
  misc_feature 1..261: note = hyper
  source 1..261: mol_type = genomic DNA
ccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctg

SEQ ID NO: 47034 - DNA, 48 bp, Homo sapiens; identical to SEQ ID NO: 16891
  misc_feature 1..48: note = chr1:18957985-18958033
  misc_feature 1..48: note = hyper
  source 1..48: mol_type = genomic DNA

SEQ ID NO: 47035 - DNA, 38 bp, Homo sapiens
  misc_feature 1..38: note = chr1:18958381-18958419
  misc_feature 1..38: note = hyper
  source 1..38: mol_type = genomic DNA
ccggcggccttcgtttcgcaggtcgctagctgccggtc

SEQ ID NO: 47036 - DNA, 58 bp, Homo sapiens; identical to SEQ ID NO: 5338
  misc_feature 1..58: note = chr1:18958829-18958887
  misc_feature 1..58: note = hyper
  source 1..58: mol_type = genomic DNA

SEQ ID NO: 47037 - DNA, 48 bp, Homo sapiens; identical to SEQ ID NO: 26093
  misc_feature 1..48: note = chr1:18959220-18959268
  misc_feature 1..48: note = hyper
  source 1..48: mol_type = genomic DNA

SEQ ID NO: 47038 - DNA, 121 bp, Homo sapiens; identical to SEQ ID NO: 26094
  misc_feature 1..121: note = chr1:18959269-18959390
  misc_feature 1..121: note = hyper
  source 1..121: mol_type = genomic DNA

SEQ ID NO: 47039 - DNA, 355 bp, Homo sapiens
  misc_feature 1..355: note = chr1:18959550-18959905
  misc_feature 1..355: note = hyper
  source 1..355: mol_type = genomic DNA
ccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctcccc

SEQ ID NO: 47040 - DNA, 14 bp, Homo sapiens
  misc_feature 1..14: note = chr1:18960990-18961004
  misc_feature 1..14: note = hyper
  source 1..14: mol_type = genomic DNA
gggtccatccggcc

SEQ ID NO: 47041 - DNA, 139 bp, Homo sapiens
  misc_feature 1..139: note = chr1:18963135-18963274
  misc_feature 1..139: note = hyper
  source 1..139: mol_type = genomic DNA
gcggggctgcgcgcctggtctaccccaatactgcggggagtgcgtcctcccgggctggcgttttggctgctactctcggcgtcgatcaattatttataggaaacttgggcaagggggcgggggacgggagggagggaga

SEQ ID NO: 47042 - DNA, 182 bp, Homo sapiens; identical to SEQ ID NO: 26098
  misc_feature 1..182: note = chr1:18963662-18963844
  misc_feature 1..182: note = hyper
  source 1..182: mol_type = genomic DNA

SEQ ID NO: 47043 - DNA, 129 bp, Homo sapiens; identical to SEQ ID NO: 26099
  misc_feature 1..129: note = chr1:18964285-18964414
  misc_feature 1..129: note = hyper
  source 1..129: mol_type = genomic DNA

SEQ ID NO: 47044 - DNA, 41 bp, Homo sapiens; identical to SEQ ID NO: 26100
  misc_feature 1..41: note = chr1:18966656-18966697
  misc_feature 1..41: note = hyper
  source 1..41: mol_type = genomic DNA

SEQ ID NO: 47045 - DNA, 129 bp, Homo sapiens; identical to SEQ ID NO: 26101
  misc_feature 1..129: note = chr1:18968003-18968132
  misc_feature 1..129: note = hyper
  source 1..129: mol_type = genomic DNA

SEQ ID NO: 47046 - DNA, 132 bp, Homo sapiens
  misc_feature 1..132: note = chr1:18969493-18969625
  misc_feature 1..132: note = hyper
  source 1..132: mol_type = genomic DNA
gcgaagggagggggtcggctgcacttggaacttcaacctcctgggagaggaaaagcgtctgcgggtcgctacagcctcgggaggggtgaagggaagttgtgtgcgccccaagtccagctcaaaagaggcccc

SEQ ID NO: 47047 - DNA, 982 bp, Homo sapiens
  misc_feature 1..982: note = chr1:18969819-18970801
  misc_feature 1..982: note = hyper
  source 1..982: mol_type = genomic DNA
ggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttct

SEQ ID NO: 47048 - DNA, 113 bp, Homo sapiens
  misc_feature 1..113: note = chr1:18971739-18971852
  misc_feature 1..113: note = hyper
  source 1..113: mol_type = genomic DNA
ggctgggccttgcttcgccacgggttcgagggagaggcggagggaggagcggctgggctgcggagcctcttgccttcactgcactctttgtctgacaccacgaaaagaccgaa

SEQ ID NO: 47049 - DNA, 38 bp, Homo sapiens; identical to SEQ ID NO: 26104
  misc_feature 1..38: note = chr1:18972986-18973024
  misc_feature 1..38: note = hyper
  source 1..38: mol_type = genomic DNA

SEQ ID NO: 47050 - DNA, 73 bp, Homo sapiens; identical to SEQ ID NO: 26105
  misc_feature 1..73: note = chr1:18973661-18973734
  misc_feature 1..73: note = hyper
  source 1..73: mol_type = genomic DNA

SEQ ID NO: 47051 - DNA, 13 bp, Homo sapiens
  misc_feature 1..13: note = chr1:19043054-19043067
  misc_feature 1..13: note = hyper
  source 1..13: mol_type = genomic DNA
tcttttctccctt

SEQ ID NO: 47052 - DNA, 29 bp, Homo sapiens
  misc_feature 1..29: note = chr1:19043114-19043143
  misc_feature 1..29: note = hyper
  source 1..29: mol_type = genomic DNA
cgtctccctgatcgcgtcataaccctgag

SEQ ID NO: 47053 - DNA, 211 bp, Homo sapiens
  misc_feature 1..211: note = chr1:19043352-19043563
  misc_feature 1..211: note = hyper
  source 1..211: mol_type = genomic DNA
cctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttga

SEQ ID NO: 47054 - DNA, 65 bp, Homo sapiens; identical to SEQ ID NO: 16905
  misc_feature 1..65: note = chr1:19043678-19043743
  misc_feature 1..65: note = hyper
  source 1..65: mol_type = genomic DNA

SEQ ID NO: 47055 - DNA, 151 bp, Homo sapiens; identical to SEQ ID NO: 5351
  misc_feature 1..151: note = chr1:19043756-19043907
  misc_feature 1..151: note = hyper
  source 1..151: mol_type = genomic DNA

SEQ ID NO: 47056 - DNA, 74 bp, Homo sapiens; identical to SEQ ID NO: 26110
  misc_feature 1..74: note = chr1:20512379-20512453
  misc_feature 1..74: note = hyper
  source 1..74: mol_type = genomic DNA

SEQ ID NO: 47057 - DNA, 189 bp, Homo sapiens
  misc_feature 1..189: note = chr1:20618140-20618329
  misc_feature 1..189: note = hyper
  source 1..189: mol_type = genomic DNA
gcagggtgcccaccccggcagccgggctcatgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagca

SEQ ID NO: 47058 - DNA, 184 bp, Homo sapiens
  misc_feature 1..184: note = chr1:20618369-20618553
  misc_feature 1..184: note = hyper
  source 1..184: mol_type = genomic DNA
ctggaagttccaccataacgtctgcggcagccccaacagttccaccccatgctcccgccgccggcaccacagcagcagaaggaggcctgtggggcgggggccagaacctttccctcctcccttctgaagagcaacaggcgtcacaccatcctgcctctcccactaaccccgttccttcttttgc

SEQ ID NO: 47059 - DNA, 150 bp, Homo sapiens; identical to SEQ ID NO: 26112
  misc_feature 1..150: note = chr1:20669698-20669848
  misc_feature 1..150: note = hyper
  source 1..150: mol_type = genomic DNA

SEQ ID NO: 47060 - DNA, 38 bp, Homo sapiens; identical to SEQ ID NO: 26113
  misc_feature 1..38: note = chr1:20669896-20669934
  misc_feature 1..38: note = hyper
  source 1..38: mol_type = genomic DNA

SEQ ID NO: 47061 - DNA, 40 bp, Homo sapiens; identical to SEQ ID NO: 5354
  misc_feature 1..40: note = chr1:20692819-20692859
  misc_feature 1..40: note = hyper
  source 1..40: mol_type = genomic DNA

SEQ ID NO: 47062 - DNA, 203 bp, Homo sapiens; identical to SEQ ID NO: 26115
  misc_feature 1..203: note = chr1:20810635-20810838
  misc_feature 1..203: note = hyper
  source 1..203: mol_type = genomic DNA

SEQ ID NO: 47063 - DNA, 47 bp, Homo sapiens; identical to SEQ ID NO: 26116
  misc_feature 1..47: note = chr1:20810864-20810911
  misc_feature 1..47: note = hyper
  source 1..47: mol_type = genomic DNA

SEQ ID NO: 47064 - DNA, 148 bp, Homo sapiens; identical to SEQ ID NO: 26117
  misc_feature 1..148: note = chr1:20878512-20878660
  misc_feature 1..148: note = hyper
  source 1..148: mol_type = genomic DNA

SEQ ID NO: 47065 - DNA, 124 bp, Homo sapiens; identical to SEQ ID NO: 5357
  misc_feature 1..124: note = chr1:20878905-20879029
  misc_feature 1..124: note = hyper
  source 1..124: mol_type = genomic DNA

SEQ ID NO: 47066 - skipped

SEQ ID NO: 47067 - DNA, 148 bp, Homo sapiens; identical to SEQ ID NO: 16915
  misc_feature 1..148: note = chr1:20879289-20879437
  misc_feature 1..148: note = hyper
  source 1..148: mol_type = genomic DNA

SEQ ID NO: 47068 - DNA, 100 bp, Homo sapiens; identical to SEQ ID NO: 16916
  misc_feature 1..100: note = chr1:20879462-20879562
  misc_feature 1..100: note = hyper
  source 1..100: mol_type = genomic DNA

SEQ ID NO: 47069 - DNA, 205 bp, Homo sapiens
  misc_feature 1..205: note = chr1:20879640-20879845
  misc_feature 1..205: note = hyper
  source 1..205: mol_type = genomic DNA
cggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgca

SEQ ID NO: 47070 - DNA, 225 bp, Homo sapiens; identical to SEQ ID NO: 16917
  misc_feature 1..225: note = chr1:20879957-20880182
  misc_feature 1..225: note = hyper
  source 1..225: mol_type = genomic DNA

SEQ ID NO: 47071 - DNA, 57 bp, Homo sapiens; identical to SEQ ID NO: 26122
  misc_feature 1..57: note = chr1:20916163-20916220
  misc_feature 1..57: note = hyper
  source 1..57: mol_type = genomic DNA

SEQ ID NO: 47072 - DNA, 44 bp, Homo sapiens
  misc_feature 1..44: note = chr1:21044081-21044125
  misc_feature 1..44: note = hyper
  source 1..44: mol_type = genomic DNA
ggatgcagcactgggcgcgcgcgcagtccacagtcaccacgggc

SEQ ID NO: 47073 - DNA, 60 bp, Homo sapiens
  misc_feature 1..60: note = chr1:21044161-21044221
  misc_feature 1..60: note = hyper
  source 1..60: mol_type = genomic DNA
cggcagcgcacgacaaccttcaccgcctcggaggccatggcgccgcgcccaggaccaacg

SEQ ID NO: 47074 - DNA, 66 bp, Homo sapiens; identical to SEQ ID NO: 26124
  misc_feature 1..66: note = chr1:21058309-21058375
  misc_feature 1..66: note = hyper
  source 1..66: mol_type = genomic DNA

SEQ ID NO: 47075 - DNA, 127 bp, Homo sapiens; identical to SEQ ID NO: 26125
  misc_feature 1..127: note = chr1:21754473-21754600
  misc_feature 1..127: note = hyper
  source 1..127: mol_type = genomic DNA

SEQ ID NO: 47076 - DNA, 174 bp, Homo sapiens; identical to SEQ ID NO: 26126
  misc_feature 1..174: note = chr1:21835408-21835582
  misc_feature 1..174: note = hyper
  source 1..174: mol_type = genomic DNA

SEQ ID NO: 47077 - DNA, 317 bp, Homo sapiens; identical to SEQ ID NO: 26127
  misc_feature 1..317: note = chr1:21836071-21836388
  misc_feature 1..317: note = hyper
  source 1..317: mol_type = genomic DNA

SEQ ID NO: 47078 - DNA, 90 bp, Homo sapiens
  misc_feature 1..90: note = chr1:22140663-22140753
  misc_feature 1..90: note = hyper
  source 1..90: mol_type = genomic DNA
cgcatcttagggtttcgaataagggattgtagatttgaattaaattaaattaaatcatttaatccttacaatcattctgagattgattaa

SEQ ID NO: 47079 - DNA, 124 bp, Homo sapiens
  misc_feature 1..124: note = chr1:22141184-22141308
  misc_feature 1..124: note = hyper
  source 1..124: mol_type = genomic DNA
ggtccccactgtgcggcctgaacatcccggtgcctgtggcatcctccggaccctttctaggcctgcgcctggtcacgagaggccgccagccccgcgtggacttcgtgggcgaagtcacctcttt

SEQ ID NO: 47080 - DNA, 140 bp, Homo sapiens; identical to SEQ ID NO: 26130
  misc_feature 1..140: note = chr1:22889622-22889762
  misc_feature 1..140: note = hyper
  source 1..140: mol_type = genomic DNA

SEQ ID NO: 47081 - DNA, 30 bp, Homo sapiens; identical to SEQ ID NO: 26131
  misc_feature 1..30: note = chr1:22890079-22890109
  misc_feature 1..30: note = hyper
  source 1..30: mol_type = genomic DNA

SEQ ID NO: 47082 - DNA, 48 bp, Homo sapiens; identical to SEQ ID NO: 26132
  misc_feature 1..48: note = chr1:22933907-22933955
  misc_feature 1..48: note = hyper
  source 1..48: mol_type = genomic DNA

SEQ ID NO: 47083 - DNA, 73 bp, Homo sapiens; identical to SEQ ID NO: 26133
  misc_feature 1..73: note = chr1:23038177-23038250
  misc_feature 1..73: note = hyper
  source 1..73: mol_type = genomic DNA

SEQ ID NO: 47084 - DNA, 120 bp, Homo sapiens; identical to SEQ ID NO: 16925
  misc_feature 1..120: note = chr1:23748862-23748982
  misc_feature 1..120: note = hyper
  source 1..120: mol_type = genomic DNA

SEQ ID NO: 47085 - DNA, 79 bp, Homo sapiens
  misc_feature 1..79: note = chr1:23749070-23749149
  misc_feature 1..79: note = hyper
  source 1..79: mol_type = genomic DNA
tcccagagcaggccccacctttctcggccagacgcccagagctccatgcccacccagacactgccgagagcccaggcgc

SEQ ID NO: 47086 - DNA, 69 bp, Homo sapiens; identical to SEQ ID NO: 26135
  misc_feature 1..69: note = chr1:23884932-23885001
  misc_feature 1..69: note = hyper
  source 1..69: mol_type = genomic DNA

SEQ ID NO: 47087 - DNA, 80 bp, Homo sapiens; identical to SEQ ID NO: 26136
  misc_feature 1..80: note = chr1:24648262-24648342
  misc_feature 1..80: note = hyper
  source 1..80: mol_type = genomic DNA

SEQ ID NO: 47088 - DNA, 342 bp, Homo sapiens; identical to SEQ ID NO: 16927
  misc_feature 1..342: note = chr1:25256012-25256354
  misc_feature 1..342: note = hyper
  source 1..342: mol_type = genomic DNA

SEQ ID NO: 47089 - DNA, 441 bp, Homo sapiens; identical to SEQ ID NO: 16928
  misc_feature 1..441: note = chr1:25256383-25256824
  misc_feature 1..441: note = hyper
  source 1..441: mol_type = genomic DNA

SEQ ID NO: 47090 - DNA, 137 bp, Homo sapiens
  misc_feature 1..137: note = chr1:25257205-25257342
  misc_feature 1..137: note = hyper
  source 1..137: mol_type = genomic DNA
ccggtgacgccgcactgggagccgccccaaagaggttactcacctccctcgtcccgcacattattctgacccaagagcctccaccccacacgggattttgcgcgtcgtccacgcccggccggcggcctttgctgctc

SEQ ID NO: 47091 - DNA, 117 bp, Homo sapiens; identical to SEQ ID NO: 26139
  misc_feature 1..117: note = chr1:25259018-25259135
  misc_feature 1..117: note = hyper
  source 1..117: mol_type = genomic DNA

SEQ ID NO: 47092 - DNA, 103 bp, Homo sapiens; identical to SEQ ID NO: 26140
  misc_feature 1..103: note = chr1:26249061-26249164
  misc_feature 1..103: note = hyper
  source 1..103: mol_type = genomic DNA

SEQ ID NO: 47093 - DNA, 196 bp, Homo sapiens; identical to SEQ ID NO: 26141
  misc_feature 1..196: note = chr1:26249400-26249596
  misc_feature 1..196: note = hyper
  source 1..196: mol_type = genomic DNA

SEQ ID NO: 47094 - DNA, 113 bp, Homo sapiens; identical to SEQ ID NO: 26142
  misc_feature 1..113: note = chr1:26372988-26373101
  misc_feature 1..113: note = hyper
  source 1..113: mol_type = genomic DNA

SEQ ID NO: 47095 - DNA, 290 bp, Homo sapiens
  misc_feature 1..290: note = chr1:26551796-26552086
  misc_feature 1..290: note = hyper
  source 1..290: mol_type = genomic DNA
cttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagctt

SEQ ID NO: 47096 - DNA, 77 bp, Homo sapiens
  misc_feature 1..77: note = chr1:26552130-26552207
  misc_feature 1..77: note = hyper
  source 1..77: mol_type = genomic DNA
cgaacgcgggagggcctggagcgcggcggcagctggatagcattcgggcccatccgaataagcggtaaatggatcat

SEQ ID NO: 47097 - DNA, 121 bp, Homo sapiens; identical to SEQ ID NO: 26144
  misc_feature 1..121: note = chr1:26735162-26735283
  misc_feature 1..121: note = hyper
  source 1..121: mol_type = genomic DNA

SEQ ID NO: 47098 - DNA, 309 bp, Homo sapiens; identical to SEQ ID NO: 5374
  misc_feature 1..309: note = chr1:26735645-26735954
  misc_feature 1..309: note = hyper
  source 1..309: mol_type = genomic DNA

SEQ ID NO: 47099 - DNA, 402 bp, Homo sapiens
  misc_feature 1..402: note = chr1:26737181-26737583
  misc_feature 1..402: note = hyper
  source 1..402: mol_type = genomic DNA
ggggagggggctgcccgcggggggttgggtcattgtcttttagaatttgggagcctttgaaaagccgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggc

SEQ ID NO: 47100 - DNA, 270 bp, Homo sapiens
  misc_feature 1..270: note = chr1:26737613-26737883
  misc_feature 1..270: note = hyper
  source 1..270: mol_type = genomic DNA
aggagaggcttgtcccgccgtgagtctctgggaaacgcgttgtgggaagaggagcaaaactttcggggcactactgtcccggtgtacgctaggggaacgcgggaggcgaccgggataggtttcttctcttctgttgcttggtagctgccccctcctggctgtccacttgtggggctggatactcgggtctccctgcctggggcccgagacggccctccgattccgtgccccccagctaagtgcccggccctccctctctccaggtggctg

SEQ ID NO: 47101 - DNA, 39 bp, Homo sapiens
  misc_feature 1..39: note = chr1:26737907-26737946
  misc_feature 1..39: note = hyper
  source 1..39: mol_type = genomic DNA
cgaggaggcgccggaggacgcggcccgggcggcggacga

SEQ ID NO: 47102 - DNA, 142 bp, Homo sapiens
  misc_feature 1..142: note = chr1:26738182-26738324
  misc_feature 1..142: note = hyper
  source 1..142: mol_type = genomic DNA
tgcatccctgtctttgcttcggcaccccaattctgagtccctgttaactatctcgtgggggagtagtgggaggcagcaccaattatcagcacccccgcccccttccgggaacccctccggcttaccacgtgtctattacctc

SEQ ID NO: 47103 - DNA, 442 bp, Homo sapiens; identical to SEQ ID NO: 26148
  misc_feature 1..442: note = chr1:27960654-27961096
  misc_feature 1..442: note = hyper
  source 1..442: mol_type = genomic DNA

SEQ ID NO: 47104 - DNA, 328 bp, Homo sapiens; identical to SEQ ID NO: 26149
  misc_feature 1..328: note = chr1:28199304-28199632
  misc_feature 1..328: note = hyper
  source 1..328: mol_type = genomic DNA

SEQ ID NO: 47105 - DNA, 405 bp, Homo sapiens; identical to SEQ ID NO: 26150
  misc_feature 1..405: note = chr1:29138552-29138957
  misc_feature 1..405: note = hyper
  source 1..405: mol_type = genomic DNA

SEQ ID NO: 47106 - DNA, 237 bp, Homo sapiens; identical to SEQ ID NO: 26151
  misc_feature 1..237: note = chr1:29448530-29448767
  misc_feature 1..237: note = hyper
  source 1..237: mol_type = genomic DNA

SEQ ID NO: 47107 - DNA, 112 bp, Homo sapiens; identical to SEQ ID NO: 26152
  misc_feature 1..112: note = chr1:29449783-29449895
  misc_feature 1..112: note = hyper
  source 1..112: mol_type = genomic DNA

SEQ ID NO: 47108 - DNA, 30 bp, Homo sapiens
  misc_feature 1..30: note = chr1:29586042-29586072
  misc_feature 1..30: note = hyper
  source 1..30: mol_type = genomic DNA
cagagcggccgaggccgaacgcttcctctt

SEQ ID NO: 47109 - DNA, 184 bp, Homo sapiens
  misc_feature 1..184: note = chr1:29586674-29586858
  misc_feature 1..184: note = hyper
  source 1..184: mol_type = genomic DNA
ggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccagga

SEQ ID NO: 47110 - DNA, 31 bp, Homo sapiens
  misc_feature 1..31: note = chr1:29805094-29805125
  misc_feature 1..31: note = hyper
  source 1..31: mol_type = genomic DNA
gacccctggcttcccgcgctgccctgcccgg

SEQ ID NO: 47111 - DNA, 30 bp, Homo sapiens; identical to SEQ ID NO: 26155
  misc_feature 1..30: note = chr1:29805353-29805383
  misc_feature 1..30: note = hyper
  source 1..30: mol_type = genomic DNA

SEQ ID NO: 47112 - DNA, 166 bp, Homo sapiens; identical to SEQ ID NO: 26156
  misc_feature 1..166: note = chr1:30559014-30559180
  misc_feature 1..166: note = hyper
  source 1..166: mol_type = genomic DNA

SEQ ID NO: 47113 - DNA, 264 bp, Homo sapiens
  misc_feature 1..264: note = chr1:30815578-30815842
  misc_feature 1..264: note = hyper
  source 1..264: mol_type = genomic DNA
ctctccagggtcctgggacgagaccagccccgggcagggcagcgcggggagccaggggtcccacacccaggagggcccctcaccgcaagggacgggcttaggcggataaatgtccggctcccctcgaggggcagagtcagcaccccccacacggtccctgagatggccctgggaccgagccgccgcccccgacttgtgattcagcctcttcctgcctggctttcccctccccactgtgcctcctgggatcgcctcccaaatcag

SEQ ID NO: 47114 - DNA, 223 bp, Homo sapiens; identical to SEQ ID NO: 26158
  misc_feature 1..223: note = chr1:31157994-31158217
  misc_feature 1..223: note = hyper
  source 1..223: mol_type = genomic DNA

SEQ ID NO: 47115 - DNA, 34 bp, Homo sapiens; identical to SEQ ID NO: 26159
  misc_feature 1..34: note = chr1:31712624-31712658
  misc_feature 1..34: note = hyper
  source 1..34: mol_type = genomic DNA

SEQ ID NO: 47116 - DNA, 287 bp, Homo sapiens; identical to SEQ ID NO: 26160
  misc_feature 1..287: note = chr1:31846347-31846634
  misc_feature 1..287: note = hyper
  source 1..287: mol_type = genomic DNA

SEQ ID NO: 47117 - DNA, 213 bp, Homo sapiens; identical to SEQ ID NO: 16940
  misc_feature 1..213: note = chr1:32180184-32180397
  misc_feature 1..213: note = hyper
  source 1..213: mol_type = genomic DNA

SEQ ID NO: 47118 - DNA, 133 bp, Homo sapiens; identical to SEQ ID NO: 26162
  misc_feature 1..133: note = chr1:32180688-32180821
  misc_feature 1..133: note = hyper
  source 1..133: mol_type = genomic DNA

SEQ ID NO: 47119 - DNA, 228 bp, Homo sapiens; identical to SEQ ID NO: 5385
  misc_feature 1..228: note = chr1:32180905-32181133
  misc_feature 1..228: note = hyper
  source 1..228: mol_type = genomic DNA

SEQ ID NO: 47120 - DNA, 99 bp, Homo sapiens; identical to SEQ ID NO: 26164
  misc_feature 1..99: note = chr1:32181358-32181457
  misc_feature 1..99: note = hyper
  source 1..99: mol_type = genomic DNA

SEQ ID NO: 47121 - DNA, 20 bp, Homo sapiens
  misc_feature 1..20: note = chr1:32226308-32226328
  misc_feature 1..20: note = hyper
  source 1..20: mol_type = genomic DNA
ccgacctgcccaggccgcca

SEQ ID NO: 47122 - DNA, 25 bp, Homo sapiens
  misc_feature 1..25: note = chr1:32237521-32237546
  misc_feature 1..25: note = hyper
  source 1..25: mol_type = genomic DNA
cacaaagggccccaccgccggaagc

SEQ ID NO: 47123 - DNA, 167 bp, Homo sapiens
  misc_feature 1..167: note = chr1:32238507-32238674
  misc_feature 1..167: note = hyper
  source 1..167: mol_type = genomic DNA
agggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctga

SEQ ID NO: 47124 - DNA, 42 bp, Homo sapiens; identical to SEQ ID NO: 16944
  misc_feature 1..42: note = chr1:32410234-32410276
  misc_feature 1..42: note = hyper
  source 1..42: mol_type = genomic DNA

SEQ ID NO: 47125 - DNA, 58 bp, Homo sapiens; identical to SEQ ID NO: 16945
  misc_feature 1..58: note = chr1:32410306-32410364
  misc_feature 1..58: note = hyper
  source 1..58: mol_type = genomic DNA

SEQ ID NO: 47126 - DNA, 84 bp, Homo sapiens; identical to SEQ ID NO: 26169
  misc_feature 1..84: note = chr1:32827740-32827824
  misc_feature 1..84: note = hyper
  source 1..84: mol_type = genomic DNA

SEQ ID NO: 47127 - DNA, 408 bp, Homo sapiens; identical to SEQ ID NO: 26170
  misc_feature 1..408: note = chr1:32930619-32931027
  misc_feature 1..408: note = hyper
  source 1..408: mol_type = genomic DNA

SEQ ID NO: 47128 - DNA, 35 bp, Homo sapiens; identical to SEQ ID NO: 5391
  misc_feature 1..35: note = chr1:33351678-33351713
  misc_feature 1..35: note = hyper
  source 1..35: mol_type = genomic DNA

SEQ ID NO: 47129 - DNA, 98 bp, Homo sapiens; identical to SEQ ID NO: 26172
  misc_feature 1..98: note = chr1:33358896-33358994
  misc_feature 1..98: note = hyper
  source 1..98: mol_type = genomic DNA

SEQ ID NO: 47130 - DNA, 75 bp, Homo sapiens; identical to SEQ ID NO: 26173
  misc_feature 1..75: note = chr1:33390730-33390805
  misc_feature 1..75: note = hyper
  source 1..75: mol_type = genomic DNA

SEQ ID NO: 47131 - DNA, 71 bp, Homo sapiens; identical to SEQ ID NO: 26174
  misc_feature 1..71: note = chr1:33438729-33438800
  misc_feature 1..71: note = hyper
  source 1..71: mol_type = genomic DNA

SEQ ID NO: 47132 - DNA, 140 bp, Homo sapiens; identical to SEQ ID NO: 26175
  misc_feature 1..140: note = chr1:33772445-33772585
  misc_feature 1..140: note = hyper
  source 1..140: mol_type = genomic DNA

SEQ ID NO: 47133 - DNA, 33 bp, Homo sapiens; identical to SEQ ID NO: 26176
  misc_feature 1..33: note = chr1:33772904-33772937
  misc_feature 1..33: note = hyper
  source 1..33: mol_type = genomic DNA

SEQ ID NO: 47134 - DNA, 358 bp, Homo sapiens
  misc_feature 1..358: note = chr1:34628590-34628948
  misc_feature 1..358: note = hyper
  source 1..358: mol_type = genomic DNA
ctgagcaaggagctgcgagcaaatggatctctatagggcaggattccagcaccgctgagcggtgcaagcgccggtgagtcggcctttttctctcccctaggggcaggatatgcccaaggggcagggacaaatctagccagaaaaacaattcagtccgatgccgagacattctccaatcagctaagccagagaccggcctcgcctcaacgtacgtccgggaggcctggcgggaggtagcagcgattcccccaccgcccatgtggcaagtctgggtgaccagcagcgtcggtatgcacagcctcccagtgggtgtgggtgtgcgagaggccagagctcccaggcgcgcgcaccgcgggcg

SEQ ID NO: 47135 - DNA, 491 bp, Homo sapiens; identical to SEQ ID NO: 16951
  misc_feature 1..491: note = chr1:34628978-34629469
  misc_feature 1..491: note = hyper
  source 1..491: mol_type = genomic DNA

SEQ ID NO: 47136 - DNA, 185 bp, Homo sapiens
  misc_feature 1..185: note = chr1:34629728-34629913
  misc_feature 1..185: note = hyper
  source 1..185: mol_type = genomic DNA
tggcgcggagtgagcaccgaggggaatgtggcagcgcgaagcctggcggcggcactccctcccccgcctcgggctacaacccccaccccctccttcccatccctcaacaccctccagcccccacctgcaccctcctgcaaggaatgcgcgggacccccaccgtgggcacgcgtccacctgaaccc

SEQ ID NO: 47137 - DNA, 333 bp, Homo sapiens
  misc_feature 1..333: note = chr1:34630215-34630548
  misc_feature 1..333: note = hyper
  source 1..333: mol_type = genomic DNA
ccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccag

SEQ ID NO: 47138 - DNA, 224 bp, Homo sapiens; identical to SEQ ID NO: 16954
  misc_feature 1..224: note = chr1:34630635-34630859
  misc_feature 1..224: note = hyper
  source 1..224: mol_type = genomic DNA

SEQ ID NO: 47139 - DNA, 62 bp, Homo sapiens
  misc_feature 1..62: note = chr1:34630978-34631040
  misc_feature 1..62: note = hyper
  source 1..62: mol_type = genomic DNA
ccaaatgctgggggtggaggcgcagctaaggataaaatattggggggcgggggttcctcttc

SEQ ID NO: 47140 - DNA, 64 bp, Homo sapiens
  misc_feature 1..64: note = chr1:34631516-34631580
  misc_feature 1..64: note = hyper
  source 1..64: mol_type = genomic DNA
gggaggggggggaaccggttcatttgacccagtgcggtcccactcctaccctaagacaaaaatc

SEQ ID NO: 47141 - DNA, 147 bp, Homo sapiens
  misc_feature 1..147: note = chr1:34631662-34631809
  misc_feature 1..147: note = hyper
  source 1..147: mol_type = genomic DNA
tagtacaatttatccccaaatttaaataatcggatcctacttcttcttctccccttcctcctcccagccaaggccccaaaccaagagagttcttcccaaggacgtgagctgctccccacctctccccagtagcggctgcctctaggc

SEQ ID NO: 47142 - DNA, 361 bp, Homo sapiens; identical to SEQ ID NO: 26180
  misc_feature 1..361: note = chr1:34632140-34632501
  misc_feature 1..361: note = hyper
  source 1..361: mol_type = genomic DNA

SEQ ID NO: 47143 - DNA, 276 bp, Homo sapiens; identical to SEQ ID NO: 26182
  misc_feature 1..276: note = chr1:34642862-34643138
  misc_feature 1..276: note = hyper
  source 1..276: mol_type = genomic DNA

SEQ ID NO: 47144 - DNA, 77 bp, Homo sapiens; identical to SEQ ID NO: 26183
  misc_feature 1..77: note = chr1:35247068-35247145
  misc_feature 1..77: note = hyper
  source 1..77: mol_type = genomic DNA

SEQ ID NO: 47145 - DNA, 76 bp, Homo sapiens
  misc_feature 1..76: note = chr1:35258561-35258637
  misc_feature 1..76: note = hyper
  source 1..76: mol_type = genomic DNA
ctgcgctatttaaggcgcccccgccgctcgtgcggtccagcagggctcccgcgggcgtcactccggccatcgtccc

SEQ ID NO: 47146 - DNA, 90 bp, Homo sapiens
  misc_feature 1..90: note = chr1:35258714-35258804
  misc_feature 1..90: note = hyper
  source 1..90: mol_type = genomic DNA
ggaggccgggaggagtcttgggtcctccgatgccgggacgggggttgctgcggaacgcccgccgcgacagagccgcgctcacccaggtgg

SEQ ID NO: 47147 - DNA, 39 bp, Homo sapiens; identical to SEQ ID NO: 16960
  misc_feature 1..39: note = chr1:35351039-35351078
  misc_feature 1..39: note = hyper
  source 1..39: mol_type = genomic DNA

SEQ ID NO: 47148 - DNA, 197 bp, Homo sapiens
  misc_feature 1..197: note = chr1:35351659-35351856
  misc_feature 1..197: note = hyper
  source 1..197: mol_type = genomic DNA
aaggtgtactcacaggagccgggcctccctgagacagcggcaggggtagcgaggaggggcaggcagtcgtcgtcttgagagcagccggcctggatggcccggaggtagctgtggctccgcatgcggaaacagccgggcaggtccagggcgtccacggcctgggactccagctccccaaacaccgacccgcacacggc

SEQ ID NO: 47149 - DNA, 60 bp, Homo sapiens; identical to SEQ ID NO: 5400
  misc_feature 1..60: note = chr1:35390613-35390673
  misc_feature 1..60: note = hyper
  source 1..60: mol_type = genomic DNA

SEQ ID NO: 47150 - DNA, 151 bp, Homo sapiens
  misc_feature 1..151: note = chr1:35395375-35395526
  misc_feature 1..151: note = hyper
  source 1..151: mol_type = genomic DNA
cgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacc

SEQ ID NO: 47151 - DNA, 198 bp, Homo sapiens
  misc_feature 1..198: note = chr1:35395851-35396049
  misc_feature 1..198: note = hyper
  source 1..198: mol_type = genomic DNA
gtccgcacagccgaggcatccccagtgtggagggagagccccgctgtacctgccgcctgtgctgggcccccgcccgtgcccactgtgcccgcccgcctctgggccctgagcctgggattgtgccatggcggggtcggggtggggggaaagggactgtccgaagcacagctggaggctgcggagcccggacacaggctg

SEQ ID NO: 47152 - DNA, 24 bp, Homo sapiens
  misc_feature 1..24: note = chr1:35396107-35396131
  misc_feature 1..24: note = hyper
  source 1..24: mol_type = genomic DNA
cgcccagagcgatgctgtaatggg

SEQ ID NO: 47153 - DNA, 130 bp, Homo sapiens; identical to SEQ ID NO: 16965
  misc_feature 1..130: note = chr1:36042549-36042679
  misc_feature 1..130: note = hyper
  source 1..130: mol_type = genomic DNA

SEQ ID NO: 47154 - DNA, 30 bp, Homo sapiens; identical to SEQ ID NO: 5405
  misc_feature 1..30: note = chr1:36549840-36549870
  misc_feature 1..30: note = hyper
  source 1..30: mol_type = genomic DNA

SEQ ID NO: 47155 - DNA, 164 bp, Homo sapiens; identical to SEQ ID NO: 26192
  misc_feature 1..164: note = chr1:37498362-37498526
  misc_feature 1..164: note = hyper
  source 1..164: mol_type = genomic DNA

SEQ ID NO: 47156 - DNA, 39 bp, Homo sapiens; identical to SEQ ID NO: 16967
  misc_feature 1..39: note = chr1:37498753-37498792
  misc_feature 1..39: note = hyper
  source 1..39: mol_type = genomic DNA

SEQ ID NO: 47157 - DNA, 279 bp, Homo sapiens
  misc_feature 1..279: note = chr1:37499181-37499460
  misc_feature 1..279: note = hyper
  source 1..279: mol_type = genomic DNA
gagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggagga

SEQ ID NO: 47158 - DNA, 288 bp, Homo sapiens
  misc_feature 1..288: note = chr1:37500153-37500441
  misc_feature 1..288: note = hyper
  source 1..288: mol_type = genomic DNA
cctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagc

SEQ ID NO: 47159 - DNA, 26 bp, Homo sapiens
  misc_feature 1..26: note = chr1:37500442-37500468
  misc_feature 1..26: note = hyper
  source 1..26: mol_type = genomic DNA
cgagagctggcaccgcgagctgggag

SEQ ID NO: 47160 - DNA, 168 bp, Homo sapiens
  misc_feature 1..168: note = chr1:37500806-37500974
  misc_feature 1..168: note = hyper
  source 1..168: mol_type = genomic DNA
gctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtag

SEQ ID NO: 47161 - DNA, 33 bp, Homo sapiens; identical to SEQ ID NO: 26198
  misc_feature 1..33: note = chr1:38100650-38100683
  misc_feature 1..33: note = hyper
  source 1..33: mol_type = genomic DNA

SEQ ID NO: 47162 - DNA, 189 bp, Homo sapiens
  misc_feature 1..189: note = chr1:38219523-38219712
  misc_feature 1..189: note = hyper
  source 1..189: mol_type = genomic DNA
tggcagcatggggaccgaaccgatggtgcgaaggtcgggagcccccctttcggctggagggtaggcagggtgaggagagggcagcggaggggcgctctcctcagtgatctgccaggcatcctaaccccatcctccgtctggactctcgcagttgtcctggttcttctcatcaaaggccccggcccccag

SEQ ID NO: 47163 - DNA, 163 bp, Homo sapiens
  misc_feature 1..163: note = chr1:38219795-38219958
  misc_feature 1..163: note = hyper
  source 1..163: mol_type = genomic DNA
accctgccctcaccaccacctggatcaggccttccttcttggccactcccaccccccaccctccgcagtgcagcctggaggggggactcacgggtgcaggaagccgagggcgggtcggtgggtgagcgcgcatagctgtcctggcacacgcagaaggtggagg

SEQ ID NO: 47164 - DNA, 36 bp, Homo sapiens
  misc_feature 1..36: note = chr1:38230006-38230042
  misc_feature 1..36: note = hyper
  source 1..36: mol_type = genomic DNA
ctggattcaactgagcgtatagctcccctaaatgca

SEQ ID NO: 47165 - DNA, 156 bp, Homo sapiens; identical to SEQ ID NO: 16970
  misc_feature 1..156: note = chr1:38230623-38230779
  misc_feature 1..156: note = hyper
  source 1..156: mol_type = genomic DNA

SEQ ID NO: 47166 - DNA, 91 bp, Homo sapiens; identical to SEQ ID NO: 16971
  misc_feature 1..91: note = chr1:38510087-38510178
  misc_feature 1..91: note = hyper
  source 1..91: mol_type = genomic DNA

SEQ ID NO: 47167 - DNA, 33 bp, Homo sapiens
  misc_feature 1..33: note = chr1:38510217-38510250
  misc_feature 1..33: note = hyper
  source 1..33: mol_type = genomic DNA
ggctcggatgaaacgaaacgaaaaatgaacact

SEQ ID NO: 47168 - DNA, 253 bp, Homo sapiens
  misc_feature 1..253: note = chr1:38510310-38510563
  misc_feature 1..253: note = hyper
  source 1..253: mol_type = genomic DNA
tagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggag

SEQ ID NO: 47169 - DNA, 110 bp, Homo sapiens; identical to SEQ ID NO: 16974
  misc_feature 1..110: note = chr1:38510624-38510734
  misc_feature 1..110: note = hyper
  source 1..110: mol_type = genomic DNA

SEQ ID NO: 47170 - DNA, 81 bp, Homo sapiens; identical to SEQ ID NO: 16975
  misc_feature 1..81: note = chr1:38510773-38510854
  misc_feature 1..81: note = hyper
  source 1..81: mol_type = genomic DNA

SEQ ID NO: 47171 - DNA, 218 bp, Homo sapiens; identical to SEQ ID NO: 16976
  misc_feature 1..218: note = chr1:38511119-38511337
  misc_feature 1..218: note = hyper
  source 1..218: mol_type = genomic DNA

SEQ ID NO: 47172 - DNA, 290 bp, Homo sapiens
  misc_feature 1..290: note = chr1:38511824-38512114
  misc_feature 1..290: note = hyper
  source 1..290: mol_type = genomic DNA
ctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggc

SEQ ID NO: 47173 - DNA, 27 bp, Homo sapiens
  misc_feature 1..27: note = chr1:38512126-38512153
  misc_feature 1..27: note = hyper
  source 1..27: mol_type = genomic DNA
cgcctgccttgccgtgttctaggtgcg

SEQ ID NO: 47174 - DNA, 39 bp, Homo sapiens; identical to SEQ ID NO: 26209
  misc_feature 1..39: note = chr1:38513064-38513103
  misc_feature 1..39: note = hyper
  source 1..39: mol_type = genomic DNA

SEQ ID NO: 47175 - DNA, 32 bp, Homo sapiens; identical to SEQ ID NO: 26210
  misc_feature 1..32: note = chr1:38599724-38599756
  misc_feature 1..32: note = hyper
  source 1..32: mol_type = genomic DNA

SEQ ID NO: 47176 - DNA, 20 bp, Homo sapiens
  misc_feature 1..20: note = chr1:39025499-39025519
  misc_feature 1..20: note = hyper
  source 1..20: mol_type = genomic DNA
cggggcggggcggggggcga

SEQ ID NO: 47177 - DNA, 74 bp, Homo sapiens; identical to SEQ ID NO: 26212
  misc_feature 1..74: note = chr1:39044122-39044196
  misc_feature 1..74: note = hyper
  source 1..74: mol_type = genomic DNA

SEQ ID NO: 47178 - DNA, 109 bp, Homo sapiens; identical to SEQ ID NO: 26213
  misc_feature 1..109: note = chr1:39044197-39044306
  misc_feature 1..109: note = hyper
  source 1..109: mol_type = genomic DNA

SEQ ID NO: 47179 - DNA, 98 bp, Homo sapiens; identical to SEQ ID NO: 16979
  misc_feature 1..98: note = chr1:39269643-39269741
  misc_feature 1..98: note = hyper
  source 1..98: mol_type = genomic DNA

SEQ ID NO: 47180 - DNA, 42 bp, Homo sapiens
  misc_feature 1..42: note = chr1:39270121-39270163
  misc_feature 1..42: note = hyper
  source 1..42: mol_type = genomic DNA
tttagaaagagctgcgggctgcgggcccggctgtccccgaga

SEQ ID NO: 47181 - DNA, 33 bp, Homo sapiens; identical to SEQ ID NO: 26215
  misc_feature 1..33: note = chr1:39284513-39284546
  misc_feature 1..33: note = hyper
  source 1..33: mol_type = genomic DNA

SEQ ID NO: 47182 - DNA, 614 bp, Homo sapiens; identical to SEQ ID NO: 26216
  misc_feature 1..614: note = chr1:40105079-40105693
  misc_feature 1..614: note = hyper
  source 1..614: mol_type = genomic DNA

SEQ ID NO: 47183 - DNA, 26 bp, Homo sapiens
  misc_feature 1..26: note = chr1:40137581-40137607
  misc_feature 1..26: note = hyper
  source 1..26: mol_type = genomic DNA
gggtttcttcttgggcgcgaggttgt

SEQ ID NO: 47184 - DNA, 83 bp, Homo sapiens; identical to SEQ ID NO: 26218
  misc_feature 1..83: note = chr1:40137646-40137729
  misc_feature 1..83: note = hyper
  source 1..83: mol_type = genomic DNA

SEQ ID NO: 47185 - DNA, 169 bp, Homo sapiens; identical to SEQ ID NO: 26219
  misc_feature 1..169: note = chr1:40157762-40157931
  misc_feature 1..169: note = hyper
  source 1..169: mol_type = genomic DNA

SEQ ID NO: 47186 - DNA, 30 bp, Homo sapiens; identical to SEQ ID NO: 26220
  misc_feature 1..30: note = chr1:40204397-40204427
  misc_feature 1..30: note = hyper
  source 1..30: mol_type = genomic DNA

SEQ ID NO: 47187 - DNA, 82 bp, Homo sapiens
  misc_feature 1..82: note = chr1:40237059-40237141
  misc_feature 1..82: note = hyper
  source 1..82: mol_type = genomic DNA
gctctaggctaggcccgcgacccgcaacagggagggggccggctccgccctgggctgggggcccccgagtcagtcctccgtg

SEQ ID NO: 47188 - DNA, 488 bp, Homo sapiens; identical to SEQ ID NO: 26222
  misc_feature 1..488: note = chr1:40781403-40781891
  misc_feature 1..488: note = hyper
  source 1..488: mol_type = genomic DNA

SEQ ID NO: 47189 - DNA, 150 bp, Homo sapiens; identical to SEQ ID NO: 26223
  misc_feature 1..150: note = chr1:40782758-40782908
  misc_feature 1..150: note = hyper
  source 1..150: mol_type = genomic DNA

SEQ ID NO: 47190 - DNA, 142 bp, Homo sapiens; identical to SEQ ID NO: 26224
  misc_feature 1..142: note = chr1:41267904-41268046
  misc_feature 1..142: note = hyper
  source 1..142: mol_type = genomic DNA

SEQ ID NO: 47191 - DNA, 190 bp, Homo sapiens
  misc_feature 1..190: note = chr1:41284463-41284653
  misc_feature 1..190: note = hyper
  source 1..190: mol_type = genomic DNA
tgtggcctgcgggggttggagccctagcaggaggcgaggtctaagcgggtggggcgaagtggattctgaattaggtaggggcgggcctaggagtccggaccggatcagggggcggggccggagaggcggggcttgagggtttcccctggatgcttctgggtttgaagggaccactcgtaccacaaagtgg

SEQ ID NO: 47192 - DNA, 73 bp, Homo sapiens; identical to SEQ ID NO: 26226
  misc_feature 1..73: note = chr1:41327007-41327080
  misc_feature 1..73: note = hyper
  source 1..73: mol_type = genomic DNA

SEQ ID NO: 47193 - DNA, 39 bp, Homo sapiens; identical to SEQ ID NO: 26227
  misc_feature 1..39: note = chr1:41350136-41350175
  misc_feature 1..39: note = hyper
  source 1..39: mol_type = genomic DNA

SEQ ID NO: 47194 - DNA, 92 bp, Homo sapiens; identical to SEQ ID NO: 26228
  misc_feature 1..92: note = chr1:41444864-41444956
  misc_feature 1..92: note = hyper
  source 1..92: mol_type = genomic DNA

SEQ ID NO: 47195 - DNA, 287 bp, Homo sapiens
  misc_feature 1..287: note = chr1:41847296-41847583
  misc_feature 1..287: note = hyper
  source 1..287: mol_type = genomic DNA
cggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgca

SEQ ID NO: 47196 - DNA, 251 bp, Homo sapiens
  misc_feature 1..251: note = chr1:41847702-41847953
  misc_feature 1..251: note = hyper
  source 1..251: mol_type = genomic DNA
tcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaa

SEQ ID NO: 47197 - DNA, 56 bp, Homo sapiens; identical to SEQ ID NO: 26230
  misc_feature 1..56: note = chr1:41848262-41848318
  misc_feature 1..56: note = hyper
  source 1..56: mol_type = genomic DNA

SEQ ID NO: 47198 - DNA, 33 bp, Homo sapiens; identical to SEQ ID NO: 26231
  misc_feature 1..33: note = chr1:41848943-41848976
  misc_feature 1..33: note = hyper
  source 1..33: mol_type = genomic DNA

SEQ ID NO: 47199 - DNA, 57 bp, Homo sapiens; identical to SEQ ID NO: 26232
  misc_feature 1..57: note = chr1:42128290-42128347
  misc_feature 1..57: note = hyper
  source 1..57: mol_type = genomic DNA

SEQ ID NO: 47200 - DNA, 11 bp, Homo sapiens
  misc_feature 1..11: note = chr1:43533901-43533912
  misc_feature 1..11: note = hyper
  source 1..11: mol_type = genomic DNA
ggtgtgcgccc

SEQ ID NO: 47201 - DNA, 131 bp, Homo sapiens; identical to SEQ ID NO: 26234
  misc_feature 1..131: note = chr1:43534114-43534245
  misc_feature 1..131: note = hyper
  source 1..131: mol_type = genomic DNA

SEQ ID NO: 47202 - DNA, 124 bp, Homo sapiens; identical to SEQ ID NO: 26235
  misc_feature 1..124: note = chr1:43613496-43613620
  misc_feature 1..124: note = hyper
  source 1..124: mol_type = genomic DNA

SEQ ID NO: 47203 - DNA, 156 bp, Homo sapiens; identical to SEQ ID NO: 26236
  misc_feature 1..156: note = chr1:44402104-44402260
  misc_feature 1..156: note = hyper
  source 1..156: mol_type = genomic DNA

SEQ ID NO: 47204 - DNA, 118 bp, Homo sapiens
  misc_feature 1..118: note = chr1:44873706-44873824
  misc_feature 1..118: note = hyper
  source 1..118: mol_type = genomic DNA
cccagagtattctatatacaaaggcaaccgagagccggagggagaggtcgggccaaagagtagtgggctcggctccgcgttgggcccaagtttatgtaggtttcgccttcacctcttc

SEQ ID NO: 47205 - DNA, 52 bp, Homo sapiens
  misc_feature 1..52: note = chr1:44883069-44883121
  misc_feature 1..52: note = hyper
  source 1..52: mol_type = genomic DNA
tggggccaggctggacgggagcagtccctgatggctgcagagccatctggcc

SEQ ID NO: 47206 - DNA, 154 bp, Homo sapiens; identical to SEQ ID NO: 26243
  misc_feature 1..154: note = chr1:45250008-45250162
  misc_feature 1..154: note = hyper
  source 1..154: mol_type = genomic DNA

SEQ ID NO: 47207 - DNA, 173 bp, Homo sapiens; identical to SEQ ID NO: 26244
  misc_feature 1..173: note = chr1:45250192-45250365
  misc_feature 1..173: note = hyper
  source 1..173: mol_type = genomic DNA

SEQ ID NO: 47208 - DNA, 330 bp, Homo sapiens; identical to SEQ ID NO: 26245
  misc_feature 1..330: note = chr1:45251926-45252256
  misc_feature 1..330: note = hyper
  source 1..330: mol_type = genomic DNA

SEQ ID NO: 47209 - DNA, 155 bp, Homo sapiens
  misc_feature 1..155: note = chr1:46632721-46632876
  misc_feature 1..155: note = hyper
  source 1..155: mol_type = genomic DNA
cgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgcttt

SEQ ID NO: 47210 - DNA, 49 bp, Homo sapiens
  misc_feature 1..49: note = chr1:46632923-46632972
  misc_feature 1..49: note = hyper
  source 1..49: mol_type = genomic DNA
gcagccgcgagaaggctagctgctgccaaagctccgaagctctggatgt

SEQ ID NO: 47211 - DNA, 42 bp, Homo sapiens; identical to SEQ ID NO: 26247
  misc_feature 1..42: note = chr1:46859934-46859976
  misc_feature 1..42: note = hyper
  source 1..42: mol_type = genomic DNA

SEQ ID NO: 47212 - DNA, 51 bp, Homo sapiens
  misc_feature 1..51: note = chr1:46913786-46913837
  misc_feature 1..51: note = hyper
  source 1..51: mol_type = genomic DNA
cgcccgcattcagttcgaaggaccagccagtaggccctgcgccgcccaggg

SEQ ID NO: 47213 - DNA, 148 bp, Homo sapiens; identical to SEQ ID NO: 26250
  misc_feature 1..148: note = chr1:46914285-46914433
  misc_feature 1..148: note = hyper
  source 1..148: mol_type = genomic DNA

SEQ ID NO: 47214 - DNA, 21 bp, Homo sapiens
  misc_feature 1..21: note = chr1:46951186-46951207
  misc_feature 1..21: note = hyper
  source 1..21: mol_type = genomic DNA
gtgaaggggagtagccgtcgg

SEQ ID NO: 47215 - DNA, 23 bp, Homo sapiens
  misc_feature 1..23: note = chr1:46951739-46951762
  misc_feature 1..23: note = hyper
  source 1..23: mol_type = genomic DNA
agggcggccgcatggggcattcg

SEQ ID NO: 47216 - DNA, 194 bp, Homo sapiens
  misc_feature 1..194: note = chr1:46956260-46956454
  misc_feature 1..194: note = hyper
  source 1..194: mol_type = genomic DNA
aaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttca

SEQ ID NO: 47217 - DNA, 13 bp, Homo sapiens
  misc_feature 1..13: note = chr1:46956603-46956616
  misc_feature 1..13: note = hyper
  source 1..13: mol_type = genomic DNA
agtcaaagggttg

SEQ ID NO: 47218 - DNA, 139 bp, Homo sapiens; identical to SEQ ID NO: 17001
  misc_feature 1..139: note = chr1:46956684-46956823
  misc_feature 1..139: note = hyper
  source 1..139: mol_type = genomic DNA

SEQ ID NO: 47219 - DNA, 437 bp, Homo sapiens; identical to SEQ ID NO: 26256
  misc_feature 1..437: note = chr1:47009449-47009886
  misc_feature 1..437: note = hyper
  source 1..437: mol_type = genomic DNA

SEQ ID NO: 47220 - DNA, 19 bp, Homo sapiens
  misc_feature 1..19: note = chr1:47009910-47009929
  misc_feature 1..19: note = hyper
  source 1..19: mol_type = genomic DNA
cgcctcccgccacccggaa

SEQ ID NO: 47221 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 47222 - DNA, 35 bp, Homo sapiens; identical to SEQ ID NO: 26259
  misc_feature 1..35: note = chr1:47691684-47691719
  misc_feature 1..35: note = hyper
  source 1..35: mol_type = genomic DNA

SEQ ID NO: 47223 - DNA, 101 bp, Homo sapiens; identical to SEQ ID NO: 26260
  misc_feature 1..101: note = chr1:47694827-47694928
  misc_feature 1..101: note = hyper
  source 1..101: mol_type = genomic DNA

SEQ ID NO: 47224 - DNA, 143 bp, Homo sapiens
  misc_feature 1..143: note = chr1:47694979-47695122
  misc_feature 1..143: note = hyper
  source 1..143: mol_type = genomic DNA
cgctgagaggcctgcagttacgctgcggtgtggtcctgggcgatctgccgcgcccaaagcgagtttccaggaaagataggggtggagagaaagaggcagggcaagagggagggagagagagaaatgggggtcaatggctggga

SEQ ID NO: 47225 - DNA, 164 bp, Homo sapiens
  misc_feature 1..164: note = chr1:47695422-47695586
  misc_feature 1..164: note = hyper
  source 1..164: mol_type = genomic DNA
cgcgaagggatagtcccgggcctggatgggcggaggtccgtgttgggaaaggcgaatagtcttcagactctggtcggtgggacagaaccttgaagtcccccccacctcattctctctctgacccccatccacccacctccagcccaaagcgaaaccagaaccca

SEQ ID NO: 47226 - DNA, 399 bp, Homo sapiens
  misc_feature 1..399: note = chr1:47695896-47696295
  misc_feature 1..399: note = hyper
  source 1..399: mol_type = genomic DNA
aggtaaaaacaaacccgacactactttcaaggatgtagcaggattgagcttgcttttattttttcctagtggattttgtttaatttgttttgcctaaatcgtcaggcttatgatcacacatcgaagtcttggattaactgcgaaggcctccttctatttgccgcggctttggtggacatataggaataattcttccctggattgcaatacaatgcggaagattttctttctcctcttctaatccaaaagaggggaggggaggaaagaagaggggaatccatccattcccggcgtgttcgcggggggttaatgttgcgtgttcgctgggggttaatgtttgccttatgaccaagtctctgtgtccgtgcctctctccattttctcttcctacctcaaacc

SEQ ID NO: 47227 - DNA, 201 bp, Homo sapiens; identical to SEQ ID NO: 17006
  misc_feature 1..201: note = chr1:47696620-47696821
  misc_feature 1..201: note = hyper
  source 1..201: mol_type = genomic DNA

SEQ ID NO: 47228 - DNA, 15 bp, Homo sapiens
  misc_feature 1..15: note = chr1:47697341-47697356
  misc_feature 1..15: note = hyper
  source 1..15: mol_type = genomic DNA
tgctgagaacaccaa

SEQ ID NO: 47229 - DNA, 222 bp, Homo sapiens; identical to SEQ ID NO: 17008
  misc_feature 1..222: note = chr1:47697510-47697732
  misc_feature 1..222: note = hyper
  source 1..222: mol_type = genomic DNA

SEQ ID NO: 47230 - DNA, 30 bp, Homo sapiens
  misc_feature 1..30: note = chr1:47882033-47882063
  misc_feature 1..30: note = hyper
  source 1..30: mol_type = genomic DNA
tccctgccctgccagcggtcgcgccgtcgg

SEQ ID NO: 47231 - DNA, 16 bp, Homo sapiens
  misc_feature 1..16: note = chr1:47882322-47882338
  misc_feature 1..16: note = hyper
  source 1..16: mol_type = genomic DNA
gcgcaagtggcagaac

SEQ ID NO: 47232 - DNA, 10 bp, Homo sapiens
  misc_feature 1..10: note = chr1:47882759-47882769
  misc_feature 1..10: note = hyper
  source 1..10: mol_type = genomic DNA
ccccgccact

SEQ ID NO: 47233 - DNA, 32 bp, Homo sapiens
  misc_feature 1..32: note = chr1:47882803-47882835
  misc_feature 1..32: note = hyper
  source 1..32: mol_type = genomic DNA
gcgacgcgccccggccccggcccgctgcccgc

SEQ ID NO: 47234 - DNA, 55 bp, Homo sapiens; identical to SEQ ID NO: 26270
  misc_feature 1..55: note = chr1:47904617-47904672
  misc_feature 1..55: note = hyper
  source 1..55: mol_type = genomic DNA

SEQ ID NO: 47235 - DNA, 183 bp, Homo sapiens
  misc_feature 1..183: note = chr1:47909535-47909718
  misc_feature 1..183: note = hyper
  source 1..183: mol_type = genomic DNA
gagttgaggtgggggcggacacttcccctccatatccaatttgctcttgccacagcgggcgcgtcttcgtggttacaaagcgctttttccctgatgacttttttccccttttcaaaaacacttctttctccccccttcaactagcaaccctccccaggcccacccctcctccctctccgctcc

SEQ ID NO: 47236 - DNA, 15 bp, Homo sapiens
  misc_feature 1..15: note = chr1:47910508-47910523
  misc_feature 1..15: note = hyper
  source 1..15: mol_type = genomic DNA
cgcctccttccgtag

SEQ ID NO: 47237 - DNA, 132 bp, Homo sapiens
  misc_feature 1..132: note = chr1:48058946-48059078
  misc_feature 1..132: note = hyper
  source 1..132: mol_type = genomic DNA
cgccgccgccagcccggggctgacctctcagagcagggcggaggattttcacagcacagcttcccgagagagcgggattaagggggaactgctcgggtgggccagagccaggggctagggggaggccgggcg

SEQ ID NO: 47238 - DNA, 63 bp, Homo sapiens
  misc_feature 1..63: note = chr1:48059243-48059306
  misc_feature 1..63: note = hyper
  source 1..63: mol_type = genomic DNA
ggtggggctcagtctgtctctcgttttctctccctgtttctaagatctcgtggaatcaaagac

SEQ ID NO: 47239 - DNA, 188 bp, Homo sapiens; identical to SEQ ID NO: 26275
  misc_feature 1..188: note = chr1:48190874-48191062
  misc_feature 1..188: note = hyper
  source 1..188: mol_type = genomic DNA

SEQ ID NO: 47240 - DNA, 310 bp, Homo sapiens; identical to SEQ ID NO: 26276
  misc_feature 1..310: note = chr1:48462159-48462469
  misc_feature 1..310: note = hyper
  source 1..310: mol_type = genomic DNA

SEQ ID NO: 47241 - DNA, 10 bp, Homo sapiens
  misc_feature 1..10: note = chr1:49242334-49242344
  misc_feature 1..10: note = hyper
  source 1..10: mol_type = genomic DNA
cgcgcggggg

SEQ ID NO: 47242 - DNA, 64 bp, Homo sapiens; identical to SEQ ID NO: 5472
  misc_feature 1..64: note = chr1:49242884-49242948
  misc_feature 1..64: note = hyper
  source 1..64: mol_type = genomic DNA

SEQ ID NO: 47243 - DNA, 60 bp, Homo sapiens; identical to SEQ ID NO: 26281
  misc_feature 1..60: note = chr1:50489576-50489636
  misc_feature 1..60: note = hyper
  source 1..60: mol_type = genomic DNA

SEQ ID NO: 47244 - DNA, 457 bp, Homo sapiens
  misc_feature 1..457: note = chr1:50513745-50514202
  misc_feature 1..457: note = hyper
  source 1..457: mol_type = genomic DNA
gagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcg

SEQ ID NO: 47245 - DNA, 626 bp, Homo sapiens; identical to SEQ ID NO: 17019
  misc_feature 1..626: note = chr1:50798652-50799278
  misc_feature 1..626: note = hyper
  source 1..626: mol_type = genomic DNA

SEQ ID NO: 47246 - DNA, 214 bp, Homo sapiens
  misc_feature 1..214: note = chr1:50799400-50799614
  misc_feature 1..214: note = hyper
  source 1..214: mol_type = genomic DNA
agccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcc

SEQ ID NO: 47247 - DNA, 15 bp, Homo sapiens
  misc_feature 1..15: note = chr1:50881302-50881317
  misc_feature 1..15: note = hyper
  source 1..15: mol_type = genomic DNA
cattgcaggtctctg

SEQ ID NO: 47248 - DNA, 23 bp, Homo sapiens
  misc_feature 1..23: note = chr1:50882529-50882552
  misc_feature 1..23: note = hyper
  source 1..23: mol_type = genomic DNA
gcggggagcgggagggactggag

SEQ ID NO: 47249 - DNA, 42 bp, Homo sapiens
  misc_feature 1..42: note = chr1:50882766-50882808
  misc_feature 1..42: note = hyper
  source 1..42: mol_type = genomic DNA
gccaccctgcccagccgtcgccttcgttgcctgtggttccaa

SEQ ID NO: 47250 - DNA, 271 bp, Homo sapiens
  misc_feature 1..271: note = chr1:50883611-50883882
  misc_feature 1..271: note = hyper
  source 1..271: mol_type = genomic DNA
attacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaat

SEQ ID NO: 47251 - DNA, 88 bp, Homo sapiens
  misc_feature 1..88: note = chr1:50885248-50885336
  misc_feature 1..88: note = hyper
  source 1..88: mol_type = genomic DNA
cgagcctgagccgggccgcacctctggggacgacgtcccgggccccgagtctgcgccgtcgggtgataagggcttcaccggcggcggc

SEQ ID NO: 47252 - DNA, 76 bp, Homo sapiens
  misc_feature 1..76: note = chr1:50885366-50885442
  misc_feature 1..76: note = hyper
  source 1..76: mol_type = genomic DNA
agcgtcttaggaaacaggtcaaacttctgcaacttggcctctgggaggggagaaaacgtgtcgtgaggagcggtta

SEQ ID NO: 47253 - DNA, 133 bp, Homo sapiens
  misc_feature 1..133: note = chr1:50886055-50886188
  misc_feature 1..133: note = hyper
  source 1..133: mol_type = genomic DNA
gcaggcagtaggaagcgaagaggaaaagacataggaaagcagacctgagaaaccagggagggtgcggaagaaactagaaggagggagggcgcagcaagcggttgtccagagggcgttaggaacgcgagaaggg

SEQ ID NO: 47254 - DNA, 30 bp, Homo sapiens; identical to SEQ ID NO: 26294
  misc_feature 1..30: note = chr1:50887723-50887753
  misc_feature 1..30: note = hyper
  source 1..30: mol_type = genomic DNA

SEQ ID NO: 47255 - DNA, 478 bp, Homo sapiens
  misc_feature 1..478: note = chr1:50888231-50888709
  misc_feature 1..478: note = hyper
  source 1..478: mol_type = genomic DNA
gagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggccca

SEQ ID NO: 47256 - DNA, 310 bp, Homo sapiens; identical to SEQ ID NO: 17024
  misc_feature 1..310: note = chr1:50889510-50889820
  misc_feature 1..310: note = hyper
  source 1..310: mol_type = genomic DNA

SEQ ID NO: 47257 - DNA, 20 bp, Homo sapiens
  misc_feature 1..20: note = chr1:50890629-50890649
  misc_feature 1..20: note = hyper
  source 1..20: mol_type = genomic DNA
cgcgcagactcggcccgggt

SEQ ID NO: 47258 - DNA, 256 bp, Homo sapiens; identical to SEQ ID NO: 17025
  misc_feature 1..256: note = chr1:50892351-50892607
  misc_feature 1..256: note = hyper
  source 1..256: mol_type = genomic DNA

SEQ ID NO: 47259 - DNA, 113 bp, Homo sapiens; identical to SEQ ID NO: 26304
  misc_feature 1..113: note = chr1:50896073-50896186
  misc_feature 1..113: note = hyper
  source 1..113: mol_type = genomic DNA

SEQ ID NO: 47260 - DNA, 30 bp, Homo sapiens; identical to SEQ ID NO: 26305
  misc_feature 1..30: note = chr1:51442776-51442806
  misc_feature 1..30: note = hyper
  source 1..30: mol_type = genomic DNA

SEQ ID NO: 47261 - DNA, 46 bp, Homo sapiens; identical to SEQ ID NO: 26306
  misc_feature 1..46: note = chr1:52456259-52456305
  misc_feature 1..46: note = hyper
  source 1..46: mol_type = genomic DNA

SEQ ID NO: 47262 - DNA, 288 bp, Homo sapiens
  misc_feature 1..288: note = chr1:53067878-53068166
  misc_feature 1..288: note = hyper
  source 1..288: mol_type = genomic DNA
tccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttca

SEQ ID NO: 47263 - DNA, 99 bp, Homo sapiens
  misc_feature 1..99: note = chr1:53068546-53068645
  misc_feature 1..99: note = hyper
  source 1..99: mol_type = genomic DNA
agcctttgccattcacgggtgaaaaaagtaaccgtagcatcgtgcggcctttccctctcccgtcctcattttctgcatctggaacggggagtggctgat

SEQ ID NO: 47264 - DNA, 159 bp, Homo sapiens
  misc_feature 1..159: note = chr1:53098683-53098842
  misc_feature 1..159: note = hyper
  source 1..159: mol_type = genomic DNA
cgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcaga

SEQ ID NO: 47265 - DNA, 299 bp, Homo sapiens; identical to SEQ ID NO: 17027
  misc_feature 1..299: note = chr1:53099067-53099366
  misc_feature 1..299: note = hyper
  source 1..299: mol_type = genomic DNA

SEQ ID NO: 47266 - DNA, 352 bp, Homo sapiens; identical to SEQ ID NO: 26311
  misc_feature 1..352: note = chr1:53168843-53169195
  misc_feature 1..352: note = hyper
  source 1..352: mol_type = genomic DNA

SEQ ID NO: 47267 - DNA, 236 bp, Homo sapiens
  misc_feature 1..236: note = chr1:53308332-53308568
  misc_feature 1..236: note = hyper
  source 1..236: mol_type = genomic DNA
ggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttct

SEQ ID NO: 47268 - DNA, 27 bp, Homo sapiens
  misc_feature 1..27: note = chr1:53309248-53309275
  misc_feature 1..27: note = hyper
  source 1..27: mol_type = genomic DNA
cccagcctttgccgaatgcctgttact

SEQ ID NO: 47269 - DNA, 49 bp, Homo sapiens; identical to SEQ ID NO: 26314
  misc_feature 1..49: note = chr1:53527557-53527606
  misc_feature 1..49: note = hyper
  source 1..49: mol_type = genomic DNA

SEQ ID NO: 47270 - DNA, 92 bp, Homo sapiens; identical to SEQ ID NO: 5507
  misc_feature 1..92: note = chr1:53527939-53528031
  misc_feature 1..92: note = hyper
  source 1..92: mol_type = genomic DNA

SEQ ID NO: 47271 - DNA, 119 bp, Homo sapiens; identical to SEQ ID NO: 17033
  misc_feature 1..119: note = chr1:53528255-53528374
  misc_feature 1..119: note = hyper
  source 1..119: mol_type = genomic DNA

SEQ ID NO: 47272 - DNA, 30 bp, Homo sapiens; identical to SEQ ID NO: 26317
  misc_feature 1..30: note = chr1:53528728-53528758
  misc_feature 1..30: note = hyper
  source 1..30: mol_type = genomic DNA

SEQ ID NO: 47273 - DNA, 267 bp, Homo sapiens
  misc_feature 1..267: note = chr1:54204399-54204666
  misc_feature 1..267: note = hyper
  source 1..267: mol_type = genomic DNA
cctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgc

SEQ ID NO: 47274 - DNA, 168 bp, Homo sapiens; identical to SEQ ID NO: 26319
  misc_feature 1..168: note = chr1:54940331-54940499
  misc_feature 1..168: note = hyper
  source 1..168: mol_type = genomic DNA

SEQ ID NO: 47275 - DNA, 224 bp, Homo sapiens
  misc_feature 1..224: note = chr1:55462703-55462927
  misc_feature 1..224: note = hyper
  source 1..224: mol_type = genomic DNA
cgccgactcagccgagggagaccttggccagcccctgccactccgcaggctcggtttcctcgcctgtgaaatgcgggcgatgactcccctccccgccgcgactgctcatcaccgggtccgagcccagccgctgaccccgggggaagcgccttgctcagcgccgggcggcccacgaggccctgcaggaccgcggctgcggagaccgttcccgccacccgcctggg

SEQ ID NO: 47276 - DNA, 89 bp, Homo sapiens; identical to SEQ ID NO: 26321
  misc_feature 1..89: note = chr1:55505073-55505162
  misc_feature 1..89: note = hyper
  source 1..89: mol_type = genomic DNA

SEQ ID NO: 47277 - DNA, 30 bp, Homo sapiens; identical to SEQ ID NO: 26322
  misc_feature 1..30: note = chr1:55505516-55505546
  misc_feature 1..30: note = hyper
  source 1..30: mol_type = genomic DNA

SEQ ID NO: 47278 - DNA, 522 bp, Homo sapiens; identical to SEQ ID NO: 26323
  misc_feature 1..522: note = chr1:57110923-57111445
  misc_feature 1..522: note = hyper
  source 1..522: mol_type = genomic DNA

SEQ ID NO: 47279 - DNA, 36 bp, Homo sapiens; identical to SEQ ID NO: 26324
  misc_feature 1..36: note = chr1:57888031-57888067
  misc_feature 1..36: note = hyper
  source 1..36: mol_type = genomic DNA

SEQ ID NO: 47280 - DNA, 40 bp, Homo sapiens; identical to SEQ ID NO: 17036
  misc_feature 1..40: note = chr1:57888327-57888367
  misc_feature 1..40: note = hyper
  source 1..40: mol_type = genomic DNA

SEQ ID NO: 47281 - DNA, 207 bp, Homo sapiens; identical to SEQ ID NO: 17037
  misc_feature 1..207: note = chr1:57888780-57888987
  misc_feature 1..207: note = hyper
  source 1..207: mol_type = genomic DNA

SEQ ID NO: 47282 - DNA, 315 bp, Homo sapiens
  misc_feature 1..315: note = chr1:57889087-57889402
  misc_feature 1..315: note = hyper
  source 1..315: mol_type = genomic DNA
tcgaagccgaatctcagcgctacggaggagtagggaagtgagaacggggttcggccgaatgaggaaaagggtctggccaccagcgagggagggagggagtttcgggagcccaggacagcgggagaaggcaggctcgaggtccgatatagccaggaccgcaggaggaaagagggcgcagggggtcttggagagagacgcgtgtcaggggtggacaagtctggagacaggatcgcgcgtggtcggaagtagggagacaggggcgcggggatggggggcaggacagagaaagagaagtcgcccttttcctcccagcaa

SEQ ID NO: 47283 - DNA, 378 bp, Homo sapiens
  misc_feature 1..378: note = chr1:57889654-57890032
  misc_feature 1..378: note = hyper
  source 1..378: mol_type = genomic DNA
tccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgg

SEQ ID NO: 47284 - DNA, 173 bp, Homo sapiens
  misc_feature 1..173: note = chr1:57890258-57890431
  misc_feature 1..173: note = hyper
  source 1..173: mol_type = genomic DNA
cttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggt

SEQ ID NO: 47285 - DNA, 133 bp, Homo sapiens
  misc_feature 1..133: note = chr1:58715194-58715327
  misc_feature 1..133: note = hyper
  source 1..133: mol_type = genomic DNA
tacagtctttgggtaagacccctggccagcttgcctggtttctagatacataagtggacagaaaagaaatgaagagaacgcggactgagcgaggaaatgctcaagaccacaggactgaaccccccggaagtct

SEQ ID NO: 47286 - DNA, 116 bp, Homo sapiens
  misc_feature 1..116: note = chr1:58715359-58715475
  misc_feature 1..116: note = hyper
  source 1..116: mol_type = genomic DNA
cgacgcggatgaagttgtttccccgggacaggaagggttaaatggctgcgcgtcaactcggcctcgactggggtgtcagggagcaagagccgcttgtctcgggggattccgcttgg

SEQ ID NO: 47287 - DNA, 253 bp, Homo sapiens
  misc_feature 1..253: note = chr1:58715993-58716246
  misc_feature 1..253: note = hyper
  source 1..253: mol_type = genomic DNA
tttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagccc

SEQ ID NO: 47288 - DNA, 430 bp, Homo sapiens; identical to SEQ ID NO: 26334
  misc_feature 1..430: note = chr1:59042065-59042495
  misc_feature 1..430: note = hyper
  source 1..430: mol_type = genomic DNA

SEQ ID NO: 47289 - DNA, 271 bp, Homo sapiens; identical to SEQ ID NO: 26335
  misc_feature 1..271: note = chr1:59612368-59612639
  misc_feature 1..271: note = hyper
  source 1..271: mol_type = genomic DNA

SEQ ID NO: 47290 - DNA, 259 bp, Homo sapiens; identical to SEQ ID NO: 26336
  misc_feature 1..259: note = chr1:61508695-61508954
  misc_feature 1..259: note = hyper
  source 1..259: mol_type = genomic DNA

SEQ ID NO: 47291 - DNA, 44 bp, Homo sapiens; identical to SEQ ID NO: 26337
  misc_feature 1..44: note = chr1:61519551-61519595
  misc_feature 1..44: note = hyper
  source 1..44: mol_type = genomic DNA

SEQ ID NO: 47292 - DNA, 102 bp, Homo sapiens; identical to SEQ ID NO: 26338
  misc_feature 1..102: note = chr1:61549208-61549310
  misc_feature 1..102: note = hyper
  source 1..102: mol_type = genomic DNA

SEQ ID NO: 47293 - DNA, 248 bp, Homo sapiens; identical to SEQ ID NO: 26339
  misc_feature 1..248: note = chr1:62784355-62784603
  misc_feature 1..248: note = hyper
  source 1..248: mol_type = genomic DNA

SEQ ID NO: 47294 - DNA, 276 bp, Homo sapiens; identical to SEQ ID NO: 26340
  misc_feature 1..276: note = chr1:62784870-62785146
  misc_feature 1..276: note = hyper
  source 1..276: mol_type = genomic DNA

SEQ ID NO: 47295 - DNA, 94 bp, Homo sapiens
  misc_feature 1..94: note = chr1:63539887-63539981
  misc_feature 1..94: note = hyper
  source 1..94: mol_type = genomic DNA
gagatctctgctgctctctggaggtgagaaaccgcgcatctgaatgccgagggaagaggcgctgagcagccagggcaaacggagcaacaatctg

SEQ ID NO: 47296 - DNA, 168 bp, Homo sapiens; identical to SEQ ID NO: 26342
  misc_feature 1..168: note = chr1:63784272-63784440
  misc_feature 1..168: note = hyper
  source 1..168: mol_type = genomic DNA

SEQ ID NO: 47297 - DNA, 50 bp, Homo sapiens; identical to SEQ ID NO: 26343
  misc_feature 1..50: note = chr1:63784732-63784782
  misc_feature 1..50: note = hyper
  source 1..50: mol_type = genomic DNA

SEQ ID NO: 47298 - DNA, 306 bp, Homo sapiens; identical to SEQ ID NO: 56
  misc_feature 1..306: note = chr1:63784987-63785293
  misc_feature 1..306: note = hyper
  source 1..306: mol_type = genomic DNA

SEQ ID NO: 47299 - DNA, 375 bp, Homo sapiens
  misc_feature 1..375: note = chr1:63786656-63787031
  misc_feature 1..375: note = hyper
  source 1..375: mol_type = genomic DNA
gcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactg

SEQ ID NO: 47300 - DNA, 186 bp, Homo sapiens
  misc_feature 1..186: note = chr1:63787063-63787249
  misc_feature 1..186: note = hyper
  source 1..186: mol_type = genomic DNA
catcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcc

SEQ ID NO: 47301 - DNA, 20 bp, Homo sapiens
  misc_feature 1..20: note = chr1:63787282-63787302
  misc_feature 1..20: note = hyper
  source 1..20: mol_type = genomic DNA
cgctgcgtctaacctgaaga

SEQ ID NO: 47302 - DNA, 42 bp, Homo sapiens; identical to SEQ ID NO: 17047
  misc_feature 1..42: note = chr1:63787568-63787610
  misc_feature 1..42: note = hyper
  source 1..42: mol_type = genomic DNA

SEQ ID NO: 47303 - DNA, 290 bp, Homo sapiens
  misc_feature 1..290: note = chr1:63788133-63788423
  misc_feature 1..290: note = hyper
  source 1..290: mol_type = genomic DNA
caacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgaggggg

SEQ ID NO: 47304 - DNA, 210 bp, Homo sapiens
  misc_feature 1..210: note = chr1:63788557-63788767
  misc_feature 1..210: note = hyper
  source 1..210: mol_type = genomic DNA
gagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtc

SEQ ID NO: 47305 - DNA, 12 bp, Homo sapiens
  misc_feature 1..12: note = chr1:63792549-63792561
  misc_feature 1..12: note = hyper
  source 1..12: mol_type = genomic DNA
acttataaaatt

SEQ ID NO: 47306 - DNA, 156 bp, Homo sapiens; identical to SEQ ID NO: 26356
  misc_feature 1..156: note = chr1:63793435-63793591
  misc_feature 1..156: note = hyper
  source 1..156: mol_type = genomic DNA

SEQ ID NO: 47307 - DNA, 221 bp, Homo sapiens
  misc_feature 1..221: note = chr1:63796277-63796498
  misc_feature 1..221: note = hyper
  source 1..221: mol_type = genomic DNA
acagggagctctcttgtcagccccagaacaaccctaaactccaaatgttctgtttgctctcgaggtacccctgggatgcagcgtctcctccgcgaagccttcctgagcctccctgcccagaccagttgctccttcttgaagctcaccgtgccaattaatgagccattgtcattagtgttgccctctgagttcctggtgagttcctgaccgtctagcattgc

SEQ ID NO: 47308 - DNA, 28 bp, Homo sapiens
  misc_feature 1..28: note = chr1:64240118-64240146
  misc_feature 1..28: note = hyper
  source 1..28: mol_type = genomic DNA
ccgccgctcctggcgctgctggccgcgc

SEQ ID NO: 47309 - DNA, 26 bp, Homo sapiens
  misc_feature 1..26: note = chr1:64240532-64240558
  misc_feature 1..26: note = hyper
  source 1..26: mol_type = genomic DNA
cgcgccccagccggtgttcaggcaag

SEQ ID NO: 47310 - DNA, 30 bp, Homo sapiens; identical to SEQ ID NO: 26361
  misc_feature 1..30: note = chr1:65468348-65468378
  misc_feature 1..30: note = hyper
  source 1..30: mol_type = genomic DNA

SEQ ID NO: 47311 - DNA, 41 bp, Homo sapiens; identical to SEQ ID NO: 26362
  misc_feature 1..41: note = chr1:65468581-65468622
  misc_feature 1..41: note = hyper
  source 1..41: mol_type = genomic DNA

SEQ ID NO: 47312 - DNA, 106 bp, Homo sapiens; identical to SEQ ID NO: 17050
  misc_feature 1..106: note = chr1:65731231-65731337
  misc_feature 1..106: note = hyper
  source 1..106: mol_type = genomic DNA

SEQ ID NO: 47313 - DNA, 60 bp, Homo sapiens; identical to SEQ ID NO: 17051
  misc_feature 1..60: note = chr1:65731446-65731506
  misc_feature 1..60: note = hyper
  source 1..60: mol_type = genomic DNA

SEQ ID NO: 47314 - DNA, 14 bp, Homo sapiens
  misc_feature 1..14: note = chr1:65731781-65731795
  misc_feature 1..14: note = hyper
  source 1..14: mol_type = genomic DNA
ggagctaagttctt

SEQ ID NO: 47315 - DNA, 327 bp, Homo sapiens
  misc_feature 1..327: note = chr1:65991119-65991446
  misc_feature 1..327: note = hyper
  source 1..327: mol_type = genomic DNA
cgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccg

SEQ ID NO: 47316 - DNA, 58 bp, Homo sapiens
  misc_feature 1..58: note = chr1:66258774-66258832
  misc_feature 1..58: note = hyper
  source 1..58: mol_type = genomic DNA
ctttcgtcccccacccccgggagcgcggaaggctcactcgcagcgcatggtctacccg

SEQ ID NO: 47317 - DNA, 20 bp, Homo sapiens
  misc_feature 1..20: note = chr1:66259117-66259137
  misc_feature 1..20: note = hyper
  source 1..20: mol_type = genomic DNA
cggcccctagcctttcgccc

SEQ ID NO: 47318 - DNA, 257 bp, Homo sapiens
  misc_feature 1..257: note = chr1:66259174-66259431
  misc_feature 1..257: note = hyper
  source 1..257: mol_type = genomic DNA
tgacaagtcactggggaggagaggatggagagaggctaagggagaatggagagaggcagaaggattcagggcttggaagccctggagtaggtgacggatgggcgcgcggtgcccagtgattgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 47319 - DNA, 81 bp, Homo sapiens
  misc_feature 1..81: note = chr1:66999332-66999413
  misc_feature 1..81: note = hyper
  source 1..81: mol_type = genomic DNA
ctgacatttggaattccttcagggtaaaaggacaccggaatgggagcttagaagtgtgttgctaagatttccggctgcacg

SEQ ID NO: 47320 - DNA, 142 bp, Homo sapiens; identical to SEQ ID NO: 26373
  misc_feature 1..142: note = chr1:66999473-66999615
  misc_feature 1..142: note = hyper
  source 1..142: mol_type = genomic DNA

SEQ ID NO: 47321 - DNA, 99 bp, Homo sapiens; identical to SEQ ID NO: 17055
  misc_feature 1..99: note = chr1:67217965-67218064
  misc_feature 1..99: note = hyper
  source 1..99: mol_type = genomic DNA

SEQ ID NO: 47322 - DNA, 25 bp, Homo sapiens
  misc_feature 1..25: note = chr1:67773134-67773159
  misc_feature 1..25: note = hyper
  source 1..25: mol_type = genomic DNA
cacacgattttatcgcgcctatcat

SEQ ID NO: 47323 - DNA, 30 bp, Homo sapiens; identical to SEQ ID NO: 26376
  misc_feature 1..30: note = chr1:68696775-68696805
  misc_feature 1..30: note = hyper
  source 1..30: mol_type = genomic DNA

SEQ ID NO: 47324 - DNA, 128 bp, Homo sapiens; identical to SEQ ID NO: 26377
  misc_feature 1..128: note = chr1:70032971-70033099
  misc_feature 1..128: note = hyper
  source 1..128: mol_type = genomic DNA

SEQ ID NO: 47325 - DNA, 106 bp, Homo sapiens
  misc_feature 1..106: note = chr1:70033503-70033609
  misc_feature 1..106: note = hyper
  source 1..106: mol_type = genomic DNA
agctgcagctggtgtcgtcggaaaagggggtgggaaaaaagagagggggcggggagagcggtgagacacagccaagagccatgagcggcgcctcctcgcctgccaa

SEQ ID NO: 47326 - DNA, 511 bp, Homo sapiens
  misc_feature 1..511: note = chr1:70033948-70034459
  misc_feature 1..511: note = hyper
  source 1..511: mol_type = genomic DNA
ctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgc

SEQ ID NO: 47327 - DNA, 701 bp, Homo sapiens; identical to SEQ ID NO: 26383
  misc_feature 1..701: note = chr1:71513046-71513747
  misc_feature 1..701: note = hyper
  source 1..701: mol_type = genomic DNA

SEQ ID NO: 47328 - DNA, 76 bp, Homo sapiens; identical to SEQ ID NO: 5555
  misc_feature 1..76: note = chr1:72747951-72748027
  misc_feature 1..76: note = hyper
  source 1..76: mol_type = genomic DNA

SEQ ID NO: 47329 - DNA, 67 bp, Homo sapiens; identical to SEQ ID NO: 26385
  misc_feature 1..67: note = chr1:72749731-72749798
  misc_feature 1..67: note = hyper
  source 1..67: mol_type = genomic DNA

SEQ ID NO: 47330 - DNA, 481 bp, Homo sapiens; identical to SEQ ID NO: 26386
  misc_feature 1..481: note = chr1:72750097-72750578
  misc_feature 1..481: note = hyper
  source 1..481: mol_type = genomic DNA

SEQ ID NO: 47331 - DNA, 15 bp, Homo sapiens
  misc_feature 1..15: note = chr1:75594000-75594015
  misc_feature 1..15: note = hyper
  source 1..15: mol_type = genomic DNA
cgtggccgttttatt

SEQ ID NO: 47332 - DNA, 127 bp, Homo sapiens; identical to SEQ ID NO: 26388
  misc_feature 1..127: note = chr1:75595334-75595461
  misc_feature 1..127: note = hyper
  source 1..127: mol_type = genomic DNA

SEQ ID NO: 47333 - DNA, 205 bp, Homo sapiens
  misc_feature 1..205: note = chr1:75598179-75598384
  misc_feature 1..205: note = hyper
  source 1..205: mol_type = genomic DNA
cccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgc

SEQ ID NO: 47334 - DNA, 303 bp, Homo sapiens
  misc_feature 1..303: note = chr1:75598414-75598717
  misc_feature 1..303: note = hyper
  source 1..303: mol_type = genomic DNA
agtaccccagattcactttaaaccctaacacacacacacacacacacacacacacacactgtaattaaatatccaaaccggacctttatgtttaattccactttcaacgaaatcctgctctatacacgacctgatggcgccaatgttctgcacgactctgactttccattcggaagagcggtctccacaacgatgctatttcatggaaaatgcattatgtgaatttctccaccacccccaataccgatttctgcatttgatgaaaaacacaagtctttctggttcccacgcacaagttagctt

SEQ ID NO: 47335 - DNA, 40 bp, Homo sapiens
  misc_feature 1..40: note = chr1:75599387-75599427
  misc_feature 1..40: note = hyper
  source 1..40: mol_type = genomic DNA
cctccgccgcttccccgccccgcagtcagaacttgaggca

SEQ ID NO: 47336 - DNA, 51 bp, Homo sapiens
  misc_feature 1..51: note = chr1:75599621-75599672
  misc_feature 1..51: note = hyper
  source 1..51: mol_type = genomic DNA
gtcagctcccaggctgccaggagcggtggcattcctcggctacaccggaca

SEQ ID NO: 47337 - DNA, 22 bp, Homo sapiens
  misc_feature 1..22: note = chr1:75600203-75600225
  misc_feature 1..22: note = hyper
  source 1..22: mol_type = genomic DNA
cttttattagtggatcggggcg

SEQ ID NO: 47338 - DNA, 77 bp, Homo sapiens; identical to SEQ ID NO: 17064
  misc_feature 1..77: note = chr1:75600848-75600925
  misc_feature 1..77: note = hyper
  source 1..77: mol_type = genomic DNA

SEQ ID NO: 47339 - DNA, 54 bp, Homo sapiens
  misc_feature 1..54: note = chr1:75601929-75601983
  misc_feature 1..54: note = hyper
  source 1..54: mol_type = genomic DNA
ctccgctatgattgacgtctggaaagaaagagctttgtgaggggatgattgtta

SEQ ID NO: 47340 - DNA, 107 bp, Homo sapiens; identical to SEQ ID NO: 17065
  misc_feature 1..107: note = chr1:75603052-75603159
  misc_feature 1..107: note = hyper
  source 1..107: mol_type = genomic DNA

SEQ ID NO: 47341 - DNA, 206 bp, Homo sapiens; identical to SEQ ID NO: 17066
  misc_feature 1..206: note = chr1:76080278-76080484
  misc_feature 1..206: note = hyper
  source 1..206: mol_type = genomic DNA

SEQ ID NO: 47342 - DNA, 285 bp, Homo sapiens
  misc_feature 1..285: note = chr1:76080768-76081053
  misc_feature 1..285: note = hyper
  source 1..285: mol_type = genomic DNA
aagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggagggggga

SEQ ID NO: 47343 - DNA, 59 bp, Homo sapiens; identical to SEQ ID NO: 26403
  misc_feature 1..59: note = chr1:76081342-76081401
  misc_feature 1..59: note = hyper
  source 1..59: mol_type = genomic DNA

SEQ ID NO: 47344 - DNA, 70 bp, Homo sapiens; identical to SEQ ID NO: 26404
  misc_feature 1..70: note = chr1:76081756-76081826
  misc_feature 1..70: note = hyper
  source 1..70: mol_type = genomic DNA

SEQ ID NO: 47345 - DNA, 169 bp, Homo sapiens; identical to SEQ ID NO: 17068
  misc_feature 1..169: note = chr1:76082209-76082378
  misc_feature 1..169: note = hyper
  source 1..169: mol_type = genomic DNA

SEQ ID NO: 47346 - DNA, 40 bp, Homo sapiens; identical to SEQ ID NO: 26406
  misc_feature 1..40: note = chr1:76540210-76540250
  misc_feature 1..40: note = hyper
  source 1..40: mol_type = genomic DNA

SEQ ID NO: 47347 - DNA, 55 bp, Homo sapiens
  misc_feature 1..55: note = chr1:77333003-77333058
  misc_feature 1..55: note = hyper
  source 1..55: mol_type = genomic DNA
gtgggtacactggctcggttaactctctctccccagaaatttcactactgaaaag

SEQ ID NO: 47348 - DNA, 79 bp, Homo sapiens
  misc_feature 1..79: note = chr1:77333305-77333384
  misc_feature 1..79: note = hyper
  source 1..79: mol_type = genomic DNA
aaaagtggccccggacgcgcgagcctgaggattctgcacaaaagaggtgcccaaaatgaagaccctgatggtgagtcag

SEQ ID NO: 47349 - DNA, 43 bp, Homo sapiens; identical to SEQ ID NO: 26411
  misc_feature 1..43: note = chr1:77333881-77333924
  misc_feature 1..43: note = hyper
  source 1..43: mol_type = genomic DNA

SEQ ID NO: 47350 - DNA, 103 bp, Homo sapiens; identical to SEQ ID NO: 26414
  misc_feature 1..103: note = chr1:77334811-77334914
  misc_feature 1..103: note = hyper
  source 1..103: mol_type = genomic DNA

SEQ ID NO: 47351 - DNA, 67 bp, Homo sapiens
  misc_feature 1..67: note = chr1:77747299-77747366
  misc_feature 1..67: note = hyper
  source 1..67: mol_type = genomic DNA
ttcctgggagttcctcggagacccggaggtaaccgtgtatgtgcgtgcgagtgtgtctgtgtgcgta

SEQ ID NO: 47352 - DNA, 486 bp, Homo sapiens
  misc_feature 1..486: note = chr1:77747453-77747939
  misc_feature 1..486: note = hyper
  source 1..486: mol_type = genomic DNA
tgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggct

SEQ ID NO: 47353 - DNA, 423 bp, Homo sapiens; identical to SEQ ID NO: 26417
  misc_feature 1..423: note = chr1:77748403-77748826
  misc_feature 1..423: note = hyper
  source 1..423: mol_type = genomic DNA

SEQ ID NO: 47354 - DNA, 380 bp, Homo sapiens; identical to SEQ ID NO: 26418
  misc_feature 1..380: note = chr1:78354582-78354962
  misc_feature 1..380: note = hyper
  source 1..380: mol_type = genomic DNA

SEQ ID NO: 47355 - DNA, 16 bp, Homo sapiens
  misc_feature 1..16: note = chr1:78511450-78511466
  misc_feature 1..16: note = hyper
  source 1..16: mol_type = genomic DNA
cgtattgttctgtagc

SEQ ID NO: 47356 - DNA, 30 bp, Homo sapiens
  misc_feature 1..30: note = chr1:78512354-78512384
  misc_feature 1..30: note = hyper
  source 1..30: mol_type = genomic DNA
agactcgagatctggcggggcagattaata

SEQ ID NO: 47357 - DNA, 74 bp, Homo sapiens
  misc_feature 1..74: note = chr1:78957218-78957292
  misc_feature 1..74: note = hyper
  source 1..74: mol_type = genomic DNA
ttcctcacccgggcacgtcctcactccccgtgcccgggatgagggagaaaacagccctttggcgtttgagcaat

SEQ ID NO: 47358 - DNA, 31 bp, Homo sapiens
  misc_feature 1..31: note = chr1:78957522-78957553
  misc_feature 1..31: note = hyper
  source 1..31: mol_type = genomic DNA
ctcagagaagagtggccgtggccttgtgtat

SEQ ID NO: 47359 - DNA, 35 bp, Homo sapiens; identical to SEQ ID NO: 26422
  misc_feature 1..35: note = chr1:82266147-82266182
  misc_feature 1..35: note = hyper
  source 1..35: mol_type = genomic DNA

SEQ ID NO: 47360 - DNA, 86 bp, Homo sapiens; identical to SEQ ID NO: 26423
  misc_feature 1..86: note = chr1:82266769-82266855
  misc_feature 1..86: note = hyper
  source 1..86: mol_type = genomic DNA

SEQ ID NO: 47361 - DNA, 30 bp, Homo sapiens; identical to SEQ ID NO: 5588
  misc_feature 1..30: note = chr1:82267630-82267660
  misc_feature 1..30: note = hyper
  source 1..30: mol_type = genomic DNA

SEQ ID NO: 47362 - DNA, 49 bp, Homo sapiens; identical to SEQ ID NO: 5589
  misc_feature 1..49: note = chr1:82267942-82267991
  misc_feature 1..49: note = hyper
  source 1..49: mol_type = genomic DNA

SEQ ID NO: 47363 - DNA, 83 bp, Homo sapiens; identical to SEQ ID NO: 26426
  misc_feature 1..83: note = chr1:82268226-82268309
  misc_feature 1..83: note = hyper
  source 1..83: mol_type = genomic DNA

SEQ ID NO: 47364 - DNA, 69 bp, Homo sapiens
  misc_feature 1..69: note = chr1:82268815-82268884
  misc_feature 1..69: note = hyper
  source 1..69: mol_type = genomic DNA
tgggatgggggtgccactggggagtggcgacgagagaaaggcgtgggaggagcgcgagggaaggggaga

SEQ ID NO: 47365 - DNA, 30 bp, Homo sapiens; identical to SEQ ID NO: 26428
  misc_feature 1..30: note = chr1:84158496-84158526
  misc_feature 1..30: note = hyper
  source 1..30: mol_type = genomic DNA

SEQ ID NO: 47366 - DNA, 33 bp, Homo sapiens; identical to SEQ ID NO: 26429
  misc_feature 1..33: note = chr1:84544390-84544423
  misc_feature 1..33: note = hyper
  source 1..33: mol_type = genomic DNA

SEQ ID NO: 47367 - DNA, 132 bp, Homo sapiens; identical to SEQ ID NO: 5591
  misc_feature 1..132: note = chr1:85358461-85358593
  misc_feature 1..132: note = hyper
  source 1..132: mol_type = genomic DNA

SEQ ID NO: 47368 - DNA, 147 bp, Homo sapiens
  misc_feature 1..147: note = chr1:85358822-85358969
  misc_feature 1..147: note = hyper
  source 1..147: mol_type = genomic DNA
gaggacgcggcgggcgggcggagcgcctcctctccagcgacccctgcgacgcgtccagagccaaaggaaagtttggcggtgcgagggagggacctagggacagcggcccctccctgccccgccccgccccgccgggtgcgttcgacg

SEQ ID NO: 47369 - DNA, 122 bp, Homo sapiens; identical to SEQ ID NO: 26432
  misc_feature 1..122: note = chr1:85359218-85359340
  misc_feature 1..122: note = hyper
  source 1..122: mol_type = genomic DNA

SEQ ID NO: 47370 - DNA, 22 bp, Homo sapiens
  misc_feature 1..22: note = chr1:85463327-85463349
  misc_feature 1..22: note = hyper
  source 1..22: mol_type = genomic DNA
tgtctgccggagaagcgcctta

SEQ ID NO: 47371 - DNA, 70 bp, Homo sapiens
  misc_feature 1..70: note = chr1:85463378-85463448
  misc_feature 1..70: note = hyper
  source 1..70: mol_type = genomic DNA
caaagtggcccacgcaccctccacaccgctcccgggcggccgcacctggcactcccggccctctggggtt

SEQ ID NO: 47372 - DNA, 69 bp, Homo sapiens; identical to SEQ ID NO: 5594
  misc_feature 1..69: note = chr1:85463878-85463947
  misc_feature 1..69: note = hyper
  source 1..69: mol_type = genomic DNA

SEQ ID NO: 47373 - DNA, 30 bp, Homo sapiens; identical to SEQ ID NO: 26435
  misc_feature 1..30: note = chr1:85527927-85527957
  misc_feature 1..30: note = hyper
  source 1..30: mol_type = genomic DNA

SEQ ID NO: 47374 - DNA, 44 bp, Homo sapiens; identical to SEQ ID NO: 26436
  misc_feature 1..44: note = chr1:85774021-85774065
  misc_feature 1..44: note = hyper
  source 1..44: mol_type = genomic DNA

SEQ ID NO: 47375 - DNA, 325 bp, Homo sapiens
  misc_feature 1..325: note = chr1:86621335-86621660
  misc_feature 1..325: note = hyper
  source 1..325: mol_type = genomic DNA
cccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggagg

SEQ ID NO: 47376 - DNA, 31 bp, Homo sapiens
  misc_feature 1..31: note = chr1:87617807-87617838
  misc_feature 1..31: note = hyper
  source 1..31: mol_type = genomic DNA
tctcgggaggggaaggcggctgtgtacagaa

SEQ ID NO: 47377 - DNA, 168 bp, Homo sapiens; identical to SEQ ID NO: 26440
  misc_feature 1..168: note = chr1:88928334-88928502
  misc_feature 1..168: note = hyper
  source 1..168: mol_type = genomic DNA

SEQ ID NO: 47378 - DNA, 35 bp, Homo sapiens
  misc_feature 1..35: note = chr1:91172677-91172712
  misc_feature 1..35: note = hyper
  source 1..35: mol_type = genomic DNA
tgtgccagttagaagggttccgccggccacctcgt

SEQ ID NO: 47379 - DNA, 85 bp, Homo sapiens; identical to SEQ ID NO: 26442
  misc_feature 1..85: note = chr1:91172959-91173044
  misc_feature 1..85: note = hyper
  source 1..85: mol_type = genomic DNA

SEQ ID NO: 47380 - DNA, 198 bp, Homo sapiens; identical to SEQ ID NO: 26443
  misc_feature 1..198: note = chr1:91176399-91176597
  misc_feature 1..198: note = hyper
  source 1..198: mol_type = genomic DNA

SEQ ID NO: 47381 - DNA, 262 bp, Homo sapiens; identical to SEQ ID NO: 26444
  misc_feature 1..262: note = chr1:91176691-91176953
  misc_feature 1..262: note = hyper
  source 1..262: mol_type = genomic DNA

SEQ ID NO: 47382 - DNA, 101 bp, Homo sapiens; identical to SEQ ID NO: 26445
  misc_feature 1..101: note = chr1:91177391-91177492
  misc_feature 1..101: note = hyper
  source 1..101: mol_type = genomic DNA

SEQ ID NO: 47383 - DNA, 101 bp, Homo sapiens; identical to SEQ ID NO: 17088
  misc_feature 1..101: note = chr1:91177840-91177941
  misc_feature 1..101: note = hyper
  source 1..101: mol_type = genomic DNA

SEQ ID NO: 47384 - DNA, 50 bp, Homo sapiens; identical to SEQ ID NO: 17089
  misc_feature 1..50: note = chr1:91178207-91178257
  misc_feature 1..50: note = hyper
  source 1..50: mol_type = genomic DNA

SEQ ID NO: 47385 - DNA, 34 bp, Homo sapiens; identical to SEQ ID NO: 26447
  misc_feature 1..34: note = chr1:91178960-91178994
  misc_feature 1..34: note = hyper
  source 1..34: mol_type = genomic DNA

SEQ ID NO: 47386 - DNA, 125 bp, Homo sapiens; identical to SEQ ID NO: 17090
  misc_feature 1..125: note = chr1:91181807-91181932
  misc_feature 1..125: note = hyper
  source 1..125: mol_type = genomic DNA

SEQ ID NO: 47387 - DNA, 206 bp, Homo sapiens
  misc_feature 1..206: note = chr1:91182132-91182338
  misc_feature 1..206: note = hyper
  source 1..206: mol_type = genomic DNA
catttgatgtcgctctgggaatcctcccgcttgtcgagtttggtcttgctgtcctcctgctcgagctttggcctgaagctctcgtgcactgcgttgctctcctgcttcggggtgtggtggggagaggatacgctggtgctgtagggtgcacatgccgccagaggtttgctgtcgcccaagatgtccttaattaaaaaagaagacgt

SEQ ID NO: 47388 - DNA, 176 bp, Homo sapiens
  misc_feature 1..176: note = chr1:91183775-91183951
  misc_feature 1..176: note = hyper
  source 1..176: mol_type = genomic DNA
cgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggactt

SEQ ID NO: 47389 - DNA, 139 bp, Homo sapiens; identical to SEQ ID NO: 1759
  misc_feature 1..139: note = chr1:91184274-91184413
  misc_feature 1..139: note = hyper
  source 1..139: mol_type = genomic DNA

SEQ ID NO: 47390 - skipped

SEQ ID NO: 47391 - DNA, 129 bp, Homo sapiens; identical to SEQ ID NO: 26455
  misc_feature 1..129: note = chr1:91184791-91184920
  misc_feature 1..129: note = hyper
  source 1..129: mol_type = genomic DNA

SEQ ID NO: 47392 - DNA, 35 bp, Homo sapiens; identical to SEQ ID NO: 26458
  misc_feature 1..35: note = chr1:91185961-91185996
  misc_feature 1..35: note = hyper
  source 1..35: mol_type = genomic DNA

SEQ ID NO: 47393 - DNA, 305 bp, Homo sapiens
  misc_feature 1..305: note = chr1:91189383-91189688
  misc_feature 1..305: note = hyper
  source 1..305: mol_type = genomic DNA
agagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctggg

SEQ ID NO: 47394 - DNA, 47 bp, Homo sapiens
  misc_feature 1..47: note = chr1:91190380-91190427
  misc_feature 1..47: note = hyper
  source 1..47: mol_type = genomic DNA
cacattaaaaccgtagtgtgtccctaatggtgcgtaatgtgctcaca

SEQ ID NO: 47395 - DNA, 240 bp, Homo sapiens
  misc_feature 1..240: note = chr1:91190629-91190869
  misc_feature 1..240: note = hyper
  source 1..240: mol_type = genomic DNA
cctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccaggg

SEQ ID NO: 47396 - DNA, 228 bp, Homo sapiens; identical to SEQ ID NO: 17098
  misc_feature 1..228: note = chr1:91191310-91191538
  misc_feature 1..228: note = hyper
  source 1..228: mol_type = genomic DNA

SEQ ID NO: 47397 - DNA, 34 bp, Homo sapiens; identical to SEQ ID NO: 26464
  misc_feature 1..34: note = chr1:91191752-91191786
  misc_feature 1..34: note = hyper
  source 1..34: mol_type = genomic DNA

SEQ ID NO: 47398 - DNA, 136 bp, Homo sapiens; identical to SEQ ID NO: 26466
  misc_feature 1..136: note = chr1:91192681-91192817
  misc_feature 1..136: note = hyper
  source 1..136: mol_type = genomic DNA

SEQ ID NO: 47399 - DNA, 251 bp, Homo sapiens
  misc_feature 1..251: note = chr1:91194569-91194820
  misc_feature 1..251: note = hyper
  source 1..251: mol_type = genomic DNA
atgcgtccgggttgatgtgatatgaccgtatcagggaaacaaagctaagtgcagtcaggatctgttagtacagtggcttttgatggaacagctgaggcacacatcgcccgtggcatggactccggggccgaacgctcacgaccaagacttttgcccttttgaaatgaaatagaaataggggagctgcaggaaaaccgaatcgcgcttagggtcaggagcaagacaggagctttcagcgaagatctgaacat

SEQ ID NO: 47400 - DNA, 15 bp, Homo sapiens
  misc_feature 1..15: note = chr1:91195390-91195405
  misc_feature 1..15: note = hyper
  source 1..15: mol_type = genomic DNA
cggtctctgcctttt

SEQ ID NO: 47401 - DNA, 15 bp, Homo sapiens
  misc_feature 1..15: note = chr1:91196502-91196517
  misc_feature 1..15: note = hyper
  source 1..15: mol_type = genomic DNA
cggcggcaggactga

SEQ ID NO: 47402 - DNA, 20 bp, Homo sapiens
  misc_feature 1..20: note = chr1:91316241-91316261
  misc_feature 1..20: note = hyper
  source 1..20: mol_type = genomic DNA
ctaagaaccgccgtgcgatg

SEQ ID NO: 47403 - DNA, 314 bp, Homo sapiens
  misc_feature 1..314: note = chr1:91316313-91316627
  misc_feature 1..314: note = hyper
  source 1..314: mol_type = genomic DNA
tcctcgggctttagttcaggaagaaaatgaaagctggaggtctcgtgggcgggactggaggcggccagataggcaagaacccgcaacaggagtagggacattttttcttcaaattccaatcccatccagcgatagacaggcgcgtgggtctccctcctccacgaccaccacacaatggcacacacttttgctggaaactgaaatcgaagtctctgaggcaggctggggcccaggccggcagcggggaggggcagggtccagccacctcggcgtggccttggcgagcgctccggggtcagaggccgtcgttctcg

SEQ ID NO: 47404 - DNA, 680 bp, Homo sapiens
  misc_feature 1..680: note = chr1:91316682-91317362
  misc_feature 1..680: note = hyper
  source 1..680: mol_type = genomic DNA
tcgcctggctgcgccgtcccggcgggccggccctctccacgccctctcctggggtttgcggtgggcacagctccctccagactgggtctctccactagcctcctccccaactgcaacgtgggaaccagagctatccgagtcacgagccccaagtgcacacaaagcccccaacggggccacggcgcctccacgcctcgctacctccagctccaggagcgcagaacgcagcgccctgggtcaccgcgtctgccctgcggagcagccccactgaggggaagcctcgggcaggaggtgagaccccgcgcacgcaagcacccccgccccaagcagggccctctgcccgagggagactctcacctcaaataaacgggcgctgccgcctccagggggaggacagcgggcggagaatactcacgctgggcccagccgcgcggggacttcgctgggaaccacgcgcgggctcccgccggggagcggagccccagcctgcagtcctgcgcccgccccagcaccgcctcctcggaagggaggcctctaccgtccggcggcggacctgcagccgccgcgggagacgctgccccgccccccggccccgcccttcggcccatccccgccccgctggcctccttttcccctgccccctccctccgctcctcaacgcccgccgggtgcaatctgct

SEQ ID NO: 47405 - DNA, 281 bp, Homo sapiens; identical to SEQ ID NO: 26472
  misc_feature 1..281: note = chr1:91870046-91870327
  misc_feature 1..281: note = hyper
  source 1..281: mol_type = genomic DNA

SEQ ID NO: 47406 - DNA, 128 bp, Homo sapiens; identical to SEQ ID NO: 26473
  misc_feature 1..128: note = chr1:92495704-92495832
  misc_feature 1..128: note = hyper
  source 1..128: mol_type = genomic DNA

SEQ ID NO: 47407 - DNA, 244 bp, Homo sapiens
  misc_feature 1..244: note = chr1:92948597-92948841
  misc_feature 1..244: note = hyper
  source 1..244: mol_type = genomic DNA
tgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggc

SEQ ID NO: 47408 - DNA, 280 bp, Homo sapiens; identical to SEQ ID NO: 17105
  misc_feature 1..280: note = chr1:92948976-92949256
  misc_feature 1..280: note = hyper
  source 1..280: mol_type = genomic DNA

SEQ ID NO: 47409 - DNA, 394 bp, Homo sapiens; identical to SEQ ID NO: 26475
  misc_feature 1..394: note = chr1:92949786-92950180
  misc_feature 1..394: note = hyper
  source 1..394: mol_type = genomic DNA

SEQ ID NO: 47410 - DNA, 1509 bp, Homo sapiens
  misc_feature 1..1509: note = chr1:92950636-92952145
  misc_feature 1..1509: note = hyper
  source 1..1509: mol_type = genomic DNA
ttgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatc

SEQ ID NO: 47411 - DNA, 88 bp, Homo sapiens; identical to SEQ ID NO: 26477
  misc_feature 1..88: note = chr1:95392536-95392624
  misc_feature 1..88: note = hyper
  source 1..88: mol_type = genomic DNA

SEQ ID NO: 47412 - DNA, 39 bp, Homo sapiens; identical to SEQ ID NO: 26478
  misc_feature 1..39: note = chr1:95393028-95393067
  misc_feature 1..39: note = hyper
  source 1..39: mol_type = genomic DNA

SEQ ID NO: 47413 - DNA, 30 bp, Homo sapiens; identical to SEQ ID NO: 26479
  misc_feature 1..30: note = chr1:95428544-95428574
  misc_feature 1..30: note = hyper
  source 1..30: mol_type = genomic DNA

SEQ ID NO: 47414 - DNA, 59 bp, Homo sapiens
  misc_feature 1..59: note = chr1:98510732-98510791
  misc_feature 1..59: note = hyper
  source 1..59: mol_type = genomic DNA
tctctcttgctcccacgccttcgcagctgacctgagaggggggacgtgccttgcgtttg

SEQ ID NO: 47415 - DNA, 293 bp, Homo sapiens
  misc_feature 1..293: note = chr1:98511335-98511628
  misc_feature 1..293: note = hyper
  source 1..293: mol_type = genomic DNA
ccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgc

SEQ ID NO: 47416 - DNA, 285 bp, Homo sapiens
  misc_feature 1..285: note = chr1:98513940-98514225
  misc_feature 1..285: note = hyper
  source 1..285: mol_type = genomic DNA
gcttcagcacctggacgaatggacagctcaacccgggccgactgccggcagcactcgcagcagaactgacgctctgagctctaaccaaagctctctcgtgcttgagcggggcagcctgacttacgagaacaccatttcctacgagaccactgccgctgggtgcatattcaattcaagcctccttaagctgtcggatttcccccacccatccaccctcccccccttctccaccctccacacaaaaacaaaaaagggaaaaagcccaataccatcagggcgtttgtt

SEQ ID NO: 47417 - DNA, 19 bp, Homo sapiens
  misc_feature 1..19: note = chr1:98515068-98515087
  misc_feature 1..19: note = hyper
  source 1..19: mol_type = genomic DNA
cttgggaagggacctcggc

SEQ ID NO: 47418 - DNA, 54 bp, Homo sapiens; identical to SEQ ID NO: 17113
  misc_feature 1..54: note = chr1:98515088-98515142
  misc_feature 1..54: note = hyper
  source 1..54: mol_type = genomic DNA

SEQ ID NO: 47419 - DNA, 179 bp, Homo sapiens; identical to SEQ ID NO: 26487
  misc_feature 1..179: note = chr1:98519817-98519996
  misc_feature 1..179: note = hyper
  source 1..179: mol_type = genomic DNA

SEQ ID NO: 47420 - DNA, 118 bp, Homo sapiens
  misc_feature 1..118: note = chr1:99469564-99469682
  misc_feature 1..118: note = hyper
  source 1..118: mol_type = genomic DNA
cccctctctcctcgccggcccgcccgccgctgctcttcttccaggcacaatcgaagaggaggcagtgagcgagtcaaggccacagagtggatggaatcaaggttcacccccaaagctc

SEQ ID NO: 47421 - DNA, 186 bp, Homo sapiens
  misc_feature 1..186: note = chr1:99469788-99469974
  misc_feature 1..186: note = hyper
  source 1..186: mol_type = genomic DNA
tgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcga

SEQ ID NO: 47422 - DNA, 315 bp, Homo sapiens; identical to SEQ ID NO: 26490
  misc_feature 1..315: note = chr1:99470215-99470530
  misc_feature 1..315: note = hyper
  source 1..315: mol_type = genomic DNA

SEQ ID NO: 47423 - DNA, 36 bp, Homo sapiens; identical to SEQ ID NO: 5642
  misc_feature 1..36: note = chr1:99470582-99470618
  misc_feature 1..36: note = hyper
  source 1..36: mol_type = genomic DNA

SEQ ID NO: 47424 - DNA, 166 bp, Homo sapiens; identical to SEQ ID NO: 5643
  misc_feature 1..166: note = chr1:99470619-99470785
  misc_feature 1..166: note = hyper
  source 1..166: mol_type = genomic DNA

SEQ ID NO: 47425 - DNA, 80 bp, Homo sapiens; identical to SEQ ID NO: 17119
  misc_feature 1..80: note = chr1:101004737-101004817
  misc_feature 1..80: note = hyper
  source 1..80: mol_type = genomic DNA

SEQ ID NO: 47426 - DNA, 92 bp, Homo sapiens; identical to SEQ ID NO: 26494
  misc_feature 1..92: note = chr1:101004842-101004934
  misc_feature 1..92: note = hyper
  source 1..92: mol_type = genomic DNA

SEQ ID NO: 47427 - DNA, 136 bp, Homo sapiens
  misc_feature 1..136: note = chr1:101004935-101005071
  misc_feature 1..136: note = hyper
  source 1..136: mol_type = genomic DNA
ctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggccc

SEQ ID NO: 47428 - DNA, 216 bp, Homo sapiens; identical to SEQ ID NO: 17120
  misc_feature 1..216: note = chr1:101005144-101005360
  misc_feature 1..216: note = hyper
  source 1..216: mol_type = genomic DNA

SEQ ID NO: 47429 - DNA, 110 bp, Homo sapiens
  misc_feature 1..110: note = chr1:101005675-101005785
  misc_feature 1..110: note = hyper
  source 1..110: mol_type = genomic DNA
aacctagccggggcccgagggaagcggagatccccggcttccgacgtccttgggcaccgtcgcctccttccctcctagggcatcccctgcctgaacgaagacttccgccg

SEQ ID NO: 47430 - DNA, 180 bp, Homo sapiens
  misc_feature 1..180: note = chr1:101702616-101702796
  misc_feature 1..180: note = hyper
  source 1..180: mol_type = genomic DNA
ccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgca

SEQ ID NO: 47431 - DNA, 30 bp, Homo sapiens; identical to SEQ ID NO: 5648
  misc_feature 1..30: note = chr1:101703188-101703218
  misc_feature 1..30: note = hyper
  source 1..30: mol_type = genomic DNA

SEQ ID NO: 47432 - DNA, 46 bp, Homo sapiens
  misc_feature 1..46: note = chr1:101703566-101703612
  misc_feature 1..46: note = hyper
  source 1..46: mol_type = genomic DNA
gggcgcggggggaggcggggagaataagaagaagaaagaaaaggca

SEQ ID NO: 47433 - DNA, 394 bp, Homo sapiens; identical to SEQ ID NO: 26500
  misc_feature 1..394: note = chr1:101775094-101775488
  misc_feature 1..394: note = hyper
  source 1..394: mol_type = genomic DNA

SEQ ID NO: 47434 - DNA, 88 bp, Homo sapiens; identical to SEQ ID NO: 26501
  misc_feature 1..88: note = chr1:103572677-103572765
  misc_feature 1..88: note = hyper
  source 1..88: mol_type = genomic DNA

SEQ ID NO: 47435 - DNA, 145 bp, Homo sapiens; identical to SEQ ID NO: 26502
  misc_feature 1..145: note = chr1:103573555-103573700
  misc_feature 1..145: note = hyper
  source 1..145: mol_type = genomic DNA

SEQ ID NO: 47436 - DNA, 467 bp, Homo sapiens; identical to SEQ ID NO: 26503
  misc_feature 1..467: note = chr1:103573701-103574168
  misc_feature 1..467: note = hyper
  source 1..467: mol_type = genomic DNA

SEQ ID NO: 47437 - DNA, 114 bp, Homo sapiens
  misc_feature 1..114: note = chr1:107682621-107682735
  misc_feature 1..114: note = hyper
  source 1..114: mol_type = genomic DNA
gaagtgggaggtacacgaggagttactggaaacggcgcttctgtggaggagccgggggggatggggagtagagggagggggccctgttgcctcagcgccccgaggtcgtggagc

SEQ ID NO: 47438 - DNA, 462 bp, Homo sapiens
  misc_feature 1..462: note = chr1:107682977-107683439
  misc_feature 1..462: note = hyper
  source 1..462: mol_type = genomic DNA
tggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctc

SEQ ID NO: 47439 - DNA, 258 bp, Homo sapiens; identical to SEQ ID NO: 17130
  misc_feature 1..258: note = chr1:107683517-107683775
  misc_feature 1..258: note = hyper
  source 1..258: mol_type = genomic DNA

SEQ ID NO: 47440 - DNA, 464 bp, Homo sapiens
  misc_feature 1..464: note = chr1:107683776-107684240
  misc_feature 1..464: note = hyper
  source 1..464: mol_type = genomic DNA
gggagtggcgggccggcgctgggttctcggtcctcggggtcctctcccgccggcggccgggcgcgatcggaatccccgggctgcggcggtggcggcggctcgggtcctcacgcccacccctcccgctccgcccgctcccgcctggggaggaggctccgcgggagctgccgccctccgcccgtacgccgcccgcgggctccgctgctgcggccgccgcccgaggcggaccaggctggctgcgcagggccgccgccccgcgccgtcggctcggctcccgcccggcgcaagggcaaacgagccacacggtaagtgcctgcggctcgcctctcctactgcgacccgagcctctcgcccgtgcccctctcccccgggtttccccaccccccgccgccccccgccccacccgctgcgatgcacaggcgggagggaaggctccgggtgggcgaggaactttgtaaagcgcc

SEQ ID NO: 47441 - DNA, 56 bp, Homo sapiens
  misc_feature 1..56: note = chr1:107684439-107684495
  misc_feature 1..56: note = hyper
  source 1..56: mol_type = genomic DNA
acacatcgctcaggcggcttgtcgttattttttctttctttcgccaattatatttg

SEQ ID NO: 47442 - DNA, 436 bp, Homo sapiens; identical to SEQ ID NO: 17132
  misc_feature 1..436: note = chr1:108506627-108507063
  misc_feature 1..436: note = hyper
  source 1..436: mol_type = genomic DNA

SEQ ID NO: 47443 - DNA, 172 bp, Homo sapiens; identical to SEQ ID NO: 17133
  misc_feature 1..172: note = chr1:108507148-108507320
  misc_feature 1..172: note = hyper
  source 1..172: mol_type = genomic DNA

SEQ ID NO: 47444 - DNA, 110 bp, Homo sapiens; identical to SEQ ID NO: 17134
  misc_feature 1..110: note = chr1:108507497-108507607
  misc_feature 1..110: note = hyper
  source 1..110: mol_type = genomic DNA

SEQ ID NO: 47445 - DNA, 60 bp, Homo sapiens; identical to SEQ ID NO: 17135
  misc_feature 1..60: note = chr1:108507657-108507717
  misc_feature 1..60: note = hyper
  source 1..60: mol_type = genomic DNA

SEQ ID NO: 47446 - DNA, 242 bp, Homo sapiens; identical to SEQ ID NO: 17136
  misc_feature 1..242: note = chr1:108507810-108508052
  misc_feature 1..242: note = hyper
  source 1..242: mol_type = genomic DNA

SEQ ID NO: 47447 - DNA, 15 bp, Homo sapiens
  misc_feature 1..15: note = chr1:109203594-109203609
  misc_feature 1..15: note = hyper
  source 1..15: mol_type = genomic DNA
gcttctgtctttgta

SEQ ID NO: 47448 - DNA, 537 bp, Homo sapiens; identical to SEQ ID NO: 17137
  misc_feature 1..537: note = chr1:109203672-109204209
  misc_feature 1..537: note = hyper
  source 1..537: mol_type = genomic DNA

SEQ ID NO: 47449 - DNA, 71 bp, Homo sapiens; identical to SEQ ID NO: 26513
  misc_feature 1..71: note = chr1:109656220-109656291
  misc_feature 1..71: note = hyper
  source 1..71: mol_type = genomic DNA

SEQ ID NO: 47450 - DNA, 179 bp, Homo sapiens; identical to SEQ ID NO: 26514
  misc_feature 1..179: note = chr1:109656891-109657070
  misc_feature 1..179: note = hyper
  source 1..179: mol_type = genomic DNA

SEQ ID NO: 47451 - DNA, 235 bp, Homo sapiens; identical to SEQ ID NO: 26515
  misc_feature 1..235: note = chr1:110009583-110009818
  misc_feature 1..235: note = hyper
  source 1..235: mol_type = genomic DNA

SEQ ID NO: 47452 - DNA, 137 bp, Homo sapiens; identical to SEQ ID NO: 26516
  misc_feature 1..137: note = chr1:110282667-110282804
  misc_feature 1..137: note = hyper
  source 1..137: mol_type = genomic DNA

SEQ ID NO: 47453 - DNA, 174 bp, Homo sapiens; identical to SEQ ID NO: 26517
  misc_feature 1..174: note = chr1:110283065-110283239
  misc_feature 1..174: note = hyper
  source 1..174: mol_type = genomic DNA

SEQ ID NO: 47454 - DNA, 51 bp, Homo sapiens
  misc_feature 1..51: note = chr1:110610535-110610586
  misc_feature 1..51: note = hyper
  source 1..51: mol_type = genomic DNA
atcggccgggtcatccggctcagggcctcagcggcagcgggcaaaactcta

SEQ ID NO: 47455 - DNA, 97 bp, Homo sapiens; identical to SEQ ID NO: 26522
  misc_feature 1..97: note = chr1:110612445-110612542
  misc_feature 1..97: note = hyper
  source 1..97: mol_type = genomic DNA

SEQ ID NO: 47456 - DNA, 21 bp, Homo sapiens
  misc_feature 1..21: note = chr1:110613458-110613479
  misc_feature 1..21: note = hyper
  source 1..21: mol_type = genomic DNA
ggagcccgggaaccccctccc

SEQ ID NO: 47457 - DNA, 52 bp, Homo sapiens
  misc_feature 1..52: note = chr1:110627578-110627630
  misc_feature 1..52: note = hyper
  source 1..52: mol_type = genomic DNA
ttctaacaccgcgtgatcaccgacaacttttgcaggacgggatgaaactcct

SEQ ID NO: 47458 - DNA, 56 bp, Homo sapiens
  misc_feature 1..56: note = chr1:110672833-110672889
  misc_feature 1..56: note = hyper
  source 1..56: mol_type = genomic DNA
ctgtattttcagcctcggtttgacgtcaggctctcacggtcccaaaggatgggctt

SEQ ID NO: 47459 - DNA, 119 bp, Homo sapiens
  misc_feature 1..119: note = chr1:110673233-110673352
  misc_feature 1..119: note = hyper
  source 1..119: mol_type = genomic DNA
ggcctaaaatgagggaagatgaggaaatgggggtggggacgatggagaggatggaaggggcggcgggggggtgcggtggtctgcgcggtacagcagcgtccctgcgggttcccctcatt

SEQ ID NO: 47460 - DNA, 89 bp, Homo sapiens
  misc_feature 1..89: note = chr1:110692884-110692973
  misc_feature 1..89: note = hyper
  source 1..89: mol_type = genomic DNA
ggccccattcctctccgagggcagaagccctggcgagggctccagggtctgcatcccctgaccaggggcctcaagaagctaagccccct

SEQ ID NO: 47461 - DNA, 145 bp, Homo sapiens
  misc_feature 1..145: note = chr1:110694117-110694262
  misc_feature 1..145: note = hyper
  source 1..145: mol_type = genomic DNA
aggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcg

SEQ ID NO: 47462 - DNA, 160 bp, Homo sapiens
  misc_feature 1..160: note = chr1:110754149-110754309
  misc_feature 1..160: note = hyper
  source 1..160: mol_type = genomic DNA
accgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgc

SEQ ID NO: 47463 - DNA, 110 bp, Homo sapiens
  misc_feature 1..110: note = chr1:111097796-111097906
  misc_feature 1..110: note = hyper
  source 1..110: mol_type = genomic DNA
aggaatcagcattcccgttgtagagatcggtggaccgatgctctcagaggcttccacaagcgtttgtattgtttggggcggtcggaactcagcgctgcggaagccggtgt

SEQ ID NO: 47464 - DNA, 260 bp, Homo sapiens
  misc_feature 1..260: note = chr1:111097936-111098196
  misc_feature 1..260: note = hyper
  source 1..260: mol_type = genomic DNA
ctgcagccctgtagaaataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgc

SEQ ID NO: 47465 - DNA, 102 bp, Homo sapiens
  misc_feature 1..102: note = chr1:111098316-111098418
  misc_feature 1..102: note = hyper
  source 1..102: mol_type = genomic DNA
atgccctttcctggtcacggactccgccggcagccggggcgggacggaccagaggctaccaactgggggcttctgctgcctgggacacggggatccacattg

SEQ ID NO: 47466 - DNA, 290 bp, Homo sapiens; identical to SEQ ID NO: 26531
  misc_feature 1..290: note = chr1:111149588-111149878
  misc_feature 1..290: note = hyper
  source 1..290: mol_type = genomic DNA

SEQ ID NO: 47467 - DNA, 123 bp, Homo sapiens; identical to SEQ ID NO: 26532
  misc_feature 1..123: note = chr1:111150355-111150478
  misc_feature 1..123: note = hyper
  source 1..123: mol_type = genomic DNA

SEQ ID NO: 47468 - DNA, 56 bp, Homo sapiens
  misc_feature 1..56: note = chr1:111216707-111216763
  misc_feature 1..56: note = hyper
  source 1..56: mol_type = genomic DNA
gcacggacacgatggcgatgccccgggccggcccggagctctcggggtactcgaag

SEQ ID NO: 47469 - DNA, 86 bp, Homo sapiens
  misc_feature 1..86: note = chr1:111217982-111218068
  misc_feature 1..86: note = hyper
  source 1..86: mol_type = genomic DNA
cacacccctaggtacagcccggggagggcaggcgggcccagtgtccagggagggagtgcaggccaggcgggcgccctgggccagag

SEQ ID NO: 47470 - DNA, 76 bp, Homo sapiens
  misc_feature 1..76: note = chr1:111505931-111506007
  misc_feature 1..76: note = hyper
  source 1..76: mol_type = genomic DNA
tgagtcacataagagcgtcggccatcttggttttcatctcccgtggagatctactcggtccgcctattaaacttga

SEQ ID NO: 47471 - DNA, 240 bp, Homo sapiens
  misc_feature 1..240: note = chr1:111506212-111506452
  misc_feature 1..240: note = hyper
  source 1..240: mol_type = genomic DNA
ccgtggggaggattcgaaaccggtacttaccaacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagg

SEQ ID NO: 47472 - DNA, 264 bp, Homo sapiens; identical to SEQ ID NO: 26540
  misc_feature 1..264: note = chr1:112283059-112283323
  misc_feature 1..264: note = hyper
  source 1..264: mol_type = genomic DNA

SEQ ID NO: 47473 - DNA, 256 bp, Homo sapiens; identical to SEQ ID NO: 26541
  misc_feature 1..256: note = chr1:112531573-112531829
  misc_feature 1..256: note = hyper
  source 1..256: mol_type = genomic DNA

SEQ ID NO: 47474 - DNA, 43 bp, Homo sapiens; identical to SEQ ID NO: 26542
  misc_feature 1..43: note = chr1:112533373-112533416
  misc_feature 1..43: note = hyper
  source 1..43: mol_type = genomic DNA

SEQ ID NO: 47475 - DNA, 67 bp, Homo sapiens; identical to SEQ ID NO: 26543
  misc_feature 1..67: note = chr1:113051618-113051685
  misc_feature 1..67: note = hyper
  source 1..67: mol_type = genomic DNA

SEQ ID NO: 47476 - DNA, 32 bp, Homo sapiens; identical to SEQ ID NO: 26544
  misc_feature 1..32: note = chr1:113392524-113392556
  misc_feature 1..32: note = hyper
  source 1..32: mol_type = genomic DNA

SEQ ID NO: 47477 - DNA, 135 bp, Homo sapiens; identical to SEQ ID NO: 26545
  misc_feature 1..135: note = chr1:113497971-113498106
  misc_feature 1..135: note = hyper
  source 1..135: mol_type = genomic DNA

SEQ ID NO: 47478 - DNA, 41 bp, Homo sapiens; identical to SEQ ID NO: 26546
  misc_feature 1..41: note = chr1:113498107-113498148
  misc_feature 1..41: note = hyper
  source 1..41: mol_type = genomic DNA

SEQ ID NO: 47479 - DNA, 127 bp, Homo sapiens
  misc_feature 1..127: note = chr1:114695312-114695439
  misc_feature 1..127: note = hyper
  source 1..127: mol_type = genomic DNA
cctgccgcgactccccggagacgccgcagctgcgcgccagggtccagcccggcggggatcgggctcgggactcacccgctccggcgagctcgactcagctcgggctcccgcctcggctaggcagccg

SEQ ID NO: 47480 - DNA, 166 bp, Homo sapiens; identical to SEQ ID NO: 17154
  misc_feature 1..166: note = chr1:114695943-114696109
  misc_feature 1..166: note = hyper
  source 1..166: mol_type = genomic DNA

SEQ ID NO: 47481 - DNA, 67 bp, Homo sapiens
  misc_feature 1..67: note = chr1:114696712-114696779
  misc_feature 1..67: note = hyper
  source 1..67: mol_type = genomic DNA
cattcactgcctggtgtgaccttgggcgtctctgagcctcaattttcctctccgtaaaggaggtgta

SEQ ID NO: 47482 - DNA, 65 bp, Homo sapiens; identical to SEQ ID NO: 26552
  misc_feature 1..65: note = chr1:114697062-114697127
  misc_feature 1..65: note = hyper
  source 1..65: mol_type = genomic DNA

SEQ ID NO: 47483 - DNA, 30 bp, Homo sapiens; identical to SEQ ID NO: 26553
  misc_feature 1..30: note = chr1:114697835-114697865
  misc_feature 1..30: note = hyper
  source 1..30: mol_type = genomic DNA

SEQ ID NO: 47484 - DNA, 26 bp, Homo sapiens
  misc_feature 1..26: note = chr1:115632012-115632038
  misc_feature 1..26: note = hyper
  source 1..26: mol_type = genomic DNA
aggtacttgatgcaccgcaggccccc

SEQ ID NO: 47485 - DNA, 250 bp, Homo sapiens; identical to SEQ ID NO: 26555
  misc_feature 1..250: note = chr1:115632104-115632354
  misc_feature 1..250: note = hyper
  source 1..250: mol_type = genomic DNA

SEQ ID NO: 47486 - DNA, 82 bp, Homo sapiens
  misc_feature 1..82: note = chr1:115632555-115632637
  misc_feature 1..82: note = hyper
  source 1..82: mol_type = genomic DNA
agtgtccagggctgcggctccgcggcgcggagcaagcacacaagcagcttctaggggaccctccctccggcccctcccccct

SEQ ID NO: 47487 - DNA, 132 bp, Homo sapiens
  misc_feature 1..132: note = chr1:115880052-115880184
  misc_feature 1..132: note = hyper
  source 1..132: mol_type = genomic DNA
cgccctaaccttccacgcccgcttctcccacacctggcagcagacagctggagatgaagcgtgtgacccaagtggcagggctgaaccttggcgacctctacctgaggttgtccaacgcggctccgtggaggg

SEQ ID NO: 47488 - skipped

SEQ ID NO: 47489 - DNA, 117 bp, Homo sapiens; identical to SEQ ID NO: 5695
  misc_feature 1..117: note = chr1:115880678-115880795
  misc_feature 1..117: note = hyper
  source 1..117: mol_type = genomic DNA

SEQ ID NO: 47490 - DNA, 103 bp, Homo sapiens
  misc_feature 1..103: note = chr1:116371036-116371139
  misc_feature 1..103: note = hyper
  source 1..103: mol_type = genomic DNA
cgcccactggtgtggcgtcctgagagtgcgtgcgtgagcgagcgagcggcttatcctagactgaagacccagggaaacagatctgtgtggaggatgtttctgt

SEQ ID NO: 47491 - DNA, 328 bp, Homo sapiens
  misc_feature 1..328: note = chr1:116371201-116371529
  misc_feature 1..328: note = hyper
  source 1..328: mol_type = genomic DNA
tggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatccc

SEQ ID NO: 47492 - DNA, 128 bp, Homo sapiens; identical to SEQ ID NO: 26563
  misc_feature 1..128: note = chr1:116380300-116380428
  misc_feature 1..128: note = hyper
  source 1..128: mol_type = genomic DNA

SEQ ID NO: 47493 - DNA, 410 bp, Homo sapiens; identical to SEQ ID NO: 26565
  misc_feature 1..410: note = chr1:116381534-116381944
  misc_feature 1..410: note = hyper
  source 1..410: mol_type = genomic DNA

SEQ ID NO: 47494 - DNA, 20 bp, Homo sapiens
  misc_feature 1..20: note = chr1:116382478-116382498
  misc_feature 1..20: note = hyper
  source 1..20: mol_type = genomic DNA
ctctacggcaaaataaaaac

SEQ ID NO: 47495 - DNA, 33 bp, Homo sapiens; identical to SEQ ID NO: 26567
  misc_feature 1..33: note = chr1:116710587-116710620
  misc_feature 1..33: note = hyper
  source 1..33: mol_type = genomic DNA

SEQ ID NO: 47496 - DNA, 281 bp, Homo sapiens; identical to SEQ ID NO: 26568
  misc_feature 1..281: note = chr1:116711011-116711292
  misc_feature 1..281: note = hyper
  source 1..281: mol_type = genomic DNA

SEQ ID NO: 47497 - DNA, 160 bp, Homo sapiens; identical to SEQ ID NO: 26569
  misc_feature 1..160: note = chr1:118727930-118728090
  misc_feature 1..160: note = hyper
  source 1..160: mol_type = genomic DNA

SEQ ID NO: 47498 - DNA, 15 bp, Homo sapiens
  misc_feature 1..15: note = chr1:119521978-119521993
  misc_feature 1..15: note = hyper
  source 1..15: mol_type = genomic DNA
cgtcacgatcccaca

SEQ ID NO: 47499 - DNA, 274 bp, Homo sapiens
  misc_feature 1..274: note = chr1:119522565-119522839
  misc_feature 1..274: note = hyper
  source 1..274: mol_type = genomic DNA
cgttccggccccgcggcgcctccaaggccgggccgaggggccgaggggccgagggcgggcagacgcggccacggcctaattctgacttctgaaggtcaccgaaactgcgctgtttttccagagatgggttgaagagaagagatgcaatcccagttccttctgcggcgaaacgggatctgaaattcttggagagggggaagaattggacgttttcatcgtgcgtggaggaaaattgggggaggggaagtgagtggcaagtaagggggttaactgc

SEQ ID NO: 47500 - DNA, 159 bp, Homo sapiens; identical to SEQ ID NO: 26574
  misc_feature 1..159: note = chr1:119526773-119526932
  misc_feature 1..159: note = hyper
  source 1..159: mol_type = genomic DNA

SEQ ID NO: 47501 - DNA, 232 bp, Homo sapiens
  misc_feature 1..232: note = chr1:119527391-119527623
  misc_feature 1..232: note = hyper
  source 1..232: mol_type = genomic DNA
cggtggaatttttgaaacgctttcgaaatacatagtttcctctgtggagtgagtgcctacaacgcgcaggccggactgatcccccgttgctgcaggttggtgccccaagctgcgggtgctcgggcgccaactaaagccagctctgtccagacgcggaaagaaaaatgggctgtgaaaaagcaaaaggcctcgtctttgaatgaaagttaaacattaaaatctgaccctagag

SEQ ID NO: 47502 - DNA, 140 bp, Homo sapiens; identical to SEQ ID NO: 26576
  misc_feature 1..140: note = chr1:119528015-119528155
  misc_feature 1..140: note = hyper
  source 1..140: mol_type = genomic DNA

SEQ ID NO: 47503 - DNA, 219 bp, Homo sapiens
  misc_feature 1..219: note = chr1:119529118-119529337
  misc_feature 1..219: note = hyper
  source 1..219: mol_type = genomic DNA
tgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtc

SEQ ID NO: 47504 - DNA, 51 bp, Homo sapiens; identical to SEQ ID NO: 26578
  misc_feature 1..51: note = chr1:119529378-119529429
  misc_feature 1..51: note = hyper
  source 1..51: mol_type = genomic DNA

SEQ ID NO: 47505 - DNA, 73 bp, Homo sapiens
  misc_feature 1..73: note = chr1:119529839-119529912
  misc_feature 1..73: note = hyper
  source 1..73: mol_type = genomic DNA
gttctcagaagcgagtcctagatctcggctcccgccgttgccttcggcccgcgcccctcccaatcccagggac

SEQ ID NO: 47506 - DNA, 95 bp, Homo sapiens; identical to SEQ ID NO: 17168
  misc_feature 1..95: note = chr1:119530005-119530100
  misc_feature 1..95: note = hyper
  source 1..95: mol_type = genomic DNA

SEQ ID NO: 47507 - DNA, 31 bp, Homo sapiens
  misc_feature 1..31: note = chr1:119530998-119531029
  misc_feature 1..31: note = hyper
  source 1..31: mol_type = genomic DNA
gcccccaaccaatagcgaggagggaacaaga

SEQ ID NO: 47508 - DNA, 132 bp, Homo sapiens; identical to SEQ ID NO: 26585
  misc_feature 1..132: note = chr1:119531865-119531997
  misc_feature 1..132: note = hyper
  source 1..132: mol_type = genomic DNA

SEQ ID NO: 47509 - DNA, 37 bp, Homo sapiens; identical to SEQ ID NO: 26586
  misc_feature 1..37: note = chr1:119535303-119535340
  misc_feature 1..37: note = hyper
  source 1..37: mol_type = genomic DNA

SEQ ID NO: 47510 - DNA, 148 bp, Homo sapiens; identical to SEQ ID NO: 26587
  misc_feature 1..148: note = chr1:119535573-119535721
  misc_feature 1..148: note = hyper
  source 1..148: mol_type = genomic DNA

SEQ ID NO: 47511 - DNA, 30 bp, Homo sapiens; identical to SEQ ID NO: 26588
  misc_feature 1..30: note = chr1:119536719-119536749
  misc_feature 1..30: note = hyper
  source 1..30: mol_type = genomic DNA

SEQ ID NO: 47512 - skipped

SEQ ID NO: 47513 - DNA, 124 bp, Homo sapiens
  misc_feature 1..124: note = chr1:119543408-119543532
  misc_feature 1..124: note = hyper
  source 1..124: mol_type = genomic DNA
cgcggctgtctttcccggaaagacccaagtgcgcgatgtcagcccgcctgcacttcatctgagttgtccttatgtggccatttctgtttcaaatttcagatttttctactaaaaaaggatgggt

SEQ ID NO: 47514 - DNA, 304 bp, Homo sapiens
  misc_feature 1..304: note = chr1:119544182-119544486
  misc_feature 1..304: note = hyper
  source 1..304: mol_type = genomic DNA
tctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctgg

SEQ ID NO: 47515 - DNA, 226 bp, Homo sapiens
  misc_feature 1..226: note = chr1:119549929-119550155
  misc_feature 1..226: note = hyper
  source 1..226: mol_type = genomic DNA
gggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggac

SEQ ID NO: 47516 - DNA, 28 bp, Homo sapiens
  misc_feature 1..28: note = chr1:119550278-119550306
  misc_feature 1..28: note = hyper
  source 1..28: mol_type = genomic DNA
tcttgttctttgacggggtggccctgtg

SEQ ID NO: 47517 - DNA, 29 bp, Homo sapiens
  misc_feature 1..29: note = chr1:119550692-119550721
  misc_feature 1..29: note = hyper
  source 1..29: mol_type = genomic DNA
acgcgcctagcagcccggcggccccggcc

SEQ ID NO: 47518 - DNA, 48 bp, Homo sapiens
  misc_feature 1..48: note = chr1:119551269-119551317
  misc_feature 1..48: note = hyper
  source 1..48: mol_type = genomic DNA
aaggaaaacttctgcgacttcaagaacgtcctgcgcattcacatgggg

SEQ ID NO: 47519 - DNA, 43 bp, Homo sapiens; identical to SEQ ID NO: 26596
  misc_feature 1..43: note = chr1:119869950-119869993
  misc_feature 1..43: note = hyper
  source 1..43: mol_type = genomic DNA

SEQ ID NO: 47520 - DNA, 30 bp, Homo sapiens; identical to SEQ ID NO: 26597
  misc_feature 1..30: note = chr1:119870224-119870254
  misc_feature 1..30: note = hyper
  source 1..30: mol_type = genomic DNA

SEQ ID NO: 47521 - DNA, 43 bp, Homo sapiens; identical to SEQ ID NO: 26598
  misc_feature 1..43: note = chr1:120190546-120190589
  misc_feature 1..43: note = hyper
  source 1..43: mol_type = genomic DNA

SEQ ID NO: 47522 - DNA, 30 bp, Homo sapiens; identical to SEQ ID NO: 26599
  misc_feature 1..30: note = chr1:120254554-120254584
  misc_feature 1..30: note = hyper
  source 1..30: mol_type = genomic DNA

SEQ ID NO: 47523 - DNA, 51 bp, Homo sapiens; identical to SEQ ID NO: 26600
  misc_feature 1..51: note = chr1:147775362-147775413
  misc_feature 1..51: note = hyper
  source 1..51: mol_type = genomic DNA

SEQ ID NO: 47524 - DNA, 87 bp, Homo sapiens; identical to SEQ ID NO: 26601
  misc_feature 1..87: note = chr1:147775510-147775597
  misc_feature 1..87: note = hyper
  source 1..87: mol_type = genomic DNA

SEQ ID NO: 47525 - DNA, 121 bp, Homo sapiens; identical to SEQ ID NO: 26602
  misc_feature 1..121: note = chr1:150185824-150185945
  misc_feature 1..121: note = hyper
  source 1..121: mol_type = genomic DNA

SEQ ID NO: 47526 - DNA, 78 bp, Homo sapiens; identical to SEQ ID NO: 26603
  misc_feature 1..78: note = chr1:151118621-151118699
  misc_feature 1..78: note = hyper
  source 1..78: mol_type = genomic DNA

SEQ ID NO: 47527 - DNA, 40 bp, Homo sapiens; identical to SEQ ID NO: 26604
  misc_feature 1..40: note = chr1:151445937-151445977
  misc_feature 1..40: note = hyper
  source 1..40: mol_type = genomic DNA

SEQ ID NO: 47528 - DNA, 30 bp, Homo sapiens; identical to SEQ ID NO: 5725
  misc_feature 1..30: note = chr1:151689335-151689365
  misc_feature 1..30: note = hyper
  source 1..30: mol_type = genomic DNA

SEQ ID NO: 47529 - DNA, 55 bp, Homo sapiens; identical to SEQ ID NO: 17177
  misc_feature 1..55: note = chr1:151694351-151694406
  misc_feature 1..55: note = hyper
  source 1..55: mol_type = genomic DNA

SEQ ID NO: 47530 - DNA, 60 bp, Homo sapiens; identical to SEQ ID NO: 26607
  misc_feature 1..60: note = chr1:152083305-152083365
  misc_feature 1..60: note = hyper
  source 1..60: mol_type = genomic DNA

SEQ ID NO: 47531 - DNA, 119 bp, Homo sapiens; identical to SEQ ID NO: 26608
  misc_feature 1..119: note = chr1:152083590-152083709
  misc_feature 1..119: note = hyper
  source 1..119: mol_type = genomic DNA

SEQ ID NO: 47532 - DNA, 435 bp, Homo sapiens; identical to SEQ ID NO: 26609
  misc_feature 1..435: note = chr1:152083710-152084145
  misc_feature 1..435: note = hyper
  source 1..435: mol_type = genomic DNA

SEQ ID NO: 47533 - DNA, 834 bp, Homo sapiens
  misc_feature 1..834: note = chr1:152084564-152085398
  misc_feature 1..834: note = hyper
  source 1..834: mol_type = genomic DNA
ctgctgctcgcgcctctcctcctcctgctcgcgcctcagctgctgctcgcgcctctcctcctcctgctcgcgcctcagctgctgctcgcgcctctcctcctgctcgcgcctcagctgctgctcgcgcctctcctcctgctgctcgcgcctctcctgctgctcgcgcctctcctcctgctgctcgcgcctctcctcctcctgcttgcgccttagttgctgctcgcgcctcagcctttgctgctgctgctcttcctcctggcgctccctcctcagctcttgccgctccagcttccgtagctgctcttcttcctcctggagctctctttgccgctgcggctcctcttcctgcaacttctcttcttccttccggagcactgtctcgcgcttcctccactctttctcttcttcctcctggaacactctgtcttgccgctctcgcctttgctgctgtttctcctcgcggcccttcctcctcagctccagcagctcccgccttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgctt

SEQ ID NO: 47534 - DNA, 44 bp, Homo sapiens
  misc_feature 1..44: note = chr1:152085504-152085548
  misc_feature 1..44: note = hyper
  source 1..44: mol_type = genomic DNA
agatccagaagttccaggatcagatctaccgtcttagggtcatg

SEQ ID NO: 47535 - DNA, 168 bp, Homo sapiens; identical to SEQ ID NO: 26611
  misc_feature 1..168: note = chr1:152487789-152487957
  misc_feature 1..168: note = hyper
  source 1..168: mol_type = genomic DNA

SEQ ID NO: 47536 - DNA, 151 bp, Homo sapiens
  misc_feature 1..151: note = chr1:152487999-152488150
  misc_feature 1..151: note = hyper
  source 1..151: mol_type = genomic DNA
cggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctcc

SEQ ID NO: 47537 - DNA, 27 bp, Homo sapiens
  misc_feature 1..27: note = chr1:152488197-152488224
  misc_feature 1..27: note = hyper
  source 1..27: mol_type = genomic DNA
cccagcccagagcgggcccgccccgct

SEQ ID NO: 47538 - DNA, 79 bp, Homo sapiens; identical to SEQ ID NO: 26613
  misc_feature 1..79: note = chr1:153438376-153438455
  misc_feature 1..79: note = hyper
  source 1..79: mol_type = genomic DNA

SEQ ID NO: 47539 - DNA, 167 bp, Homo sapiens
  misc_feature 1..167: note = chr1:153651798-153651965
  misc_feature 1..167: note = hyper
  source 1..167: mol_type = genomic DNA
tgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgc

SEQ ID NO: 47540-47541 - skipped (2 entries)

SEQ ID NO: 47542 - DNA, 67 bp, Homo sapiens
  misc_feature 1..67: note = chr1:154298253-154298320
  misc_feature 1..67: note = hyper
  source 1..67: mol_type = genomic DNA
cgcggggctggaggggccggggagcgggtgtagactggggagcaccgggggccaagatttgggagct

SEQ ID NO: 47543 - DNA, 15 bp, Homo sapiens
  misc_feature 1..15: note = chr1:154474763-154474778
  misc_feature 1..15: note = hyper
  source 1..15: mol_type = genomic DNA
tgctctttcctcctg

SEQ ID NO: 47544 - DNA, 81 bp, Homo sapiens; identical to SEQ ID NO: 95
  misc_feature 1..81: note = chr1:154474987-154475068
  misc_feature 1..81: note = hyper
  source 1..81: mol_type = genomic DNA

SEQ ID NO: 47545 - DNA, 13 bp, Homo sapiens
  misc_feature 1..13: note = chr1:154475531-154475544
  misc_feature 1..13: note = hyper
  source 1..13: mol_type = genomic DNA
ggatgccaggcga

SEQ ID NO: 47546 - DNA, 68 bp, Homo sapiens; identical to SEQ ID NO: 26620
  misc_feature 1..68: note = chr1:154540186-154540254
  misc_feature 1..68: note = hyper
  source 1..68: mol_type = genomic DNA

SEQ ID NO: 47547 - DNA, 47 bp, Homo sapiens; identical to SEQ ID NO: 26621
  misc_feature 1..47: note = chr1:154733207-154733254
  misc_feature 1..47: note = hyper
  source 1..47: mol_type = genomic DNA

SEQ ID NO: 47548 - DNA, 25 bp, Homo sapiens
  misc_feature 1..25: note = chr1:155043657-155043682
  misc_feature 1..25: note = hyper
  source 1..25: mol_type = genomic DNA
ccacgggagccgggctggggaggtt

SEQ ID NO: 47549 - DNA, 15 bp, Homo sapiens
  misc_feature 1..15: note = chr1:155147247-155147262
  misc_feature 1..15: note = hyper
  source 1..15: mol_type = genomic DNA
ccgctgaccgggttg

SEQ ID NO: 47550 - DNA, 248 bp, Homo sapiens; identical to SEQ ID NO: 17188
  misc_feature 1..248: note = chr1:156215359-156215607
  misc_feature 1..248: note = hyper
  source 1..248: mol_type = genomic DNA

SEQ ID NO: 47551 - DNA, 80 bp, Homo sapiens; identical to SEQ ID NO: 26625
  misc_feature 1..80: note = chr1:156339180-156339260
  misc_feature 1..80: note = hyper
  source 1..80: mol_type = genomic DNA

SEQ ID NO: 47552 - DNA, 138 bp, Homo sapiens
  misc_feature 1..138: note = chr1:156357855-156357993
  misc_feature 1..138: note = hyper
  source 1..138: mol_type = genomic DNA
tgagggaaggttctccggaagcagccgctgttctggcttggcgcaagtgcgtgtggacgacagcaggatttcctgcccagggacatctggataagaggcccaaggtccccaggagcccccaggtgcttctgccctgtg

SEQ ID NO: 47553 - DNA, 68 bp, Homo sapiens
  misc_feature 1..68: note = chr1:156358508-156358576
  misc_feature 1..68: note = hyper
  source 1..68: mol_type = genomic DNA
gaggcggccactgcatagggatgagctgttgtcccggagcgcccgggacagagcgccattgtctgtgc

SEQ ID NO: 47554 - DNA, 27 bp, Homo sapiens
  misc_feature 1..27: note = chr1:156390108-156390135
  misc_feature 1..27: note = hyper
  source 1..27: mol_type = genomic DNA
ccccgggcccctctgcgcagtgtatgg

SEQ ID NO: 47555 - DNA, 518 bp, Homo sapiens
  misc_feature 1..518: note = chr1:156390698-156391216
  misc_feature 1..518: note = hyper
  source 1..518: mol_type = genomic DNA
tgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtg

SEQ ID NO: 47556 - DNA, 286 bp, Homo sapiens; identical to SEQ ID NO: 26628
  misc_feature 1..286: note = chr1:156391242-156391528
  misc_feature 1..286: note = hyper
  source 1..286: mol_type = genomic DNA

SEQ ID NO: 47557 - DNA, 48 bp, Homo sapiens; identical to SEQ ID NO: 1821
  misc_feature 1..48: note = chr1:156405367-156405415
  misc_feature 1..48: note = hyper
  source 1..48: mol_type = genomic DNA

SEQ ID NO: 47558 - DNA, 166 bp, Homo sapiens
  misc_feature 1..166: note = chr1:156406431-156406597
  misc_feature 1..166: note = hyper
  source 1..166: mol_type = genomic DNA
gccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcag

SEQ ID NO: 47559 - DNA, 30 bp, Homo sapiens; identical to SEQ ID NO: 5745
  misc_feature 1..30: note = chr1:156468873-156468903
  misc_feature 1..30: note = hyper
  source 1..30: mol_type = genomic DNA

SEQ ID NO: 47560 - DNA, 51 bp, Homo sapiens; identical to SEQ ID NO: 26633
  misc_feature 1..51: note = chr1:156474407-156474458
  misc_feature 1..51: note = hyper
  source 1..51: mol_type = genomic DNA

SEQ ID NO: 47561 - DNA, 212 bp, Homo sapiens; identical to SEQ ID NO: 26634
  misc_feature 1..212: note = chr1:156594433-156594645
  misc_feature 1..212: note = hyper
  source 1..212: mol_type = genomic DNA

SEQ ID NO: 47562 - DNA, 124 bp, Homo sapiens
  misc_feature 1..124: note = chr1:156594850-156594974
  misc_feature 1..124: note = hyper
  source 1..124: mol_type = genomic DNA
cgcccaccctgccctcggtcggtgacccgctgtggtccccaggccaagtgttcttcgtgcccgggcggctgacgctgtctgaagcccacgcggcgtgccggcgacgcggcgccgtggtggccaa

SEQ ID NO: 47563 - DNA, 32 bp, Homo sapiens; identical to SEQ ID NO: 17198
  misc_feature 1..32: note = chr1:156595021-156595053
  misc_feature 1..32: note = hyper
  source 1..32: mol_type = genomic DNA

SEQ ID NO: 47564 - DNA, 104 bp, Homo sapiens; identical to SEQ ID NO: 5748
  misc_feature 1..104: note = chr1:156595080-156595184
  misc_feature 1..104: note = hyper
  source 1..104: mol_type = genomic DNA

SEQ ID NO: 47565 - DNA, 44 bp, Homo sapiens; identical to SEQ ID NO: 26637
  misc_feature 1..44: note = chr1:156595221-156595265
  misc_feature 1..44: note = hyper
  source 1..44: mol_type = genomic DNA

SEQ ID NO: 47566 - DNA, 114 bp, Homo sapiens; identical to SEQ ID NO: 17200
  misc_feature 1..114: note = chr1:156611775-156611889
  misc_feature 1..114: note = hyper
  source 1..114: mol_type = genomic DNA

SEQ ID NO: 47567 - DNA, 114 bp, Homo sapiens
  misc_feature 1..114: note = chr1:156626475-156626589
  misc_feature 1..114: note = hyper
  source 1..114: mol_type = genomic DNA
gatggagacccaggccggaactccatccctcaccctggttcctgtctcttagaaaaggcaccagcgcccctgcccaagagcccctccaggctcctgctaccccctcattctcta

SEQ ID NO: 47568 - DNA, 233 bp, Homo sapiens
  misc_feature 1..233: note = chr1:156626658-156626891
  misc_feature 1..233: note = hyper
  source 1..233: mol_type = genomic DNA
accagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtg

SEQ ID NO: 47569 - DNA, 153 bp, Homo sapiens
  misc_feature 1..153: note = chr1:156646647-156646800
  misc_feature 1..153: note = hyper
  source 1..153: mol_type = genomic DNA
gctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctctt

SEQ ID NO: 47570 - DNA, 179 bp, Homo sapiens
  misc_feature 1..179: note = chr1:156814754-156814933
  misc_feature 1..179: note = hyper
  source 1..179: mol_type = genomic DNA
gaggggcaagcaaagcgaggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggt

SEQ ID NO: 47571 - DNA, 94 bp, Homo sapiens; identical to SEQ ID NO: 17204
  misc_feature 1..94: note = chr1:156815146-156815240
  misc_feature 1..94: note = hyper
  source 1..94: mol_type = genomic DNA

SEQ ID NO: 47572 - DNA, 172 bp, Homo sapiens
  misc_feature 1..172: note = chr1:156815273-156815445
  misc_feature 1..172: note = hyper
  source 1..172: mol_type = genomic DNA
cgcctccaaaagcacccacaacccgggacccgcccacacaagcaaggccccacccacaaaccccacccctcccgcaagacccgcccctcacaggccccactcatcagaccctcccaggccgcgcgcgctcttcgcacatggggatggtgatcgcgttgtgtagaaagttttc

SEQ ID NO: 47573 - skipped

SEQ ID NO: 47574 - DNA, 467 bp, Homo sapiens; identical to SEQ ID NO: 26645
  misc_feature 1..467: note = chr1:156818562-156819029
  misc_feature 1..467: note = hyper
  source 1..467: mol_type = genomic DNA

SEQ ID NO: 47575 - DNA, 54 bp, Homo sapiens; identical to SEQ ID NO: 26646
  misc_feature 1..54: note = chr1:156829171-156829225
  misc_feature 1..54: note = hyper
  source 1..54: mol_type = genomic DNA

SEQ ID NO: 47576 - DNA, 30 bp, Homo sapiens; identical to SEQ ID NO: 26647
  misc_feature 1..30: note = chr1:156829545-156829575
  misc_feature 1..30: note = hyper
  source 1..30: mol_type = genomic DNA

SEQ ID NO: 47577 - skipped

SEQ ID NO: 47578 - DNA, 96 bp, Homo sapiens; identical to SEQ ID NO: 26649
  misc_feature 1..96: note = chr1:156830979-156831075
  misc_feature 1..96: note = hyper
  source 1..96: mol_type = genomic DNA

SEQ ID NO: 47579 - DNA, 46 bp, Homo sapiens; identical to SEQ ID NO: 17206
  misc_feature 1..46: note = chr1:156863061-156863107
  misc_feature 1..46: note = hyper
  source 1..46: mol_type = genomic DNA

SEQ ID NO: 47580 - DNA, 155 bp, Homo sapiens; identical to SEQ ID NO: 17207
  misc_feature 1..155: note = chr1:156863331-156863486
  misc_feature 1..155: note = hyper
  source 1..155: mol_type = genomic DNA

SEQ ID NO: 47581 - DNA, 22 bp, Homo sapiens
  misc_feature 1..22: note = chr1:156863640-156863662
  misc_feature 1..22: note = hyper
  source 1..22: mol_type = genomic DNA
cgcgccccctggcaggggaggc

SEQ ID NO: 47582 - DNA, 30 bp, Homo sapiens; identical to SEQ ID NO: 26652
  misc_feature 1..30: note = chr1:156890393-156890423
  misc_feature 1..30: note = hyper
  source 1..30: mol_type = genomic DNA

SEQ ID NO: 47583 - DNA, 85 bp, Homo sapiens; identical to SEQ ID NO: 26653
  misc_feature 1..85: note = chr1:156890711-156890796
  misc_feature 1..85: note = hyper
  source 1..85: mol_type = genomic DNA

SEQ ID NO: 47584 - DNA, 142 bp, Homo sapiens; identical to SEQ ID NO: 26654
  misc_feature 1..142: note = chr1:156893837-156893979
  misc_feature 1..142: note = hyper
  source 1..142: mol_type = genomic DNA

SEQ ID NO: 47585 - DNA, 40 bp, Homo sapiens; identical to SEQ ID NO: 5761
  misc_feature 1..40: note = chr1:156894252-156894292
  misc_feature 1..40: note = hyper
  source 1..40: mol_type = genomic DNA

SEQ ID NO: 47586 - DNA, 41 bp, Homo sapiens; identical to SEQ ID NO: 26656
  misc_feature 1..41: note = chr1:157963385-157963426
  misc_feature 1..41: note = hyper
  source 1..41: mol_type = genomic DNA

SEQ ID NO: 47587 - DNA, 52 bp, Homo sapiens; identical to SEQ ID NO: 26657
  misc_feature 1..52: note = chr1:157963443-157963495
  misc_feature 1..52: note = hyper
  source 1..52: mol_type = genomic DNA

SEQ ID NO: 47588 - DNA, 154 bp, Homo sapiens; identical to SEQ ID NO: 26658
  misc_feature 1..154: note = chr1:157963737-157963891
  misc_feature 1..154: note = hyper
  source 1..154: mol_type = genomic DNA

SEQ ID NO: 47589 - DNA, 401 bp, Homo sapiens; identical to SEQ ID NO: 5763
  misc_feature 1..401: note = chr1:158083182-158083583
  misc_feature 1..401: note = hyper
  source 1..401: mol_type = genomic DNA

SEQ ID NO: 47590 - DNA, 44 bp, Homo sapiens; identical to SEQ ID NO: 1828
  misc_feature 1..44: note = chr1:158150605-158150649
  misc_feature 1..44: note = hyper
  source 1..44: mol_type = genomic DNA

SEQ ID NO: 47591 - DNA, 147 bp, Homo sapiens; identical to SEQ ID NO: 1829
  misc_feature 1..147: note = chr1:158150650-158150797
  misc_feature 1..147: note = hyper
  source 1..147: mol_type = genomic DNA

SEQ ID NO: 47592 - DNA, 161 bp, Homo sapiens; identical to SEQ ID NO: 26662
  misc_feature 1..161: note = chr1:158150798-158150959
  misc_feature 1..161: note = hyper
  source 1..161: mol_type = genomic DNA

SEQ ID NO: 47593 - DNA, 110 bp, Homo sapiens; identical to SEQ ID NO: 26663
  misc_feature 1..110: note = chr1:159141434-159141544
  misc_feature 1..110: note = hyper
  source 1..110: mol_type = genomic DNA

SEQ ID NO: 47594 - DNA, 132 bp, Homo sapiens; identical to SEQ ID NO: 26664
  misc_feature 1..132: note = chr1:159141599-159141731
  misc_feature 1..132: note = hyper
  source 1..132: mol_type = genomic DNA

SEQ ID NO: 47595 - DNA, 43 bp, Homo sapiens
  misc_feature 1..43: note = chr1:159158305-159158348
  misc_feature 1..43: note = hyper
  source 1..43: mol_type = genomic DNA
cagctggctctgagtcgcgctgggacgactggcgaagttcacc

SEQ ID NO: 47596 - DNA, 76 bp, Homo sapiens; identical to SEQ ID NO: 26667
  misc_feature 1..76: note = chr1:159750570-159750646
  misc_feature 1..76: note = hyper
  source 1..76: mol_type = genomic DNA

SEQ ID NO: 47597 - DNA, 52 bp, Homo sapiens; identical to SEQ ID NO: 26668
  misc_feature 1..52: note = chr1:159750677-159750729
  misc_feature 1..52: note = hyper
  source 1..52: mol_type = genomic DNA

SEQ ID NO: 47598 - DNA, 114 bp, Homo sapiens; identical to SEQ ID NO: 26669
  misc_feature 1..114: note = chr1:159751133-159751247
  misc_feature 1..114: note = hyper
  source 1..114: mol_type = genomic DNA

SEQ ID NO: 47599 - DNA, 30 bp, Homo sapiens; identical to SEQ ID NO: 26670
  misc_feature 1..30: note = chr1:160039721-160039751
  misc_feature 1..30: note = hyper
  source 1..30: mol_type = genomic DNA

SEQ ID NO: 47600 - DNA, 129 bp, Homo sapiens; identical to SEQ ID NO: 26671
  misc_feature 1..129: note = chr1:160040345-160040474
  misc_feature 1..129: note = hyper
  source 1..129: mol_type = genomic DNA

SEQ ID NO: 47601 - DNA, 158 bp, Homo sapiens; identical to SEQ ID NO: 26672
  misc_feature 1..158: note = chr1:160370097-160370255
  misc_feature 1..158: note = hyper
  source 1..158: mol_type = genomic DNA

SEQ ID NO: 47602 - DNA, 30 bp, Homo sapiens; identical to SEQ ID NO: 26673
  misc_feature 1..30: note = chr1:160370599-160370629
  misc_feature 1..30: note = hyper
  source 1..30: mol_type = genomic DNA

SEQ ID NO: 47603 - DNA, 114 bp, Homo sapiens; identical to SEQ ID NO: 26674
  misc_feature 1..114: note = chr1:161068047-161068161
  misc_feature 1..114: note = hyper
  source 1..114: mol_type = genomic DNA

SEQ ID NO: 47604 - DNA, 179 bp, Homo sapiens; identical to SEQ ID NO: 26675
  misc_feature 1..179: note = chr1:161068380-161068559
  misc_feature 1..179: note = hyper
  source 1..179: mol_type = genomic DNA

SEQ ID NO: 47605 - DNA, 97 bp, Homo sapiens
  misc_feature 1..97: note = chr1:161276026-161276123
  misc_feature 1..97: note = hyper
  source 1..97: mol_type = genomic DNA
cttccccttggccctcccacccactggagtagtctccgcccagatgggggatagtggggagagggggaggggagctaggctccgccccttacctgag

SEQ ID NO: 47606 - DNA, 97 bp, Homo sapiens; identical to SEQ ID NO: 26678
  misc_feature 1..97: note = chr1:161409851-161409948
  misc_feature 1..97: note = hyper
  source 1..97: mol_type = genomic DNA

SEQ ID NO: 47607 - DNA, 171 bp, Homo sapiens; identical to SEQ ID NO: 26679
  misc_feature 1..171: note = chr1:161494827-161494998
  misc_feature 1..171: note = hyper
  source 1..171: mol_type = genomic DNA

SEQ ID NO: 47608 - DNA, 94 bp, Homo sapiens; identical to SEQ ID NO: 26680
  misc_feature 1..94: note = chr1:161509954-161510048
  misc_feature 1..94: note = hyper
  source 1..94: mol_type = genomic DNA

SEQ ID NO: 47609 - DNA, 154 bp, Homo sapiens; identical to SEQ ID NO: 26681
  misc_feature 1..154: note = chr1:161510108-161510262
  misc_feature 1..154: note = hyper
  source 1..154: mol_type = genomic DNA

SEQ ID NO: 47610 - DNA, 128 bp, Homo sapiens; identical to SEQ ID NO: 26682
  misc_feature 1..128: note = chr1:161581762-161581890
  misc_feature 1..128: note = hyper
  source 1..128: mol_type = genomic DNA

SEQ ID NO: 47611 - DNA, 168 bp, Homo sapiens; identical to SEQ ID NO: 26683
  misc_feature 1..168: note = chr1:161582427-161582595
  misc_feature 1..168: note = hyper
  source 1..168: mol_type = genomic DNA

SEQ ID NO: 47612 - DNA, 30 bp, Homo sapiens; identical to SEQ ID NO: 26684
  misc_feature 1..30: note = chr1:161591283-161591313
  misc_feature 1..30: note = hyper
  source 1..30: mol_type = genomic DNA

SEQ ID NO: 47613 - DNA, 112 bp, Homo sapiens; identical to SEQ ID NO: 26685
  misc_feature 1..112: note = chr1:161591628-161591740
  misc_feature 1..112: note = hyper
  source 1..112: mol_type = genomic DNA

SEQ ID NO: 47614 - DNA, 180 bp, Homo sapiens; identical to SEQ ID NO: 26686
  misc_feature 1..180: note = chr1:161695643-161695823
  misc_feature 1..180: note = hyper
  source 1..180: mol_type = genomic DNA

SEQ ID NO: 47615 - DNA, 185 bp, Homo sapiens; identical to SEQ ID NO: 26687
  misc_feature 1..185: note = chr1:161697126-161697311
  misc_feature 1..185: note = hyper
  source 1..185: mol_type = genomic DNA

SEQ ID NO: 47616 - DNA, 230 bp, Homo sapiens
  misc_feature 1..230: note = chr1:162792076-162792306
  misc_feature 1..230: note = hyper
  source 1..230: mol_type = genomic DNA
gcatttaaaatgaggcgaaagaacaaatggaataattatagaaaattttagcctctagcaaaacactgtgaagcagctccagcctgtggtggaagatgtgcgaaagggatgggggaacgctgtggaccggtgtggagtctaggacgacaggtggtgggctctgtccccacgcgcctcgcggccagcagaggccccctcactgcggccgccgggcgggactggcgcgggcg

SEQ ID NO: 47617 - DNA, 20 bp, Homo sapiens
  misc_feature 1..20: note = chr1:162792533-162792553
  misc_feature 1..20: note = hyper
  source 1..20: mol_type = genomic DNA
cccaccggactgggtgggga

SEQ ID NO: 47618 - DNA, 91 bp, Homo sapiens
  misc_feature 1..91: note = chr1:164290524-164290615
  misc_feature 1..91: note = hyper
  source 1..91: mol_type = genomic DNA
cccctctgttgtgtgcgccgcgtccggggagcctgggccgtgcctccctggcgtatgcaggtcgccggcgcagccgccagctccgggggcc

SEQ ID NO: 47619 - DNA, 28 bp, Homo sapiens
  misc_feature 1..28: note = chr1:165086960-165086988
  misc_feature 1..28: note = hyper
  source 1..28: mol_type = genomic DNA
taattggctgtgacacgcgggccagctg

SEQ ID NO: 47620 - DNA, 189 bp, Homo sapiens; identical to SEQ ID NO: 26691
  misc_feature 1..189: note = chr1:165204385-165204574
  misc_feature 1..189: note = hyper
  source 1..189: mol_type = genomic DNA

SEQ ID NO: 47621 - DNA, 69 bp, Homo sapiens; identical to SEQ ID NO: 26692
  misc_feature 1..69: note = chr1:165204838-165204907
  misc_feature 1..69: note = hyper
  source 1..69: mol_type = genomic DNA

SEQ ID NO: 47622 - DNA, 45 bp, Homo sapiens; identical to SEQ ID NO: 26693
  misc_feature 1..45: note = chr1:165205298-165205343
  misc_feature 1..45: note = hyper
  source 1..45: mol_type = genomic DNA

SEQ ID NO: 47623 - DNA, 86 bp, Homo sapiens
  misc_feature 1..86: note = chr1:165321661-165321747
  misc_feature 1..86: note = hyper
  source 1..86: mol_type = genomic DNA
aaaagcccctgcatccgagggttctgcagaaaaccaggaaggcgacagtgaaagggcgaacgggctgtgcgcttagctccgaatgg

SEQ ID NO: 47624 - DNA, 30 bp, Homo sapiens; identical to SEQ ID NO: 26695
  misc_feature 1..30: note = chr1:165323752-165323782
  misc_feature 1..30: note = hyper
  source 1..30: mol_type = genomic DNA

SEQ ID NO: 47625 - DNA, 18 bp, Homo sapiens
  misc_feature 1..18: note = chr1:165324178-165324196
  misc_feature 1..18: note = hyper
  source 1..18: mol_type = genomic DNA
tccagttaattaacgcgg

SEQ ID NO: 47626 - DNA, 56 bp, Homo sapiens
  misc_feature 1..56: note = chr1:165324249-165324305
  misc_feature 1..56: note = hyper
  source 1..56: mol_type = genomic DNA
cagaaaagtctctctcggccttgcccatggctgaaattggggctggagttggtggg

SEQ ID NO: 47627 - DNA, 131 bp, Homo sapiens
  misc_feature 1..131: note = chr1:165324357-165324488
  misc_feature 1..131: note = hyper
  source 1..131: mol_type = genomic DNA
attgcctctaggccgcgagaagagggcggcatttatgagacgtcgatcagctccgagattaaaaatccagccctgggtatttttaatcacttgccactcagacgcctacgaacaagctcgcccgcccctcg

SEQ ID NO: 47628 - DNA, 440 bp, Homo sapiens
  misc_feature 1..440: note = chr1:165324668-165325108
  misc_feature 1..440: note = hyper
  source 1..440: mol_type = genomic DNA
cagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgcc

SEQ ID NO: 47629 - DNA, 250 bp, Homo sapiens
  misc_feature 1..250: note = chr1:165325646-165325896
  misc_feature 1..250: note = hyper
  source 1..250: mol_type = genomic DNA
ctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggc

SEQ ID NO: 47630 - DNA, 254 bp, Homo sapiens; identical to SEQ ID NO: 17228
  misc_feature 1..254: note = chr1:165325950-165326204
  misc_feature 1..254: note = hyper
  source 1..254: mol_type = genomic DNA

SEQ ID NO: 47631 - DNA, 209 bp, Homo sapiens; identical to SEQ ID NO: 26700
  misc_feature 1..209: note = chr1:165345473-165345682
  misc_feature 1..209: note = hyper
  source 1..209: mol_type = genomic DNA

SEQ ID NO: 47632 - DNA, 132 bp, Homo sapiens; identical to SEQ ID NO: 26701
  misc_feature 1..132: note = chr1:165414298-165414430
  misc_feature 1..132: note = hyper
  source 1..132: mol_type = genomic DNA

SEQ ID NO: 47633 - DNA, 44 bp, Homo sapiens
  misc_feature 1..44: note = chr1:166134203-166134247
  misc_feature 1..44: note = hyper
  source 1..44: mol_type = genomic DNA
agttctgaaaggaggcgggtgcggagttatgaaaatttggtaaa

SEQ ID NO: 47634 - DNA, 422 bp, Homo sapiens
  misc_feature 1..422: note = chr1:166134306-166134728
  misc_feature 1..422: note = hyper
  source 1..422: mol_type = genomic DNA
ggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggac

SEQ ID NO: 47635 - DNA, 95 bp, Homo sapiens; identical to SEQ ID NO: 17233
  misc_feature 1..95: note = chr1:166134796-166134891
  misc_feature 1..95: note = hyper
  source 1..95: mol_type = genomic DNA

SEQ ID NO: 47636 - DNA, 260 bp, Homo sapiens; identical to SEQ ID NO: 17234
  misc_feature 1..260: note = chr1:166134933-166135193
  misc_feature 1..260: note = hyper
  source 1..260: mol_type = genomic DNA

SEQ ID NO: 47637 - DNA, 305 bp, Homo sapiens
  misc_feature 1..305: note = chr1:166135281-166135586
  misc_feature 1..305: note = hyper
  source 1..305: mol_type = genomic DNA
caccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgc

SEQ ID NO: 47638 - DNA, 57 bp, Homo sapiens; identical to SEQ ID NO: 26705
  misc_feature 1..57: note = chr1:166853653-166853710
  misc_feature 1..57: note = hyper
  source 1..57: mol_type = genomic DNA

SEQ ID NO: 47639 - DNA, 16 bp, Homo sapiens
  misc_feature 1..16: note = chr1:166916850-166916866
  misc_feature 1..16: note = hyper
  source 1..16: mol_type = genomic DNA
gctgagccaatttctc

SEQ ID NO: 47640 - DNA, 196 bp, Homo sapiens; identical to SEQ ID NO: 26708
  misc_feature 1..196: note = chr1:166945272-166945468
  misc_feature 1..196: note = hyper
  source 1..196: mol_type = genomic DNA

SEQ ID NO: 47641 - DNA, 286 bp, Homo sapiens; identical to SEQ ID NO: 17236
  misc_feature 1..286: note = chr1:167599330-167599616
  misc_feature 1..286: note = hyper
  source 1..286: mol_type = genomic DNA

SEQ ID NO: 47642 - skipped

SEQ ID NO: 47643 - DNA, 90 bp, Homo sapiens
  misc_feature 1..90: note = chr1:169396286-169396376
  misc_feature 1..90: note = hyper
  source 1..90: mol_type = genomic DNA
taagctactctcagacgagtatccttcatacatagtgaagaaaggtgttaccagacttccccaccagtgccagactcggtggacctcgga

SEQ ID NO: 47644 - DNA, 91 bp, Homo sapiens
  misc_feature 1..91: note = chr1:170630365-170630456
  misc_feature 1..91: note = hyper
  source 1..91: mol_type = genomic DNA
tgaggatagagagtgcgaaaggagggagaggcgaggagctgctctatttctagggaggttttggggagactgatcagctccaaggacagac

SEQ ID NO: 47645 - DNA, 162 bp, Homo sapiens
  misc_feature 1..162: note = chr1:170631315-170631477
  misc_feature 1..162: note = hyper
  source 1..162: mol_type = genomic DNA
gtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttc

SEQ ID NO: 47646 - DNA, 20 bp, Homo sapiens
  misc_feature 1..20: note = chr1:170631559-170631579
  misc_feature 1..20: note = hyper
  source 1..20: mol_type = genomic DNA
attggcgggggtagggagaa

SEQ ID NO: 47647 - DNA, 33 bp, Homo sapiens; identical to SEQ ID NO: 26717
  misc_feature 1..33: note = chr1:170633073-170633106
  misc_feature 1..33: note = hyper
  source 1..33: mol_type = genomic DNA

SEQ ID NO: 47648 - DNA, 46 bp, Homo sapiens; identical to SEQ ID NO: 26718
  misc_feature 1..46: note = chr1:170633432-170633478
  misc_feature 1..46: note = hyper
  source 1..46: mol_type = genomic DNA

SEQ ID NO: 47649 - DNA, 381 bp, Homo sapiens; identical to SEQ ID NO: 26719
  misc_feature 1..381: note = chr1:170633902-170634283
  misc_feature 1..381: note = hyper
  source 1..381: mol_type = genomic DNA

SEQ ID NO: 47650 - DNA, 14 bp, Homo sapiens
  misc_feature 1..14: note = chr1:170637796-170637810
  misc_feature 1..14: note = hyper
  source 1..14: mol_type = genomic DNA
gccagagaaacgcc

SEQ ID NO: 47651 - DNA, 190 bp, Homo sapiens; identical to SEQ ID NO: 26721
  misc_feature 1..190: note = chr1:170640121-170640311
  misc_feature 1..190: note = hyper
  source 1..190: mol_type = genomic DNA

SEQ ID NO: 47652 - DNA, 315 bp, Homo sapiens
  misc_feature 1..315: note = chr1:171810972-171811287
  misc_feature 1..315: note = hyper
  source 1..315: mol_type = genomic DNA
gcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtg

SEQ ID NO: 47653 - DNA, 238 bp, Homo sapiens; identical to SEQ ID NO: 26725
  misc_feature 1..238: note = chr1:171811320-171811558
  misc_feature 1..238: note = hyper
  source 1..238: mol_type = genomic DNA

SEQ ID NO: 47654 - DNA, 142 bp, Homo sapiens; identical to SEQ ID NO: 26727
  misc_feature 1..142: note = chr1:177133445-177133587
  misc_feature 1..142: note = hyper
  source 1..142: mol_type = genomic DNA

SEQ ID NO: 47655 - DNA, 32 bp, Homo sapiens
  misc_feature 1..32: note = chr1:177133689-177133721
  misc_feature 1..32: note = hyper
  source 1..32: mol_type = genomic DNA
cgtgatgcttttgagcttgcactccagctcct

SEQ ID NO: 47656 - DNA, 247 bp, Homo sapiens
  misc_feature 1..247: note = chr1:177133814-177134061
  misc_feature 1..247: note = hyper
  source 1..247: mol_type = genomic DNA
tgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggag

SEQ ID NO: 47657 - DNA, 451 bp, Homo sapiens
  misc_feature 1..451: note = chr1:177150803-177151254
  misc_feature 1..451: note = hyper
  source 1..451: mol_type = genomic DNA
tatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggggagggacagttgcatttgcagaagcaatcctgtctggaactaagctgattagtcctggtgccgtccctccctccct

SEQ ID NO: 47658 - DNA, 30 bp, Homo sapiens; identical to SEQ ID NO: 26733
  misc_feature 1..30: note = chr1:178063661-178063691
  misc_feature 1..30: note = hyper
  source 1..30: mol_type = genomic DNA

SEQ ID NO: 47659 - DNA, 182 bp, Homo sapiens
  misc_feature 1..182: note = chr1:179544785-179544967
  misc_feature 1..182: note = hyper
  source 1..182: mol_type = genomic DNA
ctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggac

SEQ ID NO: 47660 - DNA, 82 bp, Homo sapiens
  misc_feature 1..82: note = chr1:179545098-179545180
  misc_feature 1..82: note = hyper
  source 1..82: mol_type = genomic DNA
ggggaccctaaagaccgtcgggtgggggctgagggcgaggggcgggacaccggggccgcgggcggggcgcacccggaacccc

SEQ ID NO: 47661 - DNA, 222 bp, Homo sapiens
  misc_feature 1..222: note = chr1:179711942-179712164
  misc_feature 1..222: note = hyper
  source 1..222: mol_type = genomic DNA
gatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaag

SEQ ID NO: 47662 - DNA, 247 bp, Homo sapiens; identical to SEQ ID NO: 17249
  misc_feature 1..247: note = chr1:180198209-180198456
  misc_feature 1..247: note = hyper
  source 1..247: mol_type = genomic DNA

SEQ ID NO: 47663 - DNA, 158 bp, Homo sapiens; identical to SEQ ID NO: 5816
  misc_feature 1..158: note = chr1:180202237-180202395
  misc_feature 1..158: note = hyper
  source 1..158: mol_type = genomic DNA

SEQ ID NO: 47664 - DNA, 278 bp, Homo sapiens
  misc_feature 1..278: note = chr1:180203016-180203294
  misc_feature 1..278: note = hyper
  source 1..278: mol_type = genomic DNA
aaggtattttattttgtgtttggtagggtcggggtaaaggttttccctgggacttcctctcctggggctcctccggggtgcgtggggtaatgtcccagcgcaggtcgagttgcagatccgagtccccggggttgttgactgtccttcttgcaggacatttcttaagggggtgagatggattcactgtccaagacaggagttcactcaaacgctggtgctgttcgctcttctttccattcctgccttgtctcctagtgcgagaaacagacacacacaac

SEQ ID NO: 47665 - DNA, 59 bp, Homo sapiens
  misc_feature 1..59: note = chr1:180203354-180203413
  misc_feature 1..59: note = hyper
  source 1..59: mol_type = genomic DNA
taatagattgagattctatcatattccgaacattccgatatagcagctgtaggcaccat

SEQ ID NO: 47666 - DNA, 447 bp, Homo sapiens
  misc_feature 1..447: note = chr1:180204924-180205371
  misc_feature 1..447: note = hyper
  source 1..447: mol_type = genomic DNA
caccgggtgcactcaccgcacgagaggccgcggctggactgggaccgagcgcatccctgtgtctcagggggtttgctttgtgcaggatgggaccttattatttttagacagtggggcaaacgtgtcttttaaagagatccgaagggtgaaactaatgaaaaaggaaatgaattactagaaaagccgtgaagggataaaaccgggagcagcaggaagttgaaggaaggacgaccgaagctaggtgtatctgcacctgcctcttgacacgccaaaaacaaaggggggttaaggcaagaatgtagactaaatgctgtgaggattagggtaacgcgagccctcaagacgtctcggagaccgcctacagggctgcaaataccagggtccatttttaaaaatcgagtgctcctagaggtggggtgggggtgggagagccgggaaaccagcaaa

SEQ ID NO: 47667 - DNA, 60 bp, Homo sapiens; identical to SEQ ID NO: 26748
  misc_feature 1..60: note = chr1:180206312-180206372
  misc_feature 1..60: note = hyper
  source 1..60: mol_type = genomic DNA

SEQ ID NO: 47668 - DNA, 118 bp, Homo sapiens; identical to SEQ ID NO: 5824
  misc_feature 1..118: note = chr1:180881433-180881551
  misc_feature 1..118: note = hyper
  source 1..118: mol_type = genomic DNA

SEQ ID NO: 47669 - DNA, 428 bp, Homo sapiens; identical to SEQ ID NO: 26750
  misc_feature 1..428: note = chr1:180882004-180882432
  misc_feature 1..428: note = hyper
  source 1..428: mol_type = genomic DNA

SEQ ID NO: 47670 - DNA, 30 bp, Homo sapiens; identical to SEQ ID NO: 26751
  misc_feature 1..30: note = chr1:181286935-181286965
  misc_feature 1..30: note = hyper
  source 1..30: mol_type = genomic DNA

SEQ ID NO: 47671 - DNA, 348 bp, Homo sapiens
  misc_feature 1..348: note = chr1:181287331-181287679
  misc_feature 1..348: note = hyper
  source 1..348: mol_type = genomic DNA
tgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctc

SEQ ID NO: 47672 - DNA, 257 bp, Homo sapiens
  misc_feature 1..257: note = chr1:181287757-181288014
  misc_feature 1..257: note = hyper
  source 1..257: mol_type = genomic DNA
ccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtaggggaggaaagagcacagaggaagccaggctgcatagggtg

SEQ ID NO: 47673 - DNA, 14 bp, Homo sapiens
  misc_feature 1..14: note = chr1:181288188-181288202
  misc_feature 1..14: note = hyper
  source 1..14: mol_type = genomic DNA
gcagaggactgagg

SEQ ID NO: 47674 - DNA, 87 bp, Homo sapiens
  misc_feature 1..87: note = chr1:181451320-181451407
  misc_feature 1..87: note = hyper
  source 1..87: mol_type = genomic DNA
ggagcctgggaggtgcggaggagcggcgacgcggccatggcgctaggcgcgcaaaggccccgacaccttactagggcggcggcgggc

SEQ ID NO: 47675 - DNA, 239 bp, Homo sapiens; identical to SEQ ID NO: 17260
  misc_feature 1..239: note = chr1:181452120-181452359
  misc_feature 1..239: note = hyper
  source 1..239: mol_type = genomic DNA

SEQ ID NO: 47676 - DNA, 180 bp, Homo sapiens; identical to SEQ ID NO: 17261
  misc_feature 1..180: note = chr1:181452691-181452871
  misc_feature 1..180: note = hyper
  source 1..180: mol_type = genomic DNA

SEQ ID NO: 47677 - DNA, 19 bp, Homo sapiens
  misc_feature 1..19: note = chr1:181452967-181452986
  misc_feature 1..19: note = hyper
  source 1..19: mol_type = genomic DNA
gtgccggcctcggggcagg

SEQ ID NO: 47678 - DNA, 60 bp, Homo sapiens; identical to SEQ ID NO: 26755
  misc_feature 1..60: note = chr1:181453050-181453110
  misc_feature 1..60: note = hyper
  source 1..60: mol_type = genomic DNA

SEQ ID NO: 47679 - DNA, 169 bp, Homo sapiens
  misc_feature 1..169: note = chr1:181454704-181454873
  misc_feature 1..169: note = hyper
  source 1..169: mol_type = genomic DNA
attgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctggg

SEQ ID NO: 47680 - DNA, 271 bp, Homo sapiens
  misc_feature 1..271: note = chr1:181454912-181455183
  misc_feature 1..271: note = hyper
  source 1..271: mol_type = genomic DNA
tcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgt

SEQ ID NO: 47681 - DNA, 86 bp, Homo sapiens
  misc_feature 1..86: note = chr1:181455263-181455349
  misc_feature 1..86: note = hyper
  source 1..86: mol_type = genomic DNA
tgtgagtcttactcctccctttccttgtctttggccaaaaatggaccaaagagagtcaaacgggagactctcgagggagttgattt

SEQ ID NO: 47682 - DNA, 165 bp, Homo sapiens
  misc_feature 1..165: note = chr1:183385985-183386150
  misc_feature 1..165: note = hyper
  source 1..165: mol_type = genomic DNA
ctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcg

SEQ ID NO: 47683 - DNA, 31 bp, Homo sapiens
  misc_feature 1..31: note = chr1:183386288-183386319
  misc_feature 1..31: note = hyper
  source 1..31: mol_type = genomic DNA
cgagcagctgcgaagccgcgtggcttcccac

SEQ ID NO: 47684 - DNA, 201 bp, Homo sapiens
  misc_feature 1..201: note = chr1:183386626-183386827
  misc_feature 1..201: note = hyper
  source 1..201: mol_type = genomic DNA
agcctccgcccggccccctccccgtcctaggcagcgggtccctgaggccgaacctaggcggaaaagggccccctccctattcactcagcatccacctcgcgcgggcaatacacggcccacaattcccaaacactggtccctgggccgcccagaatcaccagccaaatccgaaattaatcttgaagccccagcccctgtcac

SEQ ID NO: 47685 - DNA, 302 bp, Homo sapiens
  misc_feature 1..302: note = chr1:183386964-183387266
  misc_feature 1..302: note = hyper
  source 1..302: mol_type = genomic DNA
ccccatcccggtcttcgccagcctggtagccgaaccaccgcaccgccacactccagttctggtatctcgaacccctgcccagccccaaatgatactcatctctagtcccctcccatcccccacctttggccccctgcgagccgggtctggccccggcaagtgacgcctcggaaacgcagtctgcgtaccctcccctgagtccaaaatgaaggggccgacctccaccagctggatgagccggcccacccctccgaaggggcacacgccttcccgttcgatcgccctggaaaacacaggtgcct

SEQ ID NO: 47686 - DNA, 304 bp, Homo sapiens
  misc_feature 1..304: note = chr1:183387319-183387623
  misc_feature 1..304: note = hyper
  source 1..304: mol_type = genomic DNA
aacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgtattgctctgctctcttctctcct

SEQ ID NO: 47687 - skipped

SEQ ID NO: 47688 - DNA, 146 bp, Homo sapiens
  misc_feature 1..146: note = chr1:183774098-183774244
  misc_feature 1..146: note = hyper
  source 1..146: mol_type = genomic DNA
tcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgc

SEQ ID NO: 47689 - DNA, 66 bp, Homo sapiens; identical to SEQ ID NO: 17269
  misc_feature 1..66: note = chr1:183774363-183774429
  misc_feature 1..66: note = hyper
  source 1..66: mol_type = genomic DNA

SEQ ID NO: 47690 - DNA, 224 bp, Homo sapiens
  misc_feature 1..224: note = chr1:184005477-184005701
  misc_feature 1..224: note = hyper
  source 1..224: mol_type = genomic DNA
caagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccag

SEQ ID NO: 47691 - DNA, 824 bp, Homo sapiens
  misc_feature 1..824: note = chr1:184005814-184006638
  misc_feature 1..824: note = hyper
  source 1..824: mol_type = genomic DNA
atacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactgg

SEQ ID NO: 47692 - DNA, 34 bp, Homo sapiens; identical to SEQ ID NO: 26765
  misc_feature 1..34: note = chr1:184633316-184633350
  misc_feature 1..34: note = hyper
  source 1..34: mol_type = genomic DNA

SEQ ID NO: 47693 - DNA, 71 bp, Homo sapiens; identical to SEQ ID NO: 26766
  misc_feature 1..71: note = chr1:186649956-186650027
  misc_feature 1..71: note = hyper
  source 1..71: mol_type = genomic DNA

SEQ ID NO: 47694 - DNA, 429 bp, Homo sapiens; identical to SEQ ID NO: 26767
  misc_feature 1..429: note = chr1:190444251-190444680
  misc_feature 1..429: note = hyper
  source 1..429: mol_type = genomic DNA

SEQ ID NO: 47695 - DNA, 20 bp, Homo sapiens
  misc_feature 1..20: note = chr1:190445161-190445181
  misc_feature 1..20: note = hyper
  source 1..20: mol_type = genomic DNA
gggcgccaagtggtgcggac

SEQ ID NO: 47696 - DNA, 378 bp, Homo sapiens
  misc_feature 1..378: note = chr1:190445276-190445654
  misc_feature 1..378: note = hyper
  source 1..378: mol_type = genomic DNA
acttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtga

SEQ ID NO: 47697-47698 - skipped (2 entries)

SEQ ID NO: 47699 - DNA, 195 bp, Homo sapiens; identical to SEQ ID NO: 17274
  misc_feature 1..195: note = chr1:190447519-190447714
  misc_feature 1..195: note = hyper
  source 1..195: mol_type = genomic DNA

SEQ ID NO: 47700 - DNA, 64 bp, Homo sapiens; identical to SEQ ID NO: 26773
  misc_feature 1..64: note = chr1:196577371-196577435
  misc_feature 1..64: note = hyper
  source 1..64: mol_type = genomic DNA

SEQ ID NO: 47701 - DNA, 243 bp, Homo sapiens
  misc_feature 1..243: note = chr1:196577858-196578101
  misc_feature 1..243: note = hyper
  source 1..243: mol_type = genomic DNA
cactttccttaaaggcagttgccagatcctcccagagggcagcctcccggctactgttccctcgggcgggcttgcatccggcacagccctgagctggcgggaatcgggggcggtgggtttcggccccagacgcggccaacccggctctccccgcaatctccctgtggagatggagctggaggcccagccaatgagactccccctcattagcatagcacagtgacggcacgggggtgccttggg

SEQ ID NO: 47702 - DNA, 210 bp, Homo sapiens
  misc_feature 1..210: note = chr1:196578150-196578360
  misc_feature 1..210: note = hyper
  source 1..210: mol_type = genomic DNA
ttctctgggaggaggggggccagggtgcttggagtgttccactatgccacgagctccctcgctttgattgccttcagtccaggtgggcgggatgaaaaaattgcacgtttctggaaagggaatccccactctcagccccaggaaaatcccatttttttctcacattctgaaagaagggaggtgtttccctgaactcggggaaaaagaagg

SEQ ID NO: 47703 - DNA, 915 bp, Homo sapiens
  misc_feature 1..915: note = chr1:197880156-197881071
  misc_feature 1..915: note = hyper
  source 1..915: mol_type = genomic DNA
cgggcgtccccccacaccccccccccactgcgccctggacccacgccacgcaccgccaaggagtagctatggtggcacgtggaggaggggcgggtaggcagggcggcaccatcaccgggaccagcatcttggaacggtcaatctcactgctcatactctcctccctaccggcgcgggagccttgctgtaatcccctgccaccccatctccgactgtgaggggcgcaccgggtgggggaatgggtaaataactggcccaaggcccagcttccaggtcctccctccactttcccgcggcctgactgcgccccgggcaacacagccccttgggaacctgcgaccaggtaatgtggcctccgccccgtcccgggtctggctgcatcccctctaacccctgcctgcccgggtccaagtgagggttttctcccggaaggttaatcaccacccccatcccctagccgggtcccgggaggaagagatgccccggctctctcgttgacccggcctcgaacgccgacctcgagcgcagaatactcccgagtgctgggttcctgatacccagcccgggagcgaggggagtgaaggagggaccgggacaggaaggcggggacgcggtgggtgaacaatcaatggcttagcctagtttccccgcaggagctaccgcccattcaccgtctatgcaagcaccagctggcggcagcatcttttaggtacaagctgcagggaggcaaaagctggctggggggccgggagcccagggcacgccgcgggactccagtccccctgctgcgccccagcctcaagacgctctgggctttatgaggttcagttaccgccgagtcctccattaacacctcctctgattattgagaggctggaagggctgaacgcaacctcagagcgtttctctgggcac

SEQ ID NO: 47704 - DNA, 192 bp, Homo sapiens; identical to SEQ ID NO: 26777
  misc_feature 1..192: note = chr1:197881412-197881604
  misc_feature 1..192: note = hyper
  source 1..192: mol_type = genomic DNA

SEQ ID NO: 47705 - skipped

SEQ ID NO: 47706 - DNA, 26 bp, Homo sapiens
  misc_feature 1..26: note = chr1:197882427-197882453
  misc_feature 1..26: note = hyper
  source 1..26: mol_type = genomic DNA
ttggccgggaagtaccgcccagcgaa

SEQ ID NO: 47707 - DNA, 60 bp, Homo sapiens; identical to SEQ ID NO: 5850
  misc_feature 1..60: note = chr1:197885234-197885294
  misc_feature 1..60: note = hyper
  source 1..60: mol_type = genomic DNA

SEQ ID NO: 47708 - DNA, 201 bp, Homo sapiens
  misc_feature 1..201: note = chr1:197886851-197887052
  misc_feature 1..201: note = hyper
  source 1..201: mol_type = genomic DNA
ctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatc

SEQ ID NO: 47709 - DNA, 311 bp, Homo sapiens; identical to SEQ ID NO: 17282
  misc_feature 1..311: note = chr1:197887741-197888052
  misc_feature 1..311: note = hyper
  source 1..311: mol_type = genomic DNA

SEQ ID NO: 47710 - DNA, 344 bp, Homo sapiens
  misc_feature 1..344: note = chr1:197889286-197889630
  misc_feature 1..344: note = hyper
  source 1..344: mol_type = genomic DNA
caaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattggg

SEQ ID NO: 47711 - DNA, 71 bp, Homo sapiens; identical to SEQ ID NO: 26786
  misc_feature 1..71: note = chr1:197890716-197890787
  misc_feature 1..71: note = hyper
  source 1..71: mol_type = genomic DNA

SEQ ID NO: 47712 - DNA, 240 bp, Homo sapiens; identical to SEQ ID NO: 26787
  misc_feature 1..240: note = chr1:199998199-199998439
  misc_feature 1..240: note = hyper
  source 1..240: mol_type = genomic DNA

SEQ ID NO: 47713 - DNA, 30 bp, Homo sapiens; identical to SEQ ID NO: 5860
  misc_feature 1..30: note = chr1:199998758-199998788
  misc_feature 1..30: note = hyper
  source 1..30: mol_type = genomic DNA

SEQ ID NO: 47714 - DNA, 50 bp, Homo sapiens; identical to SEQ ID NO: 26789
  misc_feature 1..50: note = chr1:200008515-200008565
  misc_feature 1..50: note = hyper
  source 1..50: mol_type = genomic DNA

SEQ ID NO: 47715 - DNA, 37 bp, Homo sapiens
  misc_feature 1..37: note = chr1:200010114-200010151
  misc_feature 1..37: note = hyper
  source 1..37: mol_type = genomic DNA
gggtctggctgctatgggaacccggttggtccaaaga

SEQ ID NO: 47716 - DNA, 266 bp, Homo sapiens; identical to SEQ ID NO: 26793
  misc_feature 1..266: note = chr1:201252527-201252793
  misc_feature 1..266: note = hyper
  source 1..266: mol_type = genomic DNA

SEQ ID NO: 47717 - DNA, 42 bp, Homo sapiens; identical to SEQ ID NO: 26794
  misc_feature 1..42: note = chr1:201437622-201437664
  misc_feature 1..42: note = hyper
  source 1..42: mol_type = genomic DNA

SEQ ID NO: 47718 - DNA, 105 bp, Homo sapiens; identical to SEQ ID NO: 5866
  misc_feature 1..105: note = chr1:201437682-201437787
  misc_feature 1..105: note = hyper
  source 1..105: mol_type = genomic DNA

SEQ ID NO: 47719 - DNA, 73 bp, Homo sapiens; identical to SEQ ID NO: 26796
  misc_feature 1..73: note = chr1:201438552-201438625
  misc_feature 1..73: note = hyper
  source 1..73: mol_type = genomic DNA

SEQ ID NO: 47720 - DNA, 218 bp, Homo sapiens; identical to SEQ ID NO: 26797
  misc_feature 1..218: note = chr1:202183428-202183646
  misc_feature 1..218: note = hyper
  source 1..218: mol_type = genomic DNA

SEQ ID NO: 47721 - DNA, 234 bp, Homo sapiens; identical to SEQ ID NO: 26798
  misc_feature 1..234: note = chr1:202611761-202611995
  misc_feature 1..234: note = hyper
  source 1..234: mol_type = genomic DNA

SEQ ID NO: 47722 - DNA, 127 bp, Homo sapiens; identical to SEQ ID NO: 26799
  misc_feature 1..127: note = chr1:202613418-202613545
  misc_feature 1..127: note = hyper
  source 1..127: mol_type = genomic DNA

SEQ ID NO: 47723 - DNA, 133 bp, Homo sapiens; identical to SEQ ID NO: 26800
  misc_feature 1..133: note = chr1:202678970-202679103
  misc_feature 1..133: note = hyper
  source 1..133: mol_type = genomic DNA

SEQ ID NO: 47724 - DNA, 190 bp, Homo sapiens
  misc_feature 1..190: note = chr1:202679518-202679708
  misc_feature 1..190: note = hyper
  source 1..190: mol_type = genomic DNA
accgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 47725 - DNA, 23 bp, Homo sapiens
  misc_feature 1..23: note = chr1:202936931-202936954
  misc_feature 1..23: note = hyper
  source 1..23: mol_type = genomic DNA
atcgcgcccggccccaagatctt

SEQ ID NO: 47726 - DNA, 136 bp, Homo sapiens; identical to SEQ ID NO: 5870
  misc_feature 1..136: note = chr1:202996095-202996231
  misc_feature 1..136: note = hyper
  source 1..136: mol_type = genomic DNA

SEQ ID NO: 47727 - DNA, 15 bp, Homo sapiens
  misc_feature 1..15: note = chr1:202996304-202996319
  misc_feature 1..15: note = hyper
  source 1..15: mol_type = genomic DNA
cggtggggtggaagg

SEQ ID NO: 47728 - DNA, 179 bp, Homo sapiens; identical to SEQ ID NO: 26805
  misc_feature 1..179: note = chr1:203087019-203087198
  misc_feature 1..179: note = hyper
  source 1..179: mol_type = genomic DNA

SEQ ID NO: 47729 - DNA, 135 bp, Homo sapiens; identical to SEQ ID NO: 26806
  misc_feature 1..135: note = chr1:203096868-203097003
  misc_feature 1..135: note = hyper
  source 1..135: mol_type = genomic DNA

SEQ ID NO: 47730 - DNA, 161 bp, Homo sapiens; identical to SEQ ID NO: 26807
  misc_feature 1..161: note = chr1:203097280-203097441
  misc_feature 1..161: note = hyper
  source 1..161: mol_type = genomic DNA

SEQ ID NO: 47731 - DNA, 95 bp, Homo sapiens
  misc_feature 1..95: note = chr1:204653466-204653561
  misc_feature 1..95: note = hyper
  source 1..95: mol_type = genomic DNA
aacagatgggagctgcggcagcctgaggaacagagcacaaagcccagctgacattttccttcctgttcgtttgggtgggggaggaagggtaggga

SEQ ID NO: 47732 - DNA, 212 bp, Homo sapiens; identical to SEQ ID NO: 17293
  misc_feature 1..212: note = chr1:204653807-204654019
  misc_feature 1..212: note = hyper
  source 1..212: mol_type = genomic DNA

SEQ ID NO: 47733 - DNA, 83 bp, Homo sapiens; identical to SEQ ID NO: 26810
  misc_feature 1..83: note = chr1:204654686-204654769
  misc_feature 1..83: note = hyper
  source 1..83: mol_type = genomic DNA

SEQ ID NO: 47734 - DNA, 145 bp, Homo sapiens; identical to SEQ ID NO: 26811
  misc_feature 1..145: note = chr1:204797791-204797936
  misc_feature 1..145: note = hyper
  source 1..145: mol_type = genomic DNA

SEQ ID NO: 47735 - DNA, 129 bp, Homo sapiens; identical to SEQ ID NO: 26812
  misc_feature 1..129: note = chr1:204798148-204798277
  misc_feature 1..129: note = hyper
  source 1..129: mol_type = genomic DNA

SEQ ID NO: 47736 - DNA, 89 bp, Homo sapiens
  misc_feature 1..89: note = chr1:205312507-205312596
  misc_feature 1..89: note = hyper
  source 1..89: mol_type = genomic DNA
ggtgacggccacccccgcccgggctgtgggcagccggggcaaggcggtccactggtcggcctccggggagtagacctcgaagcagtcca

SEQ ID NO: 47737 - DNA, 45 bp, Homo sapiens; identical to SEQ ID NO: 26814
  misc_feature 1..45: note = chr1:205312961-205313006
  misc_feature 1..45: note = hyper
  source 1..45: mol_type = genomic DNA

SEQ ID NO: 47738 - DNA, 453 bp, Homo sapiens; identical to SEQ ID NO: 26815
  misc_feature 1..453: note = chr1:205399652-205400105
  misc_feature 1..453: note = hyper
  source 1..453: mol_type = genomic DNA

SEQ ID NO: 47739 - DNA, 64 bp, Homo sapiens
  misc_feature 1..64: note = chr1:205424957-205425021
  misc_feature 1..64: note = hyper
  source 1..64: mol_type = genomic DNA
ccctcagccgcactcgggcccccaacccggccaaggggtcgccaactcgcggcactttctgcct

SEQ ID NO: 47740 - DNA, 535 bp, Homo sapiens; identical to SEQ ID NO: 26817
  misc_feature 1..535: note = chr1:205425423-205425958
  misc_feature 1..535: note = hyper
  source 1..535: mol_type = genomic DNA

SEQ ID NO: 47741 - DNA, 493 bp, Homo sapiens; identical to SEQ ID NO: 26818
  misc_feature 1..493: note = chr1:207627640-207628133
  misc_feature 1..493: note = hyper
  source 1..493: mol_type = genomic DNA

SEQ ID NO: 47742 - DNA, 175 bp, Homo sapiens
  misc_feature 1..175: note = chr1:207669321-207669496
  misc_feature 1..175: note = hyper
  source 1..175: mol_type = genomic DNA
cgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccc

SEQ ID NO: 47743 - DNA, 15 bp, Homo sapiens
  misc_feature 1..15: note = chr1:208083989-208084004
  misc_feature 1..15: note = hyper
  source 1..15: mol_type = genomic DNA
tcctccccagtctcc

SEQ ID NO: 47744 - DNA, 258 bp, Homo sapiens
  misc_feature 1..258: note = chr1:208084031-208084289
  misc_feature 1..258: note = hyper
  source 1..258: mol_type = genomic DNA
cgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaa

SEQ ID NO: 47745 - DNA, 195 bp, Homo sapiens
  misc_feature 1..195: note = chr1:208084488-208084683
  misc_feature 1..195: note = hyper
  source 1..195: mol_type = genomic DNA
gcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 47746 - DNA, 64 bp, Homo sapiens; identical to SEQ ID NO: 26823
  misc_feature 1..64: note = chr1:209381523-209381587
  misc_feature 1..64: note = hyper
  source 1..64: mol_type = genomic DNA

SEQ ID NO: 47747 - DNA, 105 bp, Homo sapiens
  misc_feature 1..105: note = chr1:210111283-210111388
  misc_feature 1..105: note = hyper
  source 1..105: mol_type = genomic DNA
cgtggctctccgggccgggcacctgtttcgaatcgaggcgcgaggcgcggtggggcggtggggtggggtggggtaggttggggtgggggcggggtggcgtcacgt

SEQ ID NO: 47748 - DNA, 30 bp, Homo sapiens; identical to SEQ ID NO: 26827
  misc_feature 1..30: note = chr1:210405727-210405757
  misc_feature 1..30: note = hyper
  source 1..30: mol_type = genomic DNA

SEQ ID NO: 47749 - DNA, 48 bp, Homo sapiens; identical to SEQ ID NO: 26828
  misc_feature 1..48: note = chr1:211306737-211306785
  misc_feature 1..48: note = hyper
  source 1..48: mol_type = genomic DNA

SEQ ID NO: 47750 - DNA, 267 bp, Homo sapiens; identical to SEQ ID NO: 26829
  misc_feature 1..267: note = chr1:211307126-211307393
  misc_feature 1..267: note = hyper
  source 1..267: mol_type = genomic DNA

SEQ ID NO: 47751 - DNA, 86 bp, Homo sapiens; identical to SEQ ID NO: 26830
  misc_feature 1..86: note = chr1:212874013-212874099
  misc_feature 1..86: note = hyper
  source 1..86: mol_type = genomic DNA

SEQ ID NO: 47752 - DNA, 282 bp, Homo sapiens
  misc_feature 1..282: note = chr1:213123589-213123871
  misc_feature 1..282: note = hyper
  source 1..282: mol_type = genomic DNA
cgcggggtcacttctcgggtggttttgtttctcctctgcttccacagttgcaaaccctcgaagtgccacgacccctggggaaactcgatcttaagtcccatggccaaacgctccagcccgcggggctctcaggacaccacagcgatcggatttcgcgtggccgccaggctccccctactcctgtcccctcccgccagagaacccctggagccaatcagagcgtcgcggagcccggggttgtagagtcccgagcccgggacccgcccctctttgttgcggtgg

SEQ ID NO: 47753 - DNA, 644 bp, Homo sapiens
  misc_feature 1..644: note = chr1:213123979-213124623
  misc_feature 1..644: note = hyper
  source 1..644: mol_type = genomic DNA
ccagcagccccagccccagccccaggcccagcagcagcagcagcagcccctgctctcccgccgcccggagaggctctgcagccatgaagccaaccgtcccgaggtaggatcttggagctgccgcgcgcccttcctgcgcgccgcccgcctgcagccagtccctcccggtgataggcgctggaactcggggaaaagggggcggatggagctctttccactagatccccgccggggtccgggagggcttcctggaagaaagcgggccgccttgcaagccaaggctgctgcagcgccctcgcgccagctctgggcgctcacatgccagcacgttcgtggctcccctcctctcttggccacatctgaggacccaggaatgtgtggagccttgcgggaacctcctgttccttcatgctacacaagctgtctttcttctccccacatcttgcgctccgcatcccccaagctccttgtgcccctccatccccaaccccccgggtttaggtgtgtgtgaagcttcgtggcacattttgagctgcctttctaggtaatcgcagggctggaagcccgtcatcgattctcagggaggctgtcagcgtgcaggggggagcggggagtgtcgtggagacactccgggacccctcact

SEQ ID NO: 47754 - DNA, 123 bp, Homo sapiens
  misc_feature 1..123: note = chr1:213124910-213125033
  misc_feature 1..123: note = hyper
  source 1..123: mol_type = genomic DNA
ccgctgcccccaccccaaaggcgccaaaggcacccggtcccggagcagccacgcgcggcccgtgagcctcgccaccagcgggggctcagaggaggaggacaaagacggcggggtgctgttcca

SEQ ID NO: 47755 - DNA, 30 bp, Homo sapiens; identical to SEQ ID NO: 26833
  misc_feature 1..30: note = chr1:214155741-214155771
  misc_feature 1..30: note = hyper
  source 1..30: mol_type = genomic DNA

SEQ ID NO: 47756 - DNA, 98 bp, Homo sapiens; identical to SEQ ID NO: 26834
  misc_feature 1..98: note = chr1:214155985-214156083
  misc_feature 1..98: note = hyper
  source 1..98: mol_type = genomic DNA

SEQ ID NO: 47757 - DNA, 60 bp, Homo sapiens; identical to SEQ ID NO: 26835
  misc_feature 1..60: note = chr1:214156134-214156194
  misc_feature 1..60: note = hyper
  source 1..60: mol_type = genomic DNA

SEQ ID NO: 47758 - skipped

SEQ ID NO: 47759 - DNA, 22 bp, Homo sapiens
  misc_feature 1..22: note = chr1:214156928-214156950
  misc_feature 1..22: note = hyper
  source 1..22: mol_type = genomic DNA
acttaagcgacagcaaaagata

SEQ ID NO: 47760 - DNA, 36 bp, Homo sapiens
  misc_feature 1..36: note = chr1:214158802-214158838
  misc_feature 1..36: note = hyper
  source 1..36: mol_type = genomic DNA
atctcgctcgcctagcgtggcgcgcgctcctatttc

SEQ ID NO: 47761 - DNA, 110 bp, Homo sapiens; identical to SEQ ID NO: 26839
  misc_feature 1..110: note = chr1:214159571-214159681
  misc_feature 1..110: note = hyper
  source 1..110: mol_type = genomic DNA

SEQ ID NO: 47762 - DNA, 134 bp, Homo sapiens
  misc_feature 1..134: note = chr1:214160184-214160318
  misc_feature 1..134: note = hyper
  source 1..134: mol_type = genomic DNA
cttgcaaagcccaaggagatctttaagagccacattatctaaagaaattttgctggttatttttcaagcaagaaatgtcaaaccaaagtaaattttctagggctttattttagagcctgcgatttatgcgtttg

SEQ ID NO: 47763 - DNA, 353 bp, Homo sapiens; identical to SEQ ID NO: 26841
  misc_feature 1..353: note = chr1:214162457-214162810
  misc_feature 1..353: note = hyper
  source 1..353: mol_type = genomic DNA

SEQ ID NO: 47764 - DNA, 167 bp, Homo sapiens
  misc_feature 1..167: note = chr1:214360508-214360675
  misc_feature 1..167: note = hyper
  source 1..167: mol_type = genomic DNA
aacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagt

SEQ ID NO: 47765 - DNA, 72 bp, Homo sapiens
  misc_feature 1..72: note = chr1:214360968-214361040
  misc_feature 1..72: note = hyper
  source 1..72: mol_type = genomic DNA
gctcagaacacaccgagatcctttagaaataaatgtaatcgagactaatctggaaatcgtccctgcagccaa

SEQ ID NO: 47766 - DNA, 128 bp, Homo sapiens; identical to SEQ ID NO: 26845
  misc_feature 1..128: note = chr1:214387629-214387757
  misc_feature 1..128: note = hyper
  source 1..128: mol_type = genomic DNA

SEQ ID NO: 47767 - DNA, 126 bp, Homo sapiens; identical to SEQ ID NO: 26846
  misc_feature 1..126: note = chr1:214725407-214725533
  misc_feature 1..126: note = hyper
  source 1..126: mol_type = genomic DNA

SEQ ID NO: 47768 - DNA, 34 bp, Homo sapiens; identical to SEQ ID NO: 17314
  misc_feature 1..34: note = chr1:215255060-215255094
  misc_feature 1..34: note = hyper
  source 1..34: mol_type = genomic DNA

SEQ ID NO: 47769 - DNA, 195 bp, Homo sapiens
  misc_feature 1..195: note = chr1:215255799-215255994
  misc_feature 1..195: note = hyper
  source 1..195: mol_type = genomic DNA
agataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtag

SEQ ID NO: 47770 - DNA, 606 bp, Homo sapiens; identical to SEQ ID NO: 26848
  misc_feature 1..606: note = chr1:215256219-215256825
  misc_feature 1..606: note = hyper
  source 1..606: mol_type = genomic DNA

SEQ ID NO: 47771 - DNA, 100 bp, Homo sapiens; identical to SEQ ID NO: 26849
  misc_feature 1..100: note = chr1:216896454-216896554
  misc_feature 1..100: note = hyper
  source 1..100: mol_type = genomic DNA

SEQ ID NO: 47772 - DNA, 87 bp, Homo sapiens; identical to SEQ ID NO: 5901
  misc_feature 1..87: note = chr1:216896887-216896974
  misc_feature 1..87: note = hyper
  source 1..87: mol_type = genomic DNA

SEQ ID NO: 47773 - DNA, 145 bp, Homo sapiens; identical to SEQ ID NO: 26851
  misc_feature 1..145: note = chr1:217262983-217263128
  misc_feature 1..145: note = hyper
  source 1..145: mol_type = genomic DNA

SEQ ID NO: 47774 - DNA, 423 bp, Homo sapiens
  misc_feature 1..423: note = chr1:217308274-217308697
  misc_feature 1..423: note = hyper
  source 1..423: mol_type = genomic DNA
ccgcagcgcccagtttacctggaattcagggacctgaccctgactctatttccggctagtcccagcctctccttcctctcctttccccgctttccgcccagggcggttctgagattttgattaagagagatctgtccccgcaccgcagagggatggtgccaaatggccaggcttcctgggcactgcgtcctcattcccaggtcagagctactgcgaaaggaaaggtctccatctggacgcacctcgtcccctcccccagcgcgcggggcagccctctagggccagctcgggcacgcgcttttccccctcctcaccccctgctccgcccagccccgtacagttttattctttatgaaacacacacgcccaccccgcctcccacgtaaaggccagtcttgactcattttgcgcccagatgcaaac

SEQ ID NO: 47775 - DNA, 59 bp, Homo sapiens
  misc_feature 1..59: note = chr1:217308948-217309007
  misc_feature 1..59: note = hyper
  source 1..59: mol_type = genomic DNA
cgaagcggggtcaggcgcggacccacattcaccgactgcagaactgttttctttgccac

SEQ ID NO: 47776 - DNA, 201 bp, Homo sapiens
  misc_feature 1..201: note = chr1:217309105-217309306
  misc_feature 1..201: note = hyper
  source 1..201: mol_type = genomic DNA
tcgggccgctgggcgcctccgggatcgctctcactttgcactcggaagcgggcgcggggattcgggctgccgcgtgtagcctataaatagcaaactttttgaccgaagcaactaacaaataagaggagcaggcgtgcattttgctcaagatccccccttttctggggacgaccttactcccacccccgccccctttgcagt

SEQ ID NO: 47777 - DNA, 30 bp, Homo sapiens; identical to SEQ ID NO: 26854
  misc_feature 1..30: note = chr1:217309653-217309683
  misc_feature 1..30: note = hyper
  source 1..30: mol_type = genomic DNA

SEQ ID NO: 47778 - DNA, 39 bp, Homo sapiens; identical to SEQ ID NO: 26855
  misc_feature 1..39: note = chr1:217310204-217310243
  misc_feature 1..39: note = hyper
  source 1..39: mol_type = genomic DNA

SEQ ID NO: 47779 - DNA, 394 bp, Homo sapiens
  misc_feature 1..394: note = chr1:217310871-217311265
  misc_feature 1..394: note = hyper
  source 1..394: mol_type = genomic DNA
gggcctgggaggctgcggtaccgcctgtcggtcccggtcccgagcgcgcttgcttaagagttctcaaagacggggttggaagcagtacagacgtccccggttatcgctgccgggcttgtgcgccccacgccacctacctgtccggccttcccgctccaattgctgacccgtttagggagcccggcctggagcccgccgcctccagaggagcccgccctcgccctcccccgcgcgcctccgctctctgggacgcctggccaaatgcggggcggtctctcgcgggccattggcttgggccaccgttccgagtcagctcctaggatttccccaggctttgcggcccctttgtgggtctaggccagcgcctcaccttgcaccctattccacctccagt

SEQ ID NO: 47780 - DNA, 66 bp, Homo sapiens; identical to SEQ ID NO: 5907
  misc_feature 1..66: note = chr1:217311944-217312010
  misc_feature 1..66: note = hyper
  source 1..66: mol_type = genomic DNA

SEQ ID NO: 47781 - DNA, 17 bp, Homo sapiens
  misc_feature 1..17: note = chr1:217313025-217313042
  misc_feature 1..17: note = hyper
  source 1..17: mol_type = genomic DNA
cccctctgcaattgccg

SEQ ID NO: 47782 - DNA, 30 bp, Homo sapiens; identical to SEQ ID NO: 5910
  misc_feature 1..30: note = chr1:218337322-218337352
  misc_feature 1..30: note = hyper
  source 1..30: mol_type = genomic DNA

SEQ ID NO: 47783 - DNA, 547 bp, Homo sapiens; identical to SEQ ID NO: 26861
  misc_feature 1..547: note = chr1:218337623-218338170
  misc_feature 1..547: note = hyper
  source 1..547: mol_type = genomic DNA

SEQ ID NO: 47784 - DNA, 278 bp, Homo sapiens; identical to SEQ ID NO: 26862
  misc_feature 1..278: note = chr1:218338508-218338786
  misc_feature 1..278: note = hyper
  source 1..278: mol_type = genomic DNA

SEQ ID NO: 47785 - DNA, 156 bp, Homo sapiens; identical to SEQ ID NO: 26863
  misc_feature 1..156: note = chr1:218339178-218339334
  misc_feature 1..156: note = hyper
  source 1..156: mol_type = genomic DNA

SEQ ID NO: 47786 - DNA, 83 bp, Homo sapiens
  misc_feature 1..83: note = chr1:218520399-218520482
  misc_feature 1..83: note = hyper
  source 1..83: mol_type = genomic DNA
attttgacttccatcccctgaggtttagctctgcccggagctctcaaaaccgcagcagctcccgggatcgcccttccctctcg

SEQ ID NO: 47787 - DNA, 45 bp, Homo sapiens; identical to SEQ ID NO: 26866
  misc_feature 1..45: note = chr1:219347215-219347260
  misc_feature 1..45: note = hyper
  source 1..45: mol_type = genomic DNA

SEQ ID NO: 47788 - DNA, 96 bp, Homo sapiens
  misc_feature 1..96: note = chr1:220101049-220101145
  misc_feature 1..96: note = hyper
  source 1..96: mol_type = genomic DNA
agaagaaaaagagggcgtggggtgagaagaaagggaccgggtgggaggaggaaggaagggccaagcggtccaaaggatgcaaccgaaaggcacctg

SEQ ID NO: 47789 - DNA, 228 bp, Homo sapiens
  misc_feature 1..228: note = chr1:220101385-220101613
  misc_feature 1..228: note = hyper
  source 1..228: mol_type = genomic DNA
tgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccgg

SEQ ID NO: 47790 - DNA, 30 bp, Homo sapiens; identical to SEQ ID NO: 26869
  misc_feature 1..30: note = chr1:220101929-220101959
  misc_feature 1..30: note = hyper
  source 1..30: mol_type = genomic DNA

SEQ ID NO: 47791 - DNA, 35 bp, Homo sapiens
  misc_feature 1..35: note = chr1:220700897-220700932
  misc_feature 1..35: note = hyper
  source 1..35: mol_type = genomic DNA
acttgtactgagtctccagccgcctccctaggctg

SEQ ID NO: 47792 - DNA, 303 bp, Homo sapiens; identical to SEQ ID NO: 26871
  misc_feature 1..303: note = chr1:220702162-220702465
  misc_feature 1..303: note = hyper
  source 1..303: mol_type = genomic DNA

SEQ ID NO: 47793 - DNA, 90 bp, Homo sapiens; identical to SEQ ID NO: 26872
  misc_feature 1..90: note = chr1:220864103-220864193
  misc_feature 1..90: note = hyper
  source 1..90: mol_type = genomic DNA

SEQ ID NO: 47794 - DNA, 436 bp, Homo sapiens; identical to SEQ ID NO: 26873
  misc_feature 1..436: note = chr1:220921624-220922060
  misc_feature 1..436: note = hyper
  source 1..436: mol_type = genomic DNA

SEQ ID NO: 47795 - DNA, 243 bp, Homo sapiens; identical to SEQ ID NO: 26874
  misc_feature 1..243: note = chr1:220960315-220960558
  misc_feature 1..243: note = hyper
  source 1..243: mol_type = genomic DNA

SEQ ID NO: 47796 - DNA, 31 bp, Homo sapiens
  misc_feature 1..31: note = chr1:221052007-221052038
  misc_feature 1..31: note = hyper
  source 1..31: mol_type = genomic DNA
tagcctctgaggctccggggaaaggtttggc

SEQ ID NO: 47797 - DNA, 718 bp, Homo sapiens
  misc_feature 1..718: note = chr1:221052492-221053210
  misc_feature 1..718: note = hyper
  source 1..718: mol_type = genomic DNA
tagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagc

SEQ ID NO: 47798 - DNA, 355 bp, Homo sapiens
  misc_feature 1..355: note = chr1:221053255-221053610
  misc_feature 1..355: note = hyper
  source 1..355: mol_type = genomic DNA
cgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacag

SEQ ID NO: 47799 - DNA, 40 bp, Homo sapiens
  misc_feature 1..40: note = chr1:221067466-221067506
  misc_feature 1..40: note = hyper
  source 1..40: mol_type = genomic DNA
ccgcaggctgctccccgagtcccaacgctactagggtgct

SEQ ID NO: 47800 - DNA, 129 bp, Homo sapiens
  misc_feature 1..129: note = chr1:221067688-221067817
  misc_feature 1..129: note = hyper
  source 1..129: mol_type = genomic DNA
ctgtgtacactttctggctccagagccccgcgcaccagaaggatggggccctgcgagcgcgccccaggccgcgagctggggccgcaggcgccacggccatgtatagtgcccacccgactctgttctgca

SEQ ID NO: 47801 - DNA, 211 bp, Homo sapiens; identical to SEQ ID NO: 26878
  misc_feature 1..211: note = chr1:221914261-221914472
  misc_feature 1..211: note = hyper
  source 1..211: mol_type = genomic DNA

SEQ ID NO: 47802 - DNA, 48 bp, Homo sapiens; identical to SEQ ID NO: 17333
  misc_feature 1..48: note = chr1:223302777-223302825
  misc_feature 1..48: note = hyper
  source 1..48: mol_type = genomic DNA

SEQ ID NO: 47803 - DNA, 28 bp, Homo sapiens
  misc_feature 1..28: note = chr1:223302890-223302918
  misc_feature 1..28: note = hyper
  source 1..28: mol_type = genomic DNA
cagcacccagcagcgccactgggagagg

SEQ ID NO: 47804 - DNA, 186 bp, Homo sapiens
  misc_feature 1..186: note = chr1:223538158-223538344
  misc_feature 1..186: note = hyper
  source 1..186: mol_type = genomic DNA
agtctcttaatttcccgcgttaacccctccccgctcccatctccgccgaagctctgcgcgtccccagggagcccgaaggaccatctgaggcggctgagagacactctccccctcccccacacccttggtattttccctctgccagccgcaggtgttgcgagtgaggacccctgtccggtcttggag

SEQ ID NO: 47805 - skipped

SEQ ID NO: 47806 - DNA, 153 bp, Homo sapiens
  misc_feature 1..153: note = chr1:223937057-223937210
  misc_feature 1..153: note = hyper
  source 1..153: mol_type = genomic DNA
ttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaa

SEQ ID NO: 47807 - DNA, 202 bp, Homo sapiens
  misc_feature 1..202: note = chr1:224528612-224528814
  misc_feature 1..202: note = hyper
  source 1..202: mol_type = genomic DNA
ggggctccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctc

SEQ ID NO: 47808 - DNA, 24 bp, Homo sapiens
  misc_feature 1..24: note = chr1:224528844-224528868
  misc_feature 1..24: note = hyper
  source 1..24: mol_type = genomic DNA
ggtcctgcccggctgcgcaagggt

SEQ ID NO: 47809 - DNA, 55 bp, Homo sapiens; identical to SEQ ID NO: 26884
  misc_feature 1..55: note = chr1:224803348-224803403
  misc_feature 1..55: note = hyper
  source 1..55: mol_type = genomic DNA

SEQ ID NO: 47810 - DNA, 287 bp, Homo sapiens
  misc_feature 1..287: note = chr1:224803810-224804097
  misc_feature 1..287: note = hyper
  source 1..287: mol_type = genomic DNA
gcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaaccc

SEQ ID NO: 47811 - DNA, 206 bp, Homo sapiens; identical to SEQ ID NO: 17339
  misc_feature 1..206: note = chr1:224804910-224805116
  misc_feature 1..206: note = hyper
  source 1..206: mol_type = genomic DNA

SEQ ID NO: 47812 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 47813 - DNA, 395 bp, Homo sapiens; identical to SEQ ID NO: 26890
  misc_feature 1..395: note = chr1:225117226-225117621
  misc_feature 1..395: note = hyper
  source 1..395: mol_type = genomic DNA

SEQ ID NO: 47814 - DNA, 62 bp, Homo sapiens; identical to SEQ ID NO: 26891
  misc_feature 1..62: note = chr1:225632491-225632553
  misc_feature 1..62: note = hyper
  source 1..62: mol_type = genomic DNA

SEQ ID NO: 47815 - DNA, 30 bp, Homo sapiens; identical to SEQ ID NO: 26892
  misc_feature 1..30: note = chr1:226069474-226069504
  misc_feature 1..30: note = hyper
  source 1..30: mol_type = genomic DNA

SEQ ID NO: 47816 - DNA, 43 bp, Homo sapiens; identical to SEQ ID NO: 26893
  misc_feature 1..43: note = chr1:226150283-226150326
  misc_feature 1..43: note = hyper
  source 1..43: mol_type = genomic DNA

SEQ ID NO: 47817 - DNA, 207 bp, Homo sapiens; identical to SEQ ID NO: 26894
  misc_feature 1..207: note = chr1:226411017-226411224
  misc_feature 1..207: note = hyper
  source 1..207: mol_type = genomic DNA

SEQ ID NO: 47818 - DNA, 427 bp, Homo sapiens
  misc_feature 1..427: note = chr1:226411273-226411700
  misc_feature 1..427: note = hyper
  source 1..427: mol_type = genomic DNA
tctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgc

SEQ ID NO: 47819 - DNA, 172 bp, Homo sapiens
  misc_feature 1..172: note = chr1:226411832-226412004
  misc_feature 1..172: note = hyper
  source 1..172: mol_type = genomic DNA
gtctggactgcgggctcctgaggccacacccgggacgttgcaggcacggtgcttcccctgaggctctgcgtactagactgaaatagggggtgatatcggcacctgctgcatagggtggttgcgaggcctgtgtgaaataatttaggcctgcactgaacgatttctctcatta

SEQ ID NO: 47820 - DNA, 83 bp, Homo sapiens; identical to SEQ ID NO: 26896
  misc_feature 1..83: note = chr1:226736126-226736209
  misc_feature 1..83: note = hyper
  source 1..83: mol_type = genomic DNA

SEQ ID NO: 47821 - DNA, 692 bp, Homo sapiens; identical to SEQ ID NO: 26897
  misc_feature 1..692: note = chr1:226736861-226737553
  misc_feature 1..692: note = hyper
  source 1..692: mol_type = genomic DNA

SEQ ID NO: 47822 - DNA, 15 bp, Homo sapiens
  misc_feature 1..15: note = chr1:226924815-226924830
  misc_feature 1..15: note = hyper
  source 1..15: mol_type = genomic DNA
gccaccacctgctgc

SEQ ID NO: 47823 - DNA, 167 bp, Homo sapiens; identical to SEQ ID NO: 17346
  misc_feature 1..167: note = chr1:226924900-226925067
  misc_feature 1..167: note = hyper
  source 1..167: mol_type = genomic DNA

SEQ ID NO: 47824 - DNA, 419 bp, Homo sapiens
  misc_feature 1..419: note = chr1:226925195-226925614
  misc_feature 1..419: note = hyper
  source 1..419: mol_type = genomic DNA
cgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcc

SEQ ID NO: 47825 - DNA, 132 bp, Homo sapiens; identical to SEQ ID NO: 26900
  misc_feature 1..132: note = chr1:227505711-227505843
  misc_feature 1..132: note = hyper
  source 1..132: mol_type = genomic DNA

SEQ ID NO: 47826 - DNA, 37 bp, Homo sapiens
  misc_feature 1..37: note = chr1:227730075-227730112
  misc_feature 1..37: note = hyper
  source 1..37: mol_type = genomic DNA
cagcagcccggacagccgcttccgcccctgcgccgcc

SEQ ID NO: 47827 - DNA, 273 bp, Homo sapiens; identical to SEQ ID NO: 26902
  misc_feature 1..273: note = chr1:227730322-227730595
  misc_feature 1..273: note = hyper
  source 1..273: mol_type = genomic DNA

SEQ ID NO: 47828 - DNA, 30 bp, Homo sapiens; identical to SEQ ID NO: 26903
  misc_feature 1..30: note = chr1:227975163-227975193
  misc_feature 1..30: note = hyper
  source 1..30: mol_type = genomic DNA

SEQ ID NO: 47829 - DNA, 89 bp, Homo sapiens; identical to SEQ ID NO: 26904
  misc_feature 1..89: note = chr1:228074787-228074876
  misc_feature 1..89: note = hyper
  source 1..89: mol_type = genomic DNA

SEQ ID NO: 47830 - DNA, 169 bp, Homo sapiens; identical to SEQ ID NO: 26905
  misc_feature 1..169: note = chr1:228134702-228134871
  misc_feature 1..169: note = hyper
  source 1..169: mol_type = genomic DNA

SEQ ID NO: 47831 - skipped

SEQ ID NO: 47832 - DNA, 328 bp, Homo sapiens; identical to SEQ ID NO: 26907
  misc_feature 1..328: note = chr1:228135362-228135690
  misc_feature 1..328: note = hyper
  source 1..328: mol_type = genomic DNA

SEQ ID NO: 47833 - DNA, 161 bp, Homo sapiens; identical to SEQ ID NO: 26908
  misc_feature 1..161: note = chr1:228194250-228194411
  misc_feature 1..161: note = hyper
  source 1..161: mol_type = genomic DNA

SEQ ID NO: 47834 - DNA, 650 bp, Homo sapiens
  misc_feature 1..650: note = chr1:228194727-228195377
  misc_feature 1..650: note = hyper
  source 1..650: mol_type = genomic DNA
agggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctc

SEQ ID NO: 47835 - DNA, 176 bp, Homo sapiens
  misc_feature 1..176: note = chr1:228196349-228196525
  misc_feature 1..176: note = hyper
  source 1..176: mol_type = genomic DNA
agggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatcttt

SEQ ID NO: 47836 - DNA, 109 bp, Homo sapiens; identical to SEQ ID NO: 26910
  misc_feature 1..109: note = chr1:228225753-228225862
  misc_feature 1..109: note = hyper
  source 1..109: mol_type = genomic DNA

SEQ ID NO: 47837 - DNA, 16 bp, Homo sapiens
  misc_feature 1..16: note = chr1:228248332-228248348
  misc_feature 1..16: note = hyper
  source 1..16: mol_type = genomic DNA
ccgtctctgctctgct

SEQ ID NO: 47838 - DNA, 124 bp, Homo sapiens; identical to SEQ ID NO: 26912
  misc_feature 1..124: note = chr1:228248612-228248736
  misc_feature 1..124: note = hyper
  source 1..124: mol_type = genomic DNA

SEQ ID NO: 47839 - DNA, 106 bp, Homo sapiens
  misc_feature 1..106: note = chr1:228463205-228463311
  misc_feature 1..106: note = hyper
  source 1..106: mol_type = genomic DNA
agctggaggtgggagcggggcttaaggaagcttcctggtttcctcgcttaaagtcgcacccgggagggtgcgcagctgcggcccgcgtgtggccagggccgcgctg

SEQ ID NO: 47840 - DNA, 117 bp, Homo sapiens
  misc_feature 1..117: note = chr1:228463706-228463823
  misc_feature 1..117: note = hyper
  source 1..117: mol_type = genomic DNA
aggccaaactcaccgtggagagtgagccgcgggcgggaagggcggggcatcgaggaggagtgaggagggaggcggggcattgaggattagtgaggacgtaggcggggtgctgagggg

SEQ ID NO: 47841 - DNA, 45 bp, Homo sapiens; identical to SEQ ID NO: 26914
  misc_feature 1..45: note = chr1:228566475-228566520
  misc_feature 1..45: note = hyper
  source 1..45: mol_type = genomic DNA

SEQ ID NO: 47842 - DNA, 61 bp, Homo sapiens; identical to SEQ ID NO: 26915
  misc_feature 1..61: note = chr1:228566903-228566964
  misc_feature 1..61: note = hyper
  source 1..61: mol_type = genomic DNA

SEQ ID NO: 47843 - DNA, 233 bp, Homo sapiens; identical to SEQ ID NO: 26916
  misc_feature 1..233: note = chr1:228603691-228603924
  misc_feature 1..233: note = hyper
  source 1..233: mol_type = genomic DNA

SEQ ID NO: 47844 - DNA, 355 bp, Homo sapiens
  misc_feature 1..355: note = chr1:228604254-228604609
  misc_feature 1..355: note = hyper
  source 1..355: mol_type = genomic DNA
cccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtct

SEQ ID NO: 47845 - DNA, 339 bp, Homo sapiens; identical to SEQ ID NO: 26918
  misc_feature 1..339: note = chr1:228633581-228633920
  misc_feature 1..339: note = hyper
  source 1..339: mol_type = genomic DNA

SEQ ID NO: 47846 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 47847 - skipped

SEQ ID NO: 47848 - DNA, 172 bp, Homo sapiens
  misc_feature 1..172: note = chr1:228644968-228645140
  misc_feature 1..172: note = hyper
  source 1..172: mol_type = genomic DNA
tccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggc

SEQ ID NO: 47849 - DNA, 175 bp, Homo sapiens
  misc_feature 1..175: note = chr1:228645734-228645909
  misc_feature 1..175: note = hyper
  source 1..175: mol_type = genomic DNA
gaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaaggacg

SEQ ID NO: 47850 - skipped

SEQ ID NO: 47851 - DNA, 91 bp, Homo sapiens
  misc_feature 1..91: note = chr1:228646238-228646329
  misc_feature 1..91: note = hyper
  source 1..91: mol_type = genomic DNA
ggctcttttcagagccacccacacgatcaagaaagggtttcgaacacggtgaagggttatgtaacctaatgtgtctccatgcaccctagcg

SEQ ID NO: 47852 - DNA, 82 bp, Homo sapiens; identical to SEQ ID NO: 26925
  misc_feature 1..82: note = chr1:228646859-228646941
  misc_feature 1..82: note = hyper
  source 1..82: mol_type = genomic DNA

SEQ ID NO: 47853 - DNA, 100 bp, Homo sapiens; identical to SEQ ID NO: 26926
  misc_feature 1..100: note = chr1:228647217-228647317
  misc_feature 1..100: note = hyper
  source 1..100: mol_type = genomic DNA

SEQ ID NO: 47854 - DNA, 178 bp, Homo sapiens
  misc_feature 1..178: note = chr1:228651254-228651432
  misc_feature 1..178: note = hyper
  source 1..178: mol_type = genomic DNA
tttgggggtaaaatacgagaatcccttaattggggaaattttagctgagtgataaggagatctgtgagcctgctgttttgatgtttcaagcaggaaggcgtggcataaagagctgcttaggcgcaacgctgctgaaatggttttggctagaagctcacagtgtctagttgtggctaag

SEQ ID NO: 47855 - DNA, 253 bp, Homo sapiens; identical to SEQ ID NO: 17365
  misc_feature 1..253: note = chr1:228651626-228651879
  misc_feature 1..253: note = hyper
  source 1..253: mol_type = genomic DNA

SEQ ID NO: 47856 - DNA, 30 bp, Homo sapiens; identical to SEQ ID NO: 26930
  misc_feature 1..30: note = chr1:228871287-228871317
  misc_feature 1..30: note = hyper
  source 1..30: mol_type = genomic DNA

SEQ ID NO: 47857 - DNA, 25 bp, Homo sapiens
  misc_feature 1..25: note = chr1:229542813-229542838
  misc_feature 1..25: note = hyper
  source 1..25: mol_type = genomic DNA
catgctgaggttggtcgcttgtttc

SEQ ID NO: 47858 - DNA, 312 bp, Homo sapiens; identical to SEQ ID NO: 26932
  misc_feature 1..312: note = chr1:229543220-229543532
  misc_feature 1..312: note = hyper
  source 1..312: mol_type = genomic DNA

SEQ ID NO: 47859 - DNA, 150 bp, Homo sapiens
  misc_feature 1..150: note = chr1:229566603-229566753
  misc_feature 1..150: note = hyper
  source 1..150: mol_type = genomic DNA
ggggaacaccataggcggagctgagacgccctctgagaaacagctctccagccccagcaccatggtcagcgcccgctgcctgaggggacccagggccaccagcggaggccgccccggcagtgctggcaacactcgggagcgctgcgcaga

SEQ ID NO: 47860 - DNA, 146 bp, Homo sapiens; identical to SEQ ID NO: 17369
  misc_feature 1..146: note = chr1:229568204-229568350
  misc_feature 1..146: note = hyper
  source 1..146: mol_type = genomic DNA

SEQ ID NO: 47861 - DNA, 352 bp, Homo sapiens
  misc_feature 1..352: note = chr1:229569458-229569810
  misc_feature 1..352: note = hyper
  source 1..352: mol_type = genomic DNA
agggaactgccttggcgacaactaaagcaaaaccgtttatctccctaggcacatcctacatgccaggtaaaggagcccaaaggggctagagaaaaatttggagaagtctaatttccagaggctgactgtcttgcctcctttttaaagcgcgtgtggctccggagacgaggcacagcgctcagggcgcaggcctggggctgaccaggtgaaccgactgggttctgccccggagtccttcaggttcccctcggtagtgccctgtccccctgtcccctcccaactcctgccctacctgggcgggtagctacaactgctactctcggctcgggccctggtcgccgcggaggggaag

SEQ ID NO: 47862 - DNA, 734 bp, Homo sapiens
  misc_feature 1..734: note = chr1:229569852-229570586
  misc_feature 1..734: note = hyper
  source 1..734: mol_type = genomic DNA
cctctgctcaggttttatatagcccgcgggcattccctccgcgccaccccgcaggaatgtcgctgcccttctcgagccatatttgggtgttgggcactagagccccctccctcggccggttcgcggcctgggcccccgcccgggtcccctgcgttgaccaaagaaggagcgggttggcccggtcccaggtaacgcgggccgggccgtatatggagtgtctccctagcgggtttgcccctcctgacccgacccagttgcccgccggaggggatggggtggggcgagggtcaccgcgttcgccggtgggtgcatgtgtgcgcctgcgctccgggaaccgcacctgtcccaaaggcctccccaaccatgtccactctgagcgccctgggcgctcgggaaggtgcctgactgctgacttccaatatttcaactcctcttcgggttctttgctcagatccccaaactcccacttgcgactaccgggaagagggagtcgtgtggagtggtgggcttgggaggattggagaagcagtcactcctgagtctcaggaagggaaggaaggcgaactccctctcctttacgcccctggaactccatttctctcttcccacccccgagctccctgaatccaaaaagctgagccacgtcgaccccttcccccaccgcacagagggccaccggcggccggagggcgcgcagctgtcgcaggatagacaactggcggggggaggcgagg

SEQ ID NO: 47863 - DNA, 30 bp, Homo sapiens; identical to SEQ ID NO: 26938
  misc_feature 1..30: note = chr1:230240615-230240645
  misc_feature 1..30: note = hyper
  source 1..30: mol_type = genomic DNA

SEQ ID NO: 47864 - DNA, 120 bp, Homo sapiens; identical to SEQ ID NO: 26939
  misc_feature 1..120: note = chr1:230561556-230561676
  misc_feature 1..120: note = hyper
  source 1..120: mol_type = genomic DNA

SEQ ID NO: 47865 - DNA, 37 bp, Homo sapiens; identical to SEQ ID NO: 26940
  misc_feature 1..37: note = chr1:231296747-231296784
  misc_feature 1..37: note = hyper
  source 1..37: mol_type = genomic DNA

SEQ ID NO: 47866 - DNA, 286 bp, Homo sapiens; identical to SEQ ID NO: 26941
  misc_feature 1..286: note = chr1:231296817-231297103
  misc_feature 1..286: note = hyper
  source 1..286: mol_type = genomic DNA

SEQ ID NO: 47867 - DNA, 88 bp, Homo sapiens
  misc_feature 1..88: note = chr1:231297221-231297309
  misc_feature 1..88: note = hyper
  source 1..88: mol_type = genomic DNA
tctgggggcgctgggttcccaggggtctacccgggcgcgctctcgcctttctcaggaaaccccattttgtgagcggcaccgcgtgtcc

SEQ ID NO: 47868 - DNA, 30 bp, Homo sapiens; identical to SEQ ID NO: 26943
  misc_feature 1..30: note = chr1:231297520-231297550
  misc_feature 1..30: note = hyper
  source 1..30: mol_type = genomic DNA

SEQ ID NO: 47869 - DNA, 798 bp, Homo sapiens
  misc_feature 1..798: note = chr1:231297797-231298595
  misc_feature 1..798: note = hyper
  source 1..798: mol_type = genomic DNA
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgc

SEQ ID NO: 47870 - DNA, 155 bp, Homo sapiens; identical to SEQ ID NO: 26945
  misc_feature 1..155: note = chr1:231298924-231299079
  misc_feature 1..155: note = hyper
  source 1..155: mol_type = genomic DNA

SEQ ID NO: 47871 - DNA, 25 bp, Homo sapiens
  misc_feature 1..25: note = chr1:231299434-231299459
  misc_feature 1..25: note = hyper
  source 1..25: mol_type = genomic DNA
atcccggggacccttcgccaagcat

SEQ ID NO: 47872 - DNA, 163 bp, Homo sapiens; identical to SEQ ID NO: 26947
  misc_feature 1..163: note = chr1:231299478-231299641
  misc_feature 1..163: note = hyper
  source 1..163: mol_type = genomic DNA

SEQ ID NO: 47873 - DNA, 38 bp, Homo sapiens; identical to SEQ ID NO: 26948
  misc_feature 1..38: note = chr1:232765315-232765353
  misc_feature 1..38: note = hyper
  source 1..38: mol_type = genomic DNA

SEQ ID NO: 47874 - DNA, 162 bp, Homo sapiens
  misc_feature 1..162: note = chr1:234040319-234040481
  misc_feature 1..162: note = hyper
  source 1..162: mol_type = genomic DNA
tccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcc

SEQ ID NO: 47875 - DNA, 213 bp, Homo sapiens; identical to SEQ ID NO: 1897
  misc_feature 1..213: note = chr1:234041148-234041361
  misc_feature 1..213: note = hyper
  source 1..213: mol_type = genomic DNA

SEQ ID NO: 47876 - DNA, 119 bp, Homo sapiens
  misc_feature 1..119: note = chr1:234349869-234349988
  misc_feature 1..119: note = hyper
  source 1..119: mol_type = genomic DNA
cagggatgagggctgcggggctgggcgtcccggggaggagggcggagcaggtgagctgcggggtgggagcagggagtgcacttgtacgtgacgttggagtttgcagcaacctccaagta

SEQ ID NO: 47877 - DNA, 208 bp, Homo sapiens
  misc_feature 1..208: note = chr1:234350100-234350308
  misc_feature 1..208: note = hyper
  source 1..208: mol_type = genomic DNA
gaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgaccctta

SEQ ID NO: 47878 - DNA, 279 bp, Homo sapiens; identical to SEQ ID NO: 5978
  misc_feature 1..279: note = chr1:235812015-235812294
  misc_feature 1..279: note = hyper
  source 1..279: mol_type = genomic DNA

SEQ ID NO: 47879 - DNA, 444 bp, Homo sapiens; identical to SEQ ID NO: 26957
  misc_feature 1..444: note = chr1:235812717-235813161
  misc_feature 1..444: note = hyper
  source 1..444: mol_type = genomic DNA

SEQ ID NO: 47880 - DNA, 145 bp, Homo sapiens
  misc_feature 1..145: note = chr1:235813636-235813781
  misc_feature 1..145: note = hyper
  source 1..145: mol_type = genomic DNA
cggaggggtctggggcggggccggggttgctggaggggtctggggacggggccgcggtcagcgcgggctccccgaagcctcaggtaccgccctcgctcggggtgagctccagcgcctgggccgttggggcgcgggccgcttccca

SEQ ID NO: 47881 - DNA, 112 bp, Homo sapiens; identical to SEQ ID NO: 17383
  misc_feature 1..112: note = chr1:236228096-236228208
  misc_feature 1..112: note = hyper
  source 1..112: mol_type = genomic DNA

SEQ ID NO: 47882 - DNA, 19 bp, Homo sapiens
  misc_feature 1..19: note = chr1:236228563-236228582
  misc_feature 1..19: note = hyper
  source 1..19: mol_type = genomic DNA
gcagcccaatggccgcgag

SEQ ID NO: 47883 - DNA, 62 bp, Homo sapiens
  misc_feature 1..62: note = chr1:236228789-236228851
  misc_feature 1..62: note = hyper
  source 1..62: mol_type = genomic DNA
cgctcggccgcgtccggggtccaattcgcttgaccctggtaggaagacggggtgggagctgg

SEQ ID NO: 47884 - DNA, 31 bp, Homo sapiens; identical to SEQ ID NO: 5986
  misc_feature 1..31: note = chr1:236558486-236558517
  misc_feature 1..31: note = hyper
  source 1..31: mol_type = genomic DNA

SEQ ID NO: 47885 - DNA, 629 bp, Homo sapiens
  misc_feature 1..629: note = chr1:236558547-236559176
  misc_feature 1..629: note = hyper
  source 1..629: mol_type = genomic DNA
cgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcg

SEQ ID NO: 47886 - DNA, 97 bp, Homo sapiens; identical to SEQ ID NO: 17388
  misc_feature 1..97: note = chr1:236559271-236559368
  misc_feature 1..97: note = hyper
  source 1..97: mol_type = genomic DNA

SEQ ID NO: 47887 - DNA, 15 bp, Homo sapiens
  misc_feature 1..15: note = chr1:236850197-236850212
  misc_feature 1..15: note = hyper
  source 1..15: mol_type = genomic DNA
cgctttgtggaggtg

SEQ ID NO: 47888 - DNA, 210 bp, Homo sapiens; identical to SEQ ID NO: 26972
  misc_feature 1..210: note = chr1:239549605-239549815
  misc_feature 1..210: note = hyper
  source 1..210: mol_type = genomic DNA

SEQ ID NO: 47889 - DNA, 89 bp, Homo sapiens; identical to SEQ ID NO: 26973
  misc_feature 1..89: note = chr1:239550034-239550123
  misc_feature 1..89: note = hyper
  source 1..89: mol_type = genomic DNA

SEQ ID NO: 47890 - DNA, 134 bp, Homo sapiens; identical to SEQ ID NO: 26975
  misc_feature 1..134: note = chr1:240160952-240161086
  misc_feature 1..134: note = hyper
  source 1..134: mol_type = genomic DNA

SEQ ID NO: 47891 - DNA, 125 bp, Homo sapiens
  misc_feature 1..125: note = chr1:240254819-240254944
  misc_feature 1..125: note = hyper
  source 1..125: mol_type = genomic DNA
tatgtggctgtgacccgatggcacctctaaactggaattgggcttcagtttttctccgtgtaaaaatttcttcttttttatttaacttttctcttggcaggtccagcagctttgaagatcagagt

SEQ ID NO: 47892 - DNA, 350 bp, Homo sapiens; identical to SEQ ID NO: 17391
  misc_feature 1..350: note = chr1:240255011-240255361
  misc_feature 1..350: note = hyper
  source 1..350: mol_type = genomic DNA

SEQ ID NO: 47893 - DNA, 319 bp, Homo sapiens; identical to SEQ ID NO: 17392
  misc_feature 1..319: note = chr1:240255500-240255819
  misc_feature 1..319: note = hyper
  source 1..319: mol_type = genomic DNA

SEQ ID NO: 47894 - DNA, 39 bp, Homo sapiens
  misc_feature 1..39: note = chr1:240256624-240256663
  misc_feature 1..39: note = hyper
  source 1..39: mol_type = genomic DNA
cgctgtttcaagccctacccgctcatcaccccctgctac

SEQ ID NO: 47895 - DNA, 238 bp, Homo sapiens; identical to SEQ ID NO: 26980
  misc_feature 1..238: note = chr1:240775075-240775313
  misc_feature 1..238: note = hyper
  source 1..238: mol_type = genomic DNA

SEQ ID NO: 47896 - DNA, 47 bp, Homo sapiens; identical to SEQ ID NO: 17394
  misc_feature 1..47: note = chr1:240775378-240775425
  misc_feature 1..47: note = hyper
  source 1..47: mol_type = genomic DNA

SEQ ID NO: 47897 - DNA, 197 bp, Homo sapiens
  misc_feature 1..197: note = chr1:241520099-241520296
  misc_feature 1..197: note = hyper
  source 1..197: mol_type = genomic DNA
cggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggt

SEQ ID NO: 47898 - DNA, 188 bp, Homo sapiens
  misc_feature 1..188: note = chr1:241520345-241520533
  misc_feature 1..188: note = hyper
  source 1..188: mol_type = genomic DNA
agctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgg

SEQ ID NO: 47899 - DNA, 138 bp, Homo sapiens
  misc_feature 1..138: note = chr1:241587113-241587251
  misc_feature 1..138: note = hyper
  source 1..138: mol_type = genomic DNA
gtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggca

SEQ ID NO: 47900 - DNA, 116 bp, Homo sapiens
  misc_feature 1..116: note = chr1:241587471-241587587
  misc_feature 1..116: note = hyper
  source 1..116: mol_type = genomic DNA
gggtagcagggcagtcgagcacggagggaggggcgggcctccaggggacttcagcgggagccgggcctggggcggtgccgcacttgcacacggagtgtggggggccaggcctggga

SEQ ID NO: 47901 - DNA, 81 bp, Homo sapiens; identical to SEQ ID NO: 17398
  misc_feature 1..81: note = chr1:241587797-241587878
  misc_feature 1..81: note = hyper
  source 1..81: mol_type = genomic DNA

SEQ ID NO: 47902 - DNA, 40 bp, Homo sapiens; identical to SEQ ID NO: 26986
  misc_feature 1..40: note = chr1:242161790-242161830
  misc_feature 1..40: note = hyper
  source 1..40: mol_type = genomic DNA

SEQ ID NO: 47903 - DNA, 111 bp, Homo sapiens
  misc_feature 1..111: note = chr1:242687688-242687799
  misc_feature 1..111: note = hyper
  source 1..111: mol_type = genomic DNA
agactgagctggaggagctggaggagcgagcgggcgcggggagcgcggggtgctgagcgccagctgggagcgcggccgggcgggagggggcgatcgcgggaggcgcggggc

SEQ ID NO: 47904 - DNA, 27 bp, Homo sapiens
  misc_feature 1..27: note = chr1:242688007-242688034
  misc_feature 1..27: note = hyper
  source 1..27: mol_type = genomic DNA
ggccggctcccggggcggcggcggcgg

SEQ ID NO: 47905 - DNA, 104 bp, Homo sapiens
  misc_feature 1..104: note = chr1:242688080-242688184
  misc_feature 1..104: note = hyper
  source 1..104: mol_type = genomic DNA
cgcgcctgcaggttggtgcagtgaggagccgccgccgcccctcccgccgcgcccaggcccgggcggccgcgctcccgctccgcacccgcctttcccgagcaggc

SEQ ID NO: 47906 - DNA, 200 bp, Homo sapiens
  misc_feature 1..200: note = chr1:242688277-242688477
  misc_feature 1..200: note = hyper
  source 1..200: mol_type = genomic DNA
cgcggggatggctccggagggagacactcaggaaaccacctccgcccttcccccatctctatccagcggcgccccctcaccctgcccccggctcgcttgggctgcgccttcccccattctgaaagttcactaacttcccaccccaagggacttagagcagagggtgcccagcattcccccctgaaaatagccgagagaca

SEQ ID NO: 47907 - DNA, 92 bp, Homo sapiens; identical to SEQ ID NO: 26991
  misc_feature 1..92: note = chr1:243053773-243053865
  misc_feature 1..92: note = hyper
  source 1..92: mol_type = genomic DNA

SEQ ID NO: 47908 - DNA, 167 bp, Homo sapiens; identical to SEQ ID NO: 26992
  misc_feature 1..167: note = chr1:243053866-243054033
  misc_feature 1..167: note = hyper
  source 1..167: mol_type = genomic DNA

SEQ ID NO: 47909 - DNA, 125 bp, Homo sapiens
  misc_feature 1..125: note = chr1:243646485-243646610
  misc_feature 1..125: note = hyper
  source 1..125: mol_type = genomic DNA
ggcggctgcggagcccggggaggaggcggcgggcgcccgggtcttcctcggagcgcgccccctgggctgggcggcgtgtccctgcctcccgccggcgccctcgtccccgcagcagcgtccccgcc

SEQ ID NO: 47910 - DNA, 75 bp, Homo sapiens
  misc_feature 1..75: note = chr1:243646673-243646748
  misc_feature 1..75: note = hyper
  source 1..75: mol_type = genomic DNA
aggctgctgagcacgagcgccctccgcgacccgcccctgctcccgcctccactcttgcctcggggggagggtctc

SEQ ID NO: 47911 - DNA, 248 bp, Homo sapiens; identical to SEQ ID NO: 26994
  misc_feature 1..248: note = chr1:244014423-244014671
  misc_feature 1..248: note = hyper
  source 1..248: mol_type = genomic DNA

SEQ ID NO: 47912 - DNA, 202 bp, Homo sapiens; identical to SEQ ID NO: 17403
  misc_feature 1..202: note = chr1:244080470-244080672
  misc_feature 1..202: note = hyper
  source 1..202: mol_type = genomic DNA

SEQ ID NO: 47913 - DNA, 93 bp, Homo sapiens; identical to SEQ ID NO: 17404
  misc_feature 1..93: note = chr1:244080702-244080795
  misc_feature 1..93: note = hyper
  source 1..93: mol_type = genomic DNA

SEQ ID NO: 47914 - DNA, 786 bp, Homo sapiens; identical to SEQ ID NO: 26996
  misc_feature 1..786: note = chr1:244893526-244894312
  misc_feature 1..786: note = hyper
  source 1..786: mol_type = genomic DNA

SEQ ID NO: 47915 - DNA, 176 bp, Homo sapiens; identical to SEQ ID NO: 26997
  misc_feature 1..176: note = chr1:247171005-247171181
  misc_feature 1..176: note = hyper
  source 1..176: mol_type = genomic DNA

SEQ ID NO: 47916 - DNA, 166 bp, Homo sapiens; identical to SEQ ID NO: 26998
  misc_feature 1..166: note = chr1:247171251-247171417
  misc_feature 1..166: note = hyper
  source 1..166: mol_type = genomic DNA

SEQ ID NO: 47917 - DNA, 120 bp, Homo sapiens; identical to SEQ ID NO: 26999
  misc_feature 1..120: note = chr1:247274343-247274463
  misc_feature 1..120: note = hyper
  source 1..120: mol_type = genomic DNA

SEQ ID NO: 47918 - DNA, 77 bp, Homo sapiens; identical to SEQ ID NO: 27000
  misc_feature 1..77: note = chr1:247274523-247274600
  misc_feature 1..77: note = hyper
  source 1..77: mol_type = genomic DNA

SEQ ID NO: 47919 - DNA, 111 bp, Homo sapiens; identical to SEQ ID NO: 27001
  misc_feature 1..111: note = chr1:247274826-247274937
  misc_feature 1..111: note = hyper
  source 1..111: mol_type = genomic DNA

SEQ ID NO: 47920 - DNA, 29 bp, Homo sapiens
  misc_feature 1..29: note = chr1:248020420-248020449
  misc_feature 1..29: note = hyper
  source 1..29: mol_type = genomic DNA
ttgaactgaagccagcggacaccacccgt

SEQ ID NO: 47921 - DNA, 80 bp, Homo sapiens
  misc_feature 1..80: note = chr2:287500-287580
  misc_feature 1..80: note = hyper
  source 1..80: mol_type = genomic DNA
tgtctctttttgaaacgtgtttctcaaagacaattctatttcccagcagccccggccctcgggcgcgctcggccccactc

SEQ ID NO: 47922 - DNA, 50 bp, Homo sapiens
  misc_feature 1..50: note = chr2:287641-287691
  misc_feature 1..50: note = hyper
  source 1..50: mol_type = genomic DNA
tcccgcccgaggagctgcaggcccttgtgctccgccgagtggtgcttccg

SEQ ID NO: 47923 - DNA, 42 bp, Homo sapiens; identical to SEQ ID NO: 27006
  misc_feature 1..42: note = chr2:288009-288051
  misc_feature 1..42: note = hyper
  source 1..42: mol_type = genomic DNA

SEQ ID NO: 47924 - DNA, 135 bp, Homo sapiens
  misc_feature 1..135: note = chr2:288269-288404
  misc_feature 1..135: note = hyper
  source 1..135: mol_type = genomic DNA
ggacctcggaggggccgcgctcccgcgcctaccgctctccaagaaggcggcgccgcgcgccgggcccggcggccgcgctcaagtttccagcgtcgcctttgcgcggtggtcgccggcgagcgccgagtccccgaa

SEQ ID NO: 47925 - DNA, 372 bp, Homo sapiens
  misc_feature 1..372: note = chr2:288470-288842
  misc_feature 1..372: note = hyper
  source 1..372: mol_type = genomic DNA
tccacctcccggccatggcgccctcccgcacctgcccggcgccacccgggagccacctgcgcgtcgtggccgggccggttacctggagccgccggagtcgtcgccgtctgtgcgcacgtctgtccccgcgccccgagctgcgccactactccatgcccggcgggcggagcgcacgggacgcggggactcggccgctccgagcgctggacccacggccgacctggggtgcgccggctccgagtcccgcctcagacctcggggagcttcttatccccgcgcccgccgacgtcaggcgggtccccaagggctccgagcggggctttaattagaagccgctgaagtgttagtacccccatgcggatcttcgtcagt

SEQ ID NO: 47926 - DNA, 123 bp, Homo sapiens; identical to SEQ ID NO: 27008
  misc_feature 1..123: note = chr2:289223-289346
  misc_feature 1..123: note = hyper
  source 1..123: mol_type = genomic DNA

SEQ ID NO: 47927 - DNA, 740 bp, Homo sapiens; identical to SEQ ID NO: 27009
  misc_feature 1..740: note = chr2:289672-290412
  misc_feature 1..740: note = hyper
  source 1..740: mol_type = genomic DNA

SEQ ID NO: 47928 - DNA, 119 bp, Homo sapiens; identical to SEQ ID NO: 27010
  misc_feature 1..119: note = chr2:468115-468234
  misc_feature 1..119: note = hyper
  source 1..119: mol_type = genomic DNA

SEQ ID NO: 47929 - DNA, 31 bp, Homo sapiens
  misc_feature 1..31: note = chr2:468672-468703
  misc_feature 1..31: note = hyper
  source 1..31: mol_type = genomic DNA
cctcaacacattggctcggaaatgtacagtc

SEQ ID NO: 47930 - DNA, 101 bp, Homo sapiens
  misc_feature 1..101: note = chr2:945812-945913
  misc_feature 1..101: note = hyper
  source 1..101: mol_type = genomic DNA
ggagactccgcggaccggaggagggataggacccccgagctttgggggcgggaagggagggtggaaggaggaggggagcggggttggggaaagttggagct

SEQ ID NO: 47931 - DNA, 10 bp, Homo sapiens
  misc_feature 1..10: note = chr2:946000-946010
  misc_feature 1..10: note = hyper
  source 1..10: mol_type = genomic DNA
ggacgcggcc

SEQ ID NO: 47932 - DNA, 197 bp, Homo sapiens; identical to SEQ ID NO: 17416
  misc_feature 1..197: note = chr2:946011-946208
  misc_feature 1..197: note = hyper
  source 1..197: mol_type = genomic DNA

SEQ ID NO: 47933 - DNA, 115 bp, Homo sapiens; identical to SEQ ID NO: 1922
  misc_feature 1..115: note = chr2:946289-946404
  misc_feature 1..115: note = hyper
  source 1..115: mol_type = genomic DNA

SEQ ID NO: 47934 - DNA, 94 bp, Homo sapiens
  misc_feature 1..94: note = chr2:946432-946526
  misc_feature 1..94: note = hyper
  source 1..94: mol_type = genomic DNA
cgctcgccgccctccccgcgggtgcgcgcccggcccctccctcgcccggggcgggtctgcgtgggcggtgctccgggtcggcgggcggagctcc

SEQ ID NO: 47935 - DNA, 22 bp, Homo sapiens
  misc_feature 1..22: note = chr2:947159-947181
  misc_feature 1..22: note = hyper
  source 1..22: mol_type = genomic DNA
cttcgggcgcccaggccaggtc

SEQ ID NO: 47936 - DNA, 97 bp, Homo sapiens
  misc_feature 1..97: note = chr2:1746517-1746614
  misc_feature 1..97: note = hyper
  source 1..97: mol_type = genomic DNA
tgggctgaccattcacgggctctggaaagaaagccttggtctctctgcggaggaggagaggaactcgggcccccgccccgccccagggcctccagga

SEQ ID NO: 47937 - DNA, 20 bp, Homo sapiens
  misc_feature 1..20: note = chr2:1747650-1747670
  misc_feature 1..20: note = hyper
  source 1..20: mol_type = genomic DNA
ggggaagcgggaggccggcg

SEQ ID NO: 47938 - DNA, 42 bp, Homo sapiens; identical to SEQ ID NO: 27021
  misc_feature 1..42: note = chr2:5813681-5813723
  misc_feature 1..42: note = hyper
  source 1..42: mol_type = genomic DNA

SEQ ID NO: 47939 - DNA, 199 bp, Homo sapiens
  misc_feature 1..199: note = chr2:5830979-5831178
  misc_feature 1..199: note = hyper
  source 1..199: mol_type = genomic DNA
tttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaaca

SEQ ID NO: 47940 - DNA, 77 bp, Homo sapiens
  misc_feature 1..77: note = chr2:5831324-5831401
  misc_feature 1..77: note = hyper
  source 1..77: mol_type = genomic DNA
ttctctttggtttatgagtgacccagaaggcttctagctcacaatcgcacgatttcaggacgaggctgccggagaag

SEQ ID NO: 47941 - DNA, 86 bp, Homo sapiens; identical to SEQ ID NO: 27024
  misc_feature 1..86: note = chr2:5831467-5831553
  misc_feature 1..86: note = hyper
  source 1..86: mol_type = genomic DNA

SEQ ID NO: 47942 - DNA, 229 bp, Homo sapiens; identical to SEQ ID NO: 17421
  misc_feature 1..229: note = chr2:5831819-5832048
  misc_feature 1..229: note = hyper
  source 1..229: mol_type = genomic DNA

SEQ ID NO: 47943 - skipped

SEQ ID NO: 47944 - DNA, 116 bp, Homo sapiens; identical to SEQ ID NO: 1925
  misc_feature 1..116: note = chr2:5832731-5832847
  misc_feature 1..116: note = hyper
  source 1..116: mol_type = genomic DNA

SEQ ID NO: 47945 - DNA, 72 bp, Homo sapiens
  misc_feature 1..72: note = chr2:5834028-5834100
  misc_feature 1..72: note = hyper
  source 1..72: mol_type = genomic DNA
gtcgctggtggataaggatttggattcgttcagcgagggcagcctgggctcccacttcgagttccccgacta

SEQ ID NO: 47946 - DNA, 295 bp, Homo sapiens
  misc_feature 1..295: note = chr2:5836253-5836548
  misc_feature 1..295: note = hyper
  source 1..295: mol_type = genomic DNA
cccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcggg

SEQ ID NO: 47947 - DNA, 54 bp, Homo sapiens; identical to SEQ ID NO: 17424
  misc_feature 1..54: note = chr2:5837414-5837468
  misc_feature 1..54: note = hyper
  source 1..54: mol_type = genomic DNA

SEQ ID NO: 47948 - DNA, 24 bp, Homo sapiens
  misc_feature 1..24: note = chr2:5866074-5866098
  misc_feature 1..24: note = hyper
  source 1..24: mol_type = genomic DNA
ctgggggcagcagagcgacgtgcc

SEQ ID NO: 47949 - DNA, 228 bp, Homo sapiens; identical to SEQ ID NO: 27036
  misc_feature 1..228: note = chr2:6121893-6122121
  misc_feature 1..228: note = hyper
  source 1..228: mol_type = genomic DNA

SEQ ID NO: 47950 - DNA, 30 bp, Homo sapiens; identical to SEQ ID NO: 27037
  misc_feature 1..30: note = chr2:7057304-7057334
  misc_feature 1..30: note = hyper
  source 1..30: mol_type = genomic DNA

SEQ ID NO: 47951 - DNA, 235 bp, Homo sapiens; identical to SEQ ID NO: 27038
  misc_feature 1..235: note = chr2:7058143-7058378
  misc_feature 1..235: note = hyper
  source 1..235: mol_type = genomic DNA

SEQ ID NO: 47952 - DNA, 33 bp, Homo sapiens; identical to SEQ ID NO: 27039
  misc_feature 1..33: note = chr2:7571090-7571123
  misc_feature 1..33: note = hyper
  source 1..33: mol_type = genomic DNA

SEQ ID NO: 47953 - DNA, 320 bp, Homo sapiens; identical to SEQ ID NO: 27040
  misc_feature 1..320: note = chr2:7571157-7571477
  misc_feature 1..320: note = hyper
  source 1..320: mol_type = genomic DNA

SEQ ID NO: 47954 - DNA, 80 bp, Homo sapiens; identical to SEQ ID NO: 27042
  misc_feature 1..80: note = chr2:9143213-9143293
  misc_feature 1..80: note = hyper
  source 1..80: mol_type = genomic DNA

SEQ ID NO: 47955 - DNA, 47 bp, Homo sapiens
  misc_feature 1..47: note = chr2:10182780-10182827
  misc_feature 1..47: note = hyper
  source 1..47: mol_type = genomic DNA
aaccacaccaagagacgcgagcaaccgaaatatagggagaaaaaaaa

SEQ ID NO: 47956 - DNA, 216 bp, Homo sapiens
  misc_feature 1..216: note = chr2:10182904-10183120
  misc_feature 1..216: note = hyper
  source 1..216: mol_type = genomic DNA
tgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtca

SEQ ID NO: 47957 - DNA, 155 bp, Homo sapiens; identical to SEQ ID NO: 27044
  misc_feature 1..155: note = chr2:10220786-10220941
  misc_feature 1..155: note = hyper
  source 1..155: mol_type = genomic DNA

SEQ ID NO: 47958 - DNA, 49 bp, Homo sapiens; identical to SEQ ID NO: 27045
  misc_feature 1..49: note = chr2:10220958-10221007
  misc_feature 1..49: note = hyper
  source 1..49: mol_type = genomic DNA

SEQ ID NO: 47959 - DNA, 143 bp, Homo sapiens; identical to SEQ ID NO: 27046
  misc_feature 1..143: note = chr2:10444448-10444591
  misc_feature 1..143: note = hyper
  source 1..143: mol_type = genomic DNA

SEQ ID NO: 47960 - DNA, 30 bp, Homo sapiens; identical to SEQ ID NO: 27047
  misc_feature 1..30: note = chr2:10589172-10589202
  misc_feature 1..30: note = hyper
  source 1..30: mol_type = genomic DNA

SEQ ID NO: 47961 - DNA, 52 bp, Homo sapiens
  misc_feature 1..52: note = chr2:10688822-10688874
  misc_feature 1..52: note = hyper
  source 1..52: mol_type = genomic DNA
tgcttgcagcctggccgcgtgtgcgcctctgctgggatgacccggtcctgtt

SEQ ID NO: 47962 - DNA, 44 bp, Homo sapiens; identical to SEQ ID NO: 27049
  misc_feature 1..44: note = chr2:10861191-10861235
  misc_feature 1..44: note = hyper
  source 1..44: mol_type = genomic DNA

SEQ ID NO: 47963 - DNA, 30 bp, Homo sapiens; identical to SEQ ID NO: 27050
  misc_feature 1..30: note = chr2:11052102-11052132
  misc_feature 1..30: note = hyper
  source 1..30: mol_type = genomic DNA

SEQ ID NO: 47964 - DNA, 156 bp, Homo sapiens
  misc_feature 1..156: note = chr2:11052361-11052517
  misc_feature 1..156: note = hyper
  source 1..156: mol_type = genomic DNA
ggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggc

SEQ ID NO: 47965 - DNA, 134 bp, Homo sapiens
  misc_feature 1..134: note = chr2:11052559-11052693
  misc_feature 1..134: note = hyper
  source 1..134: mol_type = genomic DNA
ggtccggggagcgcagcctcccggagccgggcagccagagctccgctgccagcgacgacatagagatagtcgtcaacgtggggggcgtgcggcaggtgctgtacggggacctcctcagtcagtaccctgagacc

SEQ ID NO: 47966 - DNA, 556 bp, Homo sapiens; identical to SEQ ID NO: 27052
  misc_feature 1..556: note = chr2:11622808-11623364
  misc_feature 1..556: note = hyper
  source 1..556: mol_type = genomic DNA

SEQ ID NO: 47967 - DNA, 135 bp, Homo sapiens; identical to SEQ ID NO: 27053
  misc_feature 1..135: note = chr2:11623424-11623559
  misc_feature 1..135: note = hyper
  source 1..135: mol_type = genomic DNA

SEQ ID NO: 47968 - DNA, 111 bp, Homo sapiens
  misc_feature 1..111: note = chr2:12858341-12858452
  misc_feature 1..111: note = hyper
  source 1..111: mol_type = genomic DNA
tcagtggcaccgaggcgcctgcagccgcactcgccagcgactcatctctccagcgggtttttttttgtttgtcgtgtgcgatcctcacactcatgaacatacacaggtcta

SEQ ID NO: 47969 - DNA, 12 bp, Homo sapiens
  misc_feature 1..12: note = chr2:12858618-12858630
  misc_feature 1..12: note = hyper
  source 1..12: mol_type = genomic DNA
gaaatacttatt

SEQ ID NO: 47970 - DNA, 30 bp, Homo sapiens; identical to SEQ ID NO: 27055
  misc_feature 1..30: note = chr2:14773043-14773073
  misc_feature 1..30: note = hyper
  source 1..30: mol_type = genomic DNA

SEQ ID NO: 47971 - DNA, 71 bp, Homo sapiens; identical to SEQ ID NO: 27056
  misc_feature 1..71: note = chr2:14773957-14774028
  misc_feature 1..71: note = hyper
  source 1..71: mol_type = genomic DNA

SEQ ID NO: 47972 - DNA, 50 bp, Homo sapiens; identical to SEQ ID NO: 27057
  misc_feature 1..50: note = chr2:14774593-14774643
  misc_feature 1..50: note = hyper
  source 1..50: mol_type = genomic DNA

SEQ ID NO: 47973 - DNA, 319 bp, Homo sapiens; identical to SEQ ID NO: 27058
  misc_feature 1..319: note = chr2:14774939-14775258
  misc_feature 1..319: note = hyper
  source 1..319: mol_type = genomic DNA

SEQ ID NO: 47974 - DNA, 83 bp, Homo sapiens; identical to SEQ ID NO: 27059
  misc_feature 1..83: note = chr2:14775608-14775691
  misc_feature 1..83: note = hyper
  source 1..83: mol_type = genomic DNA

SEQ ID NO: 47975 - DNA, 46 bp, Homo sapiens; identical to SEQ ID NO: 27060
  misc_feature 1..46: note = chr2:16080930-16080976
  misc_feature 1..46: note = hyper
  source 1..46: mol_type = genomic DNA

SEQ ID NO: 47976 - DNA, 989 bp, Homo sapiens; identical to SEQ ID NO: 27061
  misc_feature 1..989: note = chr2:16082016-16083005
  misc_feature 1..989: note = hyper
  source 1..989: mol_type = genomic DNA

SEQ ID NO: 47977 - DNA, 43 bp, Homo sapiens; identical to SEQ ID NO: 27062
  misc_feature 1..43: note = chr2:17699420-17699463
  misc_feature 1..43: note = hyper
  source 1..43: mol_type = genomic DNA

SEQ ID NO: 47978 - DNA, 11 bp, Homo sapiens
  misc_feature 1..11: note = chr2:17719677-17719688
  misc_feature 1..11: note = hyper
  source 1..11: mol_type = genomic DNA
taaacattaca

SEQ ID NO: 47979 - DNA, 290 bp, Homo sapiens; identical to SEQ ID NO: 27064
  misc_feature 1..290: note = chr2:17720027-17720317
  misc_feature 1..290: note = hyper
  source 1..290: mol_type = genomic DNA

SEQ ID NO: 47980 - DNA, 157 bp, Homo sapiens; identical to SEQ ID NO: 27065
  misc_feature 1..157: note = chr2:17721522-17721679
  misc_feature 1..157: note = hyper
  source 1..157: mol_type = genomic DNA

SEQ ID NO: 47981 - DNA, 117 bp, Homo sapiens; identical to SEQ ID NO: 27066
  misc_feature 1..117: note = chr2:17721750-17721867
  misc_feature 1..117: note = hyper
  source 1..117: mol_type = genomic DNA

SEQ ID NO: 47982 - DNA, 151 bp, Homo sapiens; identical to SEQ ID NO: 27067
  misc_feature 1..151: note = chr2:18011883-18012034
  misc_feature 1..151: note = hyper
  source 1..151: mol_type = genomic DNA

SEQ ID NO: 47983 - DNA, 86 bp, Homo sapiens; identical to SEQ ID NO: 17442
  misc_feature 1..86: note = chr2:18058949-18059035
  misc_feature 1..86: note = hyper
  source 1..86: mol_type = genomic DNA

SEQ ID NO: 47984 - DNA, 696 bp, Homo sapiens
  misc_feature 1..696: note = chr2:18059085-18059781
  misc_feature 1..696: note = hyper
  source 1..696: mol_type = genomic DNA
cctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcc

SEQ ID NO: 47985 - DNA, 300 bp, Homo sapiens
  misc_feature 1..300: note = chr2:18059841-18060141
  misc_feature 1..300: note = hyper
  source 1..300: mol_type = genomic DNA
cggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttac

SEQ ID NO: 47986 - DNA, 30 bp, Homo sapiens; identical to SEQ ID NO: 27069
  misc_feature 1..30: note = chr2:18060643-18060673
  misc_feature 1..30: note = hyper
  source 1..30: mol_type = genomic DNA

SEQ ID NO: 47987 - DNA, 67 bp, Homo sapiens; identical to SEQ ID NO: 27070
  misc_feature 1..67: note = chr2:19551382-19551449
  misc_feature 1..67: note = hyper
  source 1..67: mol_type = genomic DNA

SEQ ID NO: 47988 - DNA, 157 bp, Homo sapiens; identical to SEQ ID NO: 27071
  misc_feature 1..157: note = chr2:19551499-19551656
  misc_feature 1..157: note = hyper
  source 1..157: mol_type = genomic DNA

SEQ ID NO: 47989 - DNA, 88 bp, Homo sapiens
  misc_feature 1..88: note = chr2:19556980-19557068
  misc_feature 1..88: note = hyper
  source 1..88: mol_type = genomic DNA
cgccgccggtcgctgctagtcccctccagcgcttctcttccctagggggttgtgaacctgggacacctagccttgcacgtggttttgt

SEQ ID NO: 47990 - DNA, 33 bp, Homo sapiens; identical to SEQ ID NO: 27074
  misc_feature 1..33: note = chr2:19558008-19558041
  misc_feature 1..33: note = hyper
  source 1..33: mol_type = genomic DNA

SEQ ID NO: 47991 - DNA, 30 bp, Homo sapiens; identical to SEQ ID NO: 27075
  misc_feature 1..30: note = chr2:19558491-19558521
  misc_feature 1..30: note = hyper
  source 1..30: mol_type = genomic DNA

SEQ ID NO: 47992 - DNA, 99 bp, Homo sapiens
  misc_feature 1..99: note = chr2:19558733-19558832
  misc_feature 1..99: note = hyper
  source 1..99: mol_type = genomic DNA
tcctaggacacagcccgtgctctttgggaggagggagggaggggcagtagctctgtgcaccgggatccccacaccgcggcttgggtttcaacgcacttt

SEQ ID NO: 47993 - DNA, 91 bp, Homo sapiens
  misc_feature 1..91: note = chr2:19558893-19558984
  misc_feature 1..91: note = hyper
  source 1..91: mol_type = genomic DNA
gtggagcagctcctggctatccaagcgtgctcggggccagggtgttaacccaggcagcgctggttaattcctggtgcgggagggccagggt

SEQ ID NO: 47994 - DNA, 157 bp, Homo sapiens
  misc_feature 1..157: note = chr2:19561316-19561473
  misc_feature 1..157: note = hyper
  source 1..157: mol_type = genomic DNA
ccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtc

SEQ ID NO: 47995 - DNA, 22 bp, Homo sapiens
  misc_feature 1..22: note = chr2:19561685-19561707
  misc_feature 1..22: note = hyper
  source 1..22: mol_type = genomic DNA
ggtaaagcgccccagcctgtct

SEQ ID NO: 47996 - DNA, 20 bp, Homo sapiens
  misc_feature 1..20: note = chr2:19563338-19563358
  misc_feature 1..20: note = hyper
  source 1..20: mol_type = genomic DNA
ccctcccggcacacccggag

SEQ ID NO: 47997 - DNA, 73 bp, Homo sapiens
  misc_feature 1..73: note = chr2:20068725-20068798
  misc_feature 1..73: note = hyper
  source 1..73: mol_type = genomic DNA
tgggatgcaagtgcccgccaagccccccgtttcccacgtggagttcccacagggcagcagggaggggccgcgc

SEQ ID NO: 47998 - DNA, 35 bp, Homo sapiens
  misc_feature 1..35: note = chr2:20068885-20068920
  misc_feature 1..35: note = hyper
  source 1..35: mol_type = genomic DNA
agacaacaaagccttctacgcggaagttactggtg

SEQ ID NO: 47999 - DNA, 67 bp, Homo sapiens; identical to SEQ ID NO: 27081
  misc_feature 1..67: note = chr2:20212718-20212785
  misc_feature 1..67: note = hyper
  source 1..67: mol_type = genomic DNA

SEQ ID NO: 48000 - DNA, 329 bp, Homo sapiens
  misc_feature 1..329: note = chr2:20865927-20866256
  misc_feature 1..329: note = hyper
  source 1..329: mol_type = genomic DNA
gcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgct

SEQ ID NO: 48001 - DNA, 65 bp, Homo sapiens; identical to SEQ ID NO: 27084
  misc_feature 1..65: note = chr2:20867171-20867236
  misc_feature 1..65: note = hyper
  source 1..65: mol_type = genomic DNA

SEQ ID NO: 48002 - DNA, 349 bp, Homo sapiens; identical to SEQ ID NO: 27085
  misc_feature 1..349: note = chr2:21022707-21023056
  misc_feature 1..349: note = hyper
  source 1..349: mol_type = genomic DNA

SEQ ID NO: 48003 - DNA, 131 bp, Homo sapiens; identical to SEQ ID NO: 27086
  misc_feature 1..131: note = chr2:23608959-23609090
  misc_feature 1..131: note = hyper
  source 1..131: mol_type = genomic DNA

SEQ ID NO: 48004 - DNA, 120 bp, Homo sapiens; identical to SEQ ID NO: 27087
  misc_feature 1..120: note = chr2:23609527-23609647
  misc_feature 1..120: note = hyper
  source 1..120: mol_type = genomic DNA

SEQ ID NO: 48005 - DNA, 174 bp, Homo sapiens; identical to SEQ ID NO: 27088
  misc_feature 1..174: note = chr2:23609896-23610070
  misc_feature 1..174: note = hyper
  source 1..174: mol_type = genomic DNA

SEQ ID NO: 48006 - DNA, 16 bp, Homo sapiens
  misc_feature 1..16: note = chr2:24232773-24232789
  misc_feature 1..16: note = hyper
  source 1..16: mol_type = genomic DNA
gtcctgagggcctgcc

SEQ ID NO: 48007 - DNA, 114 bp, Homo sapiens; identical to SEQ ID NO: 27090
  misc_feature 1..114: note = chr2:24233349-24233463
  misc_feature 1..114: note = hyper
  source 1..114: mol_type = genomic DNA

SEQ ID NO: 48008 - DNA, 199 bp, Homo sapiens; identical to SEQ ID NO: 27091
  misc_feature 1..199: note = chr2:24273048-24273247
  misc_feature 1..199: note = hyper
  source 1..199: mol_type = genomic DNA

SEQ ID NO: 48009 - DNA, 209 bp, Homo sapiens; identical to SEQ ID NO: 27092
  misc_feature 1..209: note = chr2:25354748-25354957
  misc_feature 1..209: note = hyper
  source 1..209: mol_type = genomic DNA

SEQ ID NO: 48010 - DNA, 472 bp, Homo sapiens; identical to SEQ ID NO: 17455
  misc_feature 1..472: note = chr2:25391212-25391684
  misc_feature 1..472: note = hyper
  source 1..472: mol_type = genomic DNA

SEQ ID NO: 48011 - skipped

SEQ ID NO: 48012 - DNA, 46 bp, Homo sapiens
  misc_feature 1..46: note = chr2:26395401-26395447
  misc_feature 1..46: note = hyper
  source 1..46: mol_type = genomic DNA
gcagaattcagaacccgagctttgggcggcggagcaggacagggcg

SEQ ID NO: 48013 - DNA, 282 bp, Homo sapiens; identical to SEQ ID NO: 27098
  misc_feature 1..282: note = chr2:26396681-26396963
  misc_feature 1..282: note = hyper
  source 1..282: mol_type = genomic DNA

SEQ ID NO: 48014 - DNA, 46 bp, Homo sapiens; identical to SEQ ID NO: 27099
  misc_feature 1..46: note = chr2:26397014-26397060
  misc_feature 1..46: note = hyper
  source 1..46: mol_type = genomic DNA

SEQ ID NO: 48015 - DNA, 328 bp, Homo sapiens
  misc_feature 1..328: note = chr2:26401702-26402030
  misc_feature 1..328: note = hyper
  source 1..328: mol_type = genomic DNA
ccagccccatcttttcgcggggctgcttctgtccgcccgcacgggggaggggaggaggaggcggaggcggaggcagaggcccctaggagggcgaaggccggcgggttaacgaggaggcgctgagtgcacggctgggctccacgctgatttctcctaatgaattaataatggcgctcgggcgggcgggggtggccggctgcggaccgcggagagagccgaggggaaggccgtggagggaggaggacggcgactcgcgccgggtggggctgaaggcactgcggggtgactcggtctccaggctgcggcgctctgctccgggagtcaggga

SEQ ID NO: 48016 - DNA, 166 bp, Homo sapiens
  misc_feature 1..166: note = chr2:26402060-26402226
  misc_feature 1..166: note = hyper
  source 1..166: mol_type = genomic DNA
cccagcccccgcccctggccctgcgggaggggccaggcgtcttccctgagcatggtgccacttccccagtgttggccttgtttcctgctcagcatttggcagatgcgcctctggcccaactaggatgtttccattttacagacgggaaatccgaagcccagagaga

SEQ ID NO: 48017 - DNA, 86 bp, Homo sapiens
  misc_feature 1..86: note = chr2:26915677-26915763
  misc_feature 1..86: note = hyper
  source 1..86: mol_type = genomic DNA
agcggcggccggggccgaggcgcgggccgggggcgccggggggccggcggcggcccgggcgggacgatgaagcggcagaacgtgcg

SEQ ID NO: 48018 - DNA, 130 bp, Homo sapiens
  misc_feature 1..130: note = chr2:26916259-26916389
  misc_feature 1..130: note = hyper
  source 1..130: mol_type = genomic DNA
ttggccctgccatgttgcataggcccccagggactccgaagtgtgtgagaggggcagggacgaccggcggaggctcgggcaggaggggtgtggccgggccaggccctgaacagggcgctgagagtgagcg

SEQ ID NO: 48019 - DNA, 30 bp, Homo sapiens; identical to SEQ ID NO: 27105
  misc_feature 1..30: note = chr2:27069901-27069931
  misc_feature 1..30: note = hyper
  source 1..30: mol_type = genomic DNA

SEQ ID NO: 48020 - DNA, 826 bp, Homo sapiens
  misc_feature 1..826: note = chr2:27070414-27071240
  misc_feature 1..826: note = hyper
  source 1..826: mol_type = genomic DNA
tgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtgatggcaggggggtcggtgggcttacccctcccgggctaggacatcctcctctcccccttctgtttctgcgtgaggcgcacaaaagggcggggagccgggtgagcctggggc

SEQ ID NO: 48021 - DNA, 161 bp, Homo sapiens; identical to SEQ ID NO: 27107
  misc_feature 1..161: note = chr2:27071758-27071919
  misc_feature 1..161: note = hyper
  source 1..161: mol_type = genomic DNA

SEQ ID NO: 48022 - DNA, 30 bp, Homo sapiens; identical to SEQ ID NO: 27108
  misc_feature 1..30: note = chr2:27072330-27072360
  misc_feature 1..30: note = hyper
  source 1..30: mol_type = genomic DNA

SEQ ID NO: 48023 - DNA, 150 bp, Homo sapiens
  misc_feature 1..150: note = chr2:27072672-27072822
  misc_feature 1..150: note = hyper
  source 1..150: mol_type = genomic DNA
ccacgccgggaatcccgtgtgggaggcgctcccccggcctgggggcctgcagacagccacccccccactccggctcgggtgccttctggtgcagcgccgccgcccgccccgcgctgtccacccgctgccgagacgcggcgtggttagcgg

SEQ ID NO: 48024 - DNA, 42 bp, Homo sapiens
  misc_feature 1..42: note = chr2:27072989-27073031
  misc_feature 1..42: note = hyper
  source 1..42: mol_type = genomic DNA
ttgcggagaagcgggtggaaatgatcccgcaagggtgaggct

SEQ ID NO: 48025 - DNA, 302 bp, Homo sapiens; identical to SEQ ID NO: 27110
  misc_feature 1..302: note = chr2:27341792-27342094
  misc_feature 1..302: note = hyper
  source 1..302: mol_type = genomic DNA

SEQ ID NO: 48026 - DNA, 168 bp, Homo sapiens; identical to SEQ ID NO: 27111
  misc_feature 1..168: note = chr2:27473190-27473358
  misc_feature 1..168: note = hyper
  source 1..168: mol_type = genomic DNA

SEQ ID NO: 48027 - DNA, 482 bp, Homo sapiens; identical to SEQ ID NO: 27112
  misc_feature 1..482: note = chr2:27484899-27485381
  misc_feature 1..482: note = hyper
  source 1..482: mol_type = genomic DNA

SEQ ID NO: 48028 - DNA, 30 bp, Homo sapiens; identical to SEQ ID NO: 27113
  misc_feature 1..30: note = chr2:27485609-27485639
  misc_feature 1..30: note = hyper
  source 1..30: mol_type = genomic DNA

SEQ ID NO: 48029 - DNA, 32 bp, Homo sapiens; identical to SEQ ID NO: 27114
  misc_feature 1..32: note = chr2:27486442-27486474
  misc_feature 1..32: note = hyper
  source 1..32: mol_type = genomic DNA

SEQ ID NO: 48030 - DNA, 181 bp, Homo sapiens; identical to SEQ ID NO: 27115
  misc_feature 1..181: note = chr2:27486854-27487035
  misc_feature 1..181: note = hyper
  source 1..181: mol_type = genomic DNA

SEQ ID NO: 48031 - DNA, 200 bp, Homo sapiens; identical to SEQ ID NO: 27116
  misc_feature 1..200: note = chr2:27717830-27718030
  misc_feature 1..200: note = hyper
  source 1..200: mol_type = genomic DNA

SEQ ID NO: 48032 - DNA, 296 bp, Homo sapiens; identical to SEQ ID NO: 27117
  misc_feature 1..296: note = chr2:27938325-27938621
  misc_feature 1..296: note = hyper
  source 1..296: mol_type = genomic DNA

SEQ ID NO: 48033 - DNA, 136 bp, Homo sapiens
  misc_feature 1..136: note = chr2:29338969-29339105
  misc_feature 1..136: note = hyper
  source 1..136: mol_type = genomic DNA
cagtgggtcttcaaagctaaaccaaatggctgtccttgcagtccttggctacctgagatcccttaattctgaaccatccgcacctgggaggggaagttgaaaggagcgctggagctgagcccgcatccttaaggat

SEQ ID NO: 48034 - DNA, 32 bp, Homo sapiens; identical to SEQ ID NO: 27121
  misc_feature 1..32: note = chr2:30142892-30142924
  misc_feature 1..32: note = hyper
  source 1..32: mol_type = genomic DNA

SEQ ID NO: 48035 - DNA, 28 bp, Homo sapiens
  misc_feature 1..28: note = chr2:30143276-30143304
  misc_feature 1..28: note = hyper
  source 1..28: mol_type = genomic DNA
gccagccttcagctccgaggaggatggt

SEQ ID NO: 48036 - DNA, 220 bp, Homo sapiens
  misc_feature 1..220: note = chr2:30143492-30143712
  misc_feature 1..220: note = hyper
  source 1..220: mol_type = genomic DNA
cggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaa

SEQ ID NO: 48037 - DNA, 83 bp, Homo sapiens
  misc_feature 1..83: note = chr2:30143958-30144041
  misc_feature 1..83: note = hyper
  source 1..83: mol_type = genomic DNA
ttttaaggctgagaacggcggctcccagctgctgcacgctgtcctggccgccttttgcgttccttttggctcctccaagctct

SEQ ID NO: 48038 - DNA, 168 bp, Homo sapiens; identical to SEQ ID NO: 17468
  misc_feature 1..168: note = chr2:30144411-30144579
  misc_feature 1..168: note = hyper
  source 1..168: mol_type = genomic DNA

SEQ ID NO: 48039 - DNA, 113 bp, Homo sapiens; identical to SEQ ID NO: 27126
  misc_feature 1..113: note = chr2:30144580-30144693
  misc_feature 1..113: note = hyper
  source 1..113: mol_type = genomic DNA

SEQ ID NO: 48040 - DNA, 29 bp, Homo sapiens
  misc_feature 1..29: note = chr2:30453625-30453654
  misc_feature 1..29: note = hyper
  source 1..29: mol_type = genomic DNA
cacaccttctgcccccgctgcagaccggg

SEQ ID NO: 48041 - DNA, 288 bp, Homo sapiens
  misc_feature 1..288: note = chr2:30453941-30454229
  misc_feature 1..288: note = hyper
  source 1..288: mol_type = genomic DNA
acagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccg

SEQ ID NO: 48042 - DNA, 133 bp, Homo sapiens; identical to SEQ ID NO: 27129
  misc_feature 1..133: note = chr2:30454460-30454593
  misc_feature 1..133: note = hyper
  source 1..133: mol_type = genomic DNA

SEQ ID NO: 48043 - DNA, 247 bp, Homo sapiens; identical to SEQ ID NO: 27130
  misc_feature 1..247: note = chr2:30455560-30455807
  misc_feature 1..247: note = hyper
  source 1..247: mol_type = genomic DNA

SEQ ID NO: 48044 - DNA, 111 bp, Homo sapiens
  misc_feature 1..111: note = chr2:31360195-31360306
  misc_feature 1..111: note = hyper
  source 1..111: mol_type = genomic DNA
atttcctcaactccccgccaataccaaggcgtctgtttttacaggctctttcgtggtgttctgggcacattcaacttccaatgcagctgagagggtcgggaacagttagag

SEQ ID NO: 48045 - DNA, 148 bp, Homo sapiens; identical to SEQ ID NO: 17471
  misc_feature 1..148: note = chr2:31360831-31360979
  misc_feature 1..148: note = hyper
  source 1..148: mol_type = genomic DNA

SEQ ID NO: 48046 - DNA, 60 bp, Homo sapiens
  misc_feature 1..60: note = chr2:31361296-31361356
  misc_feature 1..60: note = hyper
  source 1..60: mol_type = genomic DNA
atagggaaactgactcgagcagcgagagggaggaatccgaggctgtgccaagcaccccgg

SEQ ID NO: 48047 - DNA, 305 bp, Homo sapiens
  misc_feature 1..305: note = chr2:31361385-31361690
  misc_feature 1..305: note = hyper
  source 1..305: mol_type = genomic DNA
gggagggcgggcccgacagacaggccgactcggagcgagcccaggtgggagtgagcggggctctgagagggggcgctaccgccgcccgccgaccgaaacgctcggtgctgttgcggggccgccagcgccaagccctgggcgcagctcccagaccatcgtgggttggggcaaggcggggcggggcgggagcggtgcactcgggatgcccgccacccccagctgccagctgggacccaagggccggccctcgccaggcggcgctgtgcctgggaggactttcccgctcatcgcgggggctgcacgtg

SEQ ID NO: 48048 - DNA, 150 bp, Homo sapiens
  misc_feature 1..150: note = chr2:31457039-31457189
  misc_feature 1..150: note = hyper
  source 1..150: mol_type = genomic DNA
ccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtt

SEQ ID NO: 48049 - DNA, 128 bp, Homo sapiens; identical to SEQ ID NO: 27137
  misc_feature 1..128: note = chr2:32852511-32852639
  misc_feature 1..128: note = hyper
  source 1..128: mol_type = genomic DNA

SEQ ID NO: 48050 - DNA, 110 bp, Homo sapiens; identical to SEQ ID NO: 27138
  misc_feature 1..110: note = chr2:37571787-37571897
  misc_feature 1..110: note = hyper
  source 1..110: mol_type = genomic DNA

SEQ ID NO: 48051 - DNA, 24 bp, Homo sapiens
  misc_feature 1..24: note = chr2:38301261-38301285
  misc_feature 1..24: note = hyper
  source 1..24: mol_type = genomic DNA
gacaagataggagaccggaggggt

SEQ ID NO: 48052 - DNA, 99 bp, Homo sapiens; identical to SEQ ID NO: 6102
  misc_feature 1..99: note = chr2:38301762-38301861
  misc_feature 1..99: note = hyper
  source 1..99: mol_type = genomic DNA

SEQ ID NO: 48053 - DNA, 25 bp, Homo sapiens
  misc_feature 1..25: note = chr2:38302876-38302901
  misc_feature 1..25: note = hyper
  source 1..25: mol_type = genomic DNA
tccatctgaagaggtcgccgggcag

SEQ ID NO: 48054 - DNA, 746 bp, Homo sapiens; identical to SEQ ID NO: 27142
  misc_feature 1..746: note = chr2:38302948-38303694
  misc_feature 1..746: note = hyper
  source 1..746: mol_type = genomic DNA

SEQ ID NO: 48055 - DNA, 79 bp, Homo sapiens; identical to SEQ ID NO: 27143
  misc_feature 1..79: note = chr2:38755384-38755463
  misc_feature 1..79: note = hyper
  source 1..79: mol_type = genomic DNA

SEQ ID NO: 48056 - DNA, 37 bp, Homo sapiens
  misc_feature 1..37: note = chr2:39187181-39187218
  misc_feature 1..37: note = hyper
  source 1..37: mol_type = genomic DNA
acttcgagtcctctccggcggagccgctgggcaacgt

SEQ ID NO: 48057 - DNA, 72 bp, Homo sapiens
  misc_feature 1..72: note = chr2:39893018-39893090
  misc_feature 1..72: note = hyper
  source 1..72: mol_type = genomic DNA
ggaagagggagggagcgggcggagagctggggccaagtgcattgtgtctggcggcggcgcgcgagcccaccg

SEQ ID NO: 48058 - DNA, 471 bp, Homo sapiens
  misc_feature 1..471: note = chr2:39893501-39893972
  misc_feature 1..471: note = hyper
  source 1..471: mol_type = genomic DNA
ctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcctttgtacacctgcctgacatgtgtgtcttttcttgacgctgctccccgtgagggggactaaccgtcaaagactcgacttttctcacccgggctccttccttcaagttgtgctccttttggaaataccgtttg

SEQ ID NO: 48059 - DNA, 141 bp, Homo sapiens
  misc_feature 1..141: note = chr2:40678462-40678603
  misc_feature 1..141: note = hyper
  source 1..141: mol_type = genomic DNA
cctacatttcttcctcgtctgtctctgccccgccacacctccctcctctccgcagtccgtggtgaatgagcacccaacgcccgctggaaaacagggggctcggaaatgtggccttggggaaagaccccagggattaccgga

SEQ ID NO: 48060 - DNA, 130 bp, Homo sapiens; identical to SEQ ID NO: 27152
  misc_feature 1..130: note = chr2:42275776-42275906
  misc_feature 1..130: note = hyper
  source 1..130: mol_type = genomic DNA

SEQ ID NO: 48061 - DNA, 95 bp, Homo sapiens
  misc_feature 1..95: note = chr2:42329336-42329431
  misc_feature 1..95: note = hyper
  source 1..95: mol_type = genomic DNA
aagtgcagatgggttcgcaaacgtggactctctagttttgggtctgcagatggggccggccaccacgtgctctctgagttctctttccaagtaca

SEQ ID NO: 48062 - DNA, 86 bp, Homo sapiens; identical to SEQ ID NO: 6114
  misc_feature 1..86: note = chr2:42329751-42329837
  misc_feature 1..86: note = hyper
  source 1..86: mol_type = genomic DNA

SEQ ID NO: 48063 - skipped

SEQ ID NO: 48064 - DNA, 440 bp, Homo sapiens; identical to SEQ ID NO: 27158
  misc_feature 1..440: note = chr2:42720772-42721212
  misc_feature 1..440: note = hyper
  source 1..440: mol_type = genomic DNA

SEQ ID NO: 48065 - skipped

SEQ ID NO: 48066 - DNA, 457 bp, Homo sapiens
  misc_feature 1..457: note = chr2:43019868-43020325
  misc_feature 1..457: note = hyper
  source 1..457: mol_type = genomic DNA
cactccaggccctggcgagcgcggcggcggcagcgctggggaacggcgtcccgcgccctctgcttctccgcggggcaggggctcggtccccgccaccgtctccggggcgccccacacactggcgcctgcggtggggcctgctcccggcggaggacaaagaatccagacccttcctggacgcttgtccccagacgttccttccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactc

SEQ ID NO: 48067 - DNA, 203 bp, Homo sapiens; identical to SEQ ID NO: 27160
  misc_feature 1..203: note = chr2:43037974-43038177
  misc_feature 1..203: note = hyper
  source 1..203: mol_type = genomic DNA

SEQ ID NO: 48068 - DNA, 51 bp, Homo sapiens; identical to SEQ ID NO: 27161
  misc_feature 1..51: note = chr2:43448422-43448473
  misc_feature 1..51: note = hyper
  source 1..51: mol_type = genomic DNA

SEQ ID NO: 48069 - DNA, 318 bp, Homo sapiens; identical to SEQ ID NO: 27162
  misc_feature 1..318: note = chr2:43451091-43451409
  misc_feature 1..318: note = hyper
  source 1..318: mol_type = genomic DNA

SEQ ID NO: 48070 - DNA, 152 bp, Homo sapiens; identical to SEQ ID NO: 27163
  misc_feature 1..152: note = chr2:43451694-43451846
  misc_feature 1..152: note = hyper
  source 1..152: mol_type = genomic DNA

SEQ ID NO: 48071 - DNA, 18 bp, Homo sapiens
  misc_feature 1..18: note = chr2:43451891-43451909
  misc_feature 1..18: note = hyper
  source 1..18: mol_type = genomic DNA
cgcacggggcccccggcg

SEQ ID NO: 48072 - DNA, 116 bp, Homo sapiens
  misc_feature 1..116: note = chr2:43452327-43452443
  misc_feature 1..116: note = hyper
  source 1..116: mol_type = genomic DNA
gaagccgatggtatgaaaggtgcggcacagctcggtcttgtacttcggatggcgagtcaggctgcgcagctcgtggaagccatgcgcgaactggcacttttcgccgtacttgcacg

SEQ ID NO: 48073 - DNA, 61 bp, Homo sapiens; identical to SEQ ID NO: 27165
  misc_feature 1..61: note = chr2:43864669-43864730
  misc_feature 1..61: note = hyper
  source 1..61: mol_type = genomic DNA

SEQ ID NO: 48074 - DNA, 48 bp, Homo sapiens; identical to SEQ ID NO: 17486
  misc_feature 1..48: note = chr2:45028940-45028988
  misc_feature 1..48: note = hyper
  source 1..48: mol_type = genomic DNA

SEQ ID NO: 48075 - DNA, 118 bp, Homo sapiens; identical to SEQ ID NO: 27168
  misc_feature 1..118: note = chr2:45029987-45030105
  misc_feature 1..118: note = hyper
  source 1..118: mol_type = genomic DNA

SEQ ID NO: 48076 - DNA, 37 bp, Homo sapiens; identical to SEQ ID NO: 27169
  misc_feature 1..37: note = chr2:45154244-45154281
  misc_feature 1..37: note = hyper
  source 1..37: mol_type = genomic DNA

SEQ ID NO: 48077 - DNA, 468 bp, Homo sapiens
  misc_feature 1..468: note = chr2:45159488-45159956
  misc_feature 1..468: note = hyper
  source 1..468: mol_type = genomic DNA
gttggggtcactcctcgcaggcactgtggcttttgtctgcatctggacaacagggtgtgcacccgtgtattcaaataattatgcctgtgggcacttctttattcctcaaattcctgttagtgttcctttaattctcccgtagtgttcctttaattctcccatgtgtattcggtacgattgcctgtacgttccaggcatagtcaggtgactcagcttgagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctttgggaaggataggaccatcatctagggcgtctctcggt

SEQ ID NO: 48078 - DNA, 58 bp, Homo sapiens
  misc_feature 1..58: note = chr2:45160538-45160596
  misc_feature 1..58: note = hyper
  source 1..58: mol_type = genomic DNA
gtagatgtgttttctcgtgagaatgatgcagacttactgctgacttaaggtcagtttg

SEQ ID NO: 48079 - DNA, 380 bp, Homo sapiens
  misc_feature 1..380: note = chr2:45160634-45161014
  misc_feature 1..380: note = hyper
  source 1..380: mol_type = genomic DNA
gtgtctctcctgagcattcgtacaaagtgaagccacctcccctccgccatgcagtctcccagaccgggtcaaaggacccaggctccaggtcgctgaggcctggagggctgaggcccttgctgtgcgccctggtgctctgatcccaaggcccaagctgccccggtacccacttagggtcagggtggaaagcctacgtgggaaagggggacctggaggactacccccacgcccatggcagggtggagtcccgaccttggcatattggacctactcacttggcatctccctgccccgaccccgtctgggatccgtattggcagcgacgaggaagggaggaatggtaagggagttgggtcggtacaggacggaagtgaagatgg

SEQ ID NO: 48080 - DNA, 112 bp, Homo sapiens; identical to SEQ ID NO: 27177
  misc_feature 1..112: note = chr2:45161221-45161333
  misc_feature 1..112: note = hyper
  source 1..112: mol_type = genomic DNA

SEQ ID NO: 48081 - DNA, 207 bp, Homo sapiens; identical to SEQ ID NO: 27178
  misc_feature 1..207: note = chr2:45161334-45161541
  misc_feature 1..207: note = hyper
  source 1..207: mol_type = genomic DNA

SEQ ID NO: 48082 - DNA, 66 bp, Homo sapiens
  misc_feature 1..66: note = chr2:45161597-45161663
  misc_feature 1..66: note = hyper
  source 1..66: mol_type = genomic DNA
cgttggtgggggtgggagggcggctctactctgcgttcactttgggtgcccaggcatgcgaccctg

SEQ ID NO: 48083 - DNA, 123 bp, Homo sapiens
  misc_feature 1..123: note = chr2:45162112-45162235
  misc_feature 1..123: note = hyper
  source 1..123: mol_type = genomic DNA
tgctgcgcgttctttctccctccccctctcagggcgccagggcccagaccaaggagctaagagtgatcgggacttgggggtaccgggtggaactccttgggggccgcccgccaggcttcctgg

SEQ ID NO: 48084 - DNA, 270 bp, Homo sapiens
  misc_feature 1..270: note = chr2:45162481-45162751
  misc_feature 1..270: note = hyper
  source 1..270: mol_type = genomic DNA
caaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagc

SEQ ID NO: 48085 - DNA, 158 bp, Homo sapiens
  misc_feature 1..158: note = chr2:45162913-45163071
  misc_feature 1..158: note = hyper
  source 1..158: mol_type = genomic DNA
tcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagcccc

SEQ ID NO: 48086 - DNA, 322 bp, Homo sapiens; identical to SEQ ID NO: 27182
  misc_feature 1..322: note = chr2:45164822-45165144
  misc_feature 1..322: note = hyper
  source 1..322: mol_type = genomic DNA

SEQ ID NO: 48087 - DNA, 64 bp, Homo sapiens
  misc_feature 1..64: note = chr2:45165500-45165564
  misc_feature 1..64: note = hyper
  source 1..64: mol_type = genomic DNA
ccaagtcccagatcccgcaatcagagcggccagagagcagagaagagacctagaggatctgcaa

SEQ ID NO: 48088 - DNA, 192 bp, Homo sapiens
  misc_feature 1..192: note = chr2:45165594-45165786
  misc_feature 1..192: note = hyper
  source 1..192: mol_type = genomic DNA
tgagcgaccccagggtgcaggcgccctccacgcgccacctcctctagcggtcccccagggtcccttcccagtcctcgcactgccctagggcttgcttggttcccagaccagcgtggaaggccgctgggccccggaacccaaggtccctctgcttctgctccactccccagtgcccagcgcctgggaatttgg

SEQ ID NO: 48089 - DNA, 73 bp, Homo sapiens; identical to SEQ ID NO: 27184
  misc_feature 1..73: note = chr2:45166113-45166186
  misc_feature 1..73: note = hyper
  source 1..73: mol_type = genomic DNA

SEQ ID NO: 48090 - DNA, 30 bp, Homo sapiens; identical to SEQ ID NO: 27185
  misc_feature 1..30: note = chr2:45166483-45166513
  misc_feature 1..30: note = hyper
  source 1..30: mol_type = genomic DNA

SEQ ID NO: 48091 - DNA, 93 bp, Homo sapiens; identical to SEQ ID NO: 27186
  misc_feature 1..93: note = chr2:45168959-45169052
  misc_feature 1..93: note = hyper
  source 1..93: mol_type = genomic DNA

SEQ ID NO: 48092 - DNA, 130 bp, Homo sapiens
  misc_feature 1..130: note = chr2:45169316-45169446
  misc_feature 1..130: note = hyper
  source 1..130: mol_type = genomic DNA
gctccatacttctggcgagtagcggcggcgggaacggtgcgggaggcggcggcggcgcgggaggcggcagcggcggcgggaacggtgcgggaggcggcggtgctggcggagcaggcggcggcggcggcgg

SEQ ID NO: 48093 - DNA, 94 bp, Homo sapiens; identical to SEQ ID NO: 17495
  misc_feature 1..94: note = chr2:45170029-45170123
  misc_feature 1..94: note = hyper
  source 1..94: mol_type = genomic DNA

SEQ ID NO: 48094 - DNA, 45 bp, Homo sapiens; identical to SEQ ID NO: 27189
  misc_feature 1..45: note = chr2:45170168-45170213
  misc_feature 1..45: note = hyper
  source 1..45: mol_type = genomic DNA

SEQ ID NO: 48095 - DNA, 139 bp, Homo sapiens
  misc_feature 1..139: note = chr2:45171246-45171385
  misc_feature 1..139: note = hyper
  source 1..139: mol_type = genomic DNA
tccccacttttccaccgccagctttcctattttctctaccctcggtcctgcgctctgcgctggcatccagagagcaaagtatgcagttctacccggagactggccgggcggtggggaacccgcagctcccggtgtgtgt

SEQ ID NO: 48096 - DNA, 62 bp, Homo sapiens
  misc_feature 1..62: note = chr2:45171862-45171924
  misc_feature 1..62: note = hyper
  source 1..62: mol_type = genomic DNA
ctcggtaacctccagcgactcggaatgtgatgtatgatagccaaggccgccctcctccctct

SEQ ID NO: 48097 - DNA, 264 bp, Homo sapiens; identical to SEQ ID NO: 27192
  misc_feature 1..264: note = chr2:45172185-45172449
  misc_feature 1..264: note = hyper
  source 1..264: mol_type = genomic DNA

SEQ ID NO: 48098 - skipped

SEQ ID NO: 48099 - DNA, 361 bp, Homo sapiens
  misc_feature 1..361: note = chr2:45176768-45177129
  misc_feature 1..361: note = hyper
  source 1..361: mol_type = genomic DNA
attcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacgcgcgctgaggcccccacggcttcccaccgctccggccctttccggccccagctgagctgaagctccctggccccagtgtgcgggccccggtggccgtctggcccgagggagggcgggggcaggcgaga

SEQ ID NO: 48100 - DNA, 324 bp, Homo sapiens
  misc_feature 1..324: note = chr2:45179296-45179620
  misc_feature 1..324: note = hyper
  source 1..324: mol_type = genomic DNA
aaggcagggtccagacgtgagggggagcgcggcggggcgtgggggacgcggcccccggggcaggggtccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccg

SEQ ID NO: 48101 - DNA, 289 bp, Homo sapiens; identical to SEQ ID NO: 17500
  misc_feature 1..289: note = chr2:45179650-45179939
  misc_feature 1..289: note = hyper
  source 1..289: mol_type = genomic DNA

SEQ ID NO: 48102 - DNA, 215 bp, Homo sapiens
  misc_feature 1..215: note = chr2:45181672-45181887
  misc_feature 1..215: note = hyper
  source 1..215: mol_type = genomic DNA
ggtctgtcggtggacgccgcgaaccaatcaaacccttgcactttgttccaaaacccattccctaccagaatgggagtcctgtagggccaggtctcctcccatacccacccatttcggcctttgttctactgcacaataacagctggcactggggtgcgggaggacggtgaaagctcgagtcccaggctccaaatcctccaggagtaactggggtg

SEQ ID NO: 48103 - DNA, 232 bp, Homo sapiens
  misc_feature 1..232: note = chr2:45182001-45182233
  misc_feature 1..232: note = hyper
  source 1..232: mol_type = genomic DNA
tcgcaggctctgcgaaacttcagtgcgcgcagcctcctgcacaccgttttcgcgcgacctccttgcctcggtctccaggggtcaagccaacccagcgcgggaatgttccatttgcccttttgggacattcagagaggcttttccgggctgccgcggcgcttccacgcagaggaggcgtcggcttccaggcagcttggcgatcttgttattggacacgcgagagtttagagac

SEQ ID NO: 48104 - DNA, 15 bp, Homo sapiens
  misc_feature 1..15: note = chr2:45231136-45231151
  misc_feature 1..15: note = hyper
  source 1..15: mol_type = genomic DNA
attctgattttatcc

SEQ ID NO: 48105 - DNA, 76 bp, Homo sapiens; identical to SEQ ID NO: 6149
  misc_feature 1..76: note = chr2:45231244-45231320
  misc_feature 1..76: note = hyper
  source 1..76: mol_type = genomic DNA

SEQ ID NO: 48106 - DNA, 62 bp, Homo sapiens
  misc_feature 1..62: note = chr2:45232131-45232193
  misc_feature 1..62: note = hyper
  source 1..62: mol_type = genomic DNA
aggaaaagggagggagctgtttcaggaatttcagtgccttcacctagcgactgacacaagtc

SEQ ID NO: 48107 - DNA, 30 bp, Homo sapiens; identical to SEQ ID NO: 27199
  misc_feature 1..30: note = chr2:45232401-45232431
  misc_feature 1..30: note = hyper
  source 1..30: mol_type = genomic DNA

SEQ ID NO: 48108 - DNA, 183 bp, Homo sapiens
  misc_feature 1..183: note = chr2:45233586-45233769
  misc_feature 1..183: note = hyper
  source 1..183: mol_type = genomic DNA
ggttgtggctgttagaattggagttctcgttgttctccctgcaagtgcgggagcaaagcagcggggtcagcagggacatcgagaccacccagcgccatctcagtcacagtcagagccagccaccagcctcgggagacagatcccgggcttgtggcctgcgggtgttttcggtttctaccattt

SEQ ID NO: 48109 - DNA, 119 bp, Homo sapiens
  misc_feature 1..119: note = chr2:45235475-45235594
  misc_feature 1..119: note = hyper
  source 1..119: mol_type = genomic DNA
ctgaattgctctgcccgctttagacaaatccctgctcgccgggtctccggcatagaaaggcctaagcatcgtccaagtcaggccgggctgccgctgggctgtggccgggcctgggggcc

SEQ ID NO: 48110 - DNA, 960 bp, Homo sapiens
  misc_feature 1..960: note = chr2:45235926-45236886
  misc_feature 1..960: note = hyper
  source 1..960: mol_type = genomic DNA
ttgcccacggcgcccaggggtcggccgcgcagcttctccgcctcgatgtagtgtgccttgagccacagctgctgcagcttggcgtggttgtgcggcgagaactggtggctctccaggatcttgtagagctcgcggaagttgccgcggtggaaggccaccacggccttggccttgagcacgctttcattcttgtgaaggtgctcgcaggcgggcagcgaccacaggaagcggcccagccgctcgatgttgccgccctgctgcagcacctcgcacacgcacgccacttgctcctgcgtgaagccgaaggtgggcagcatggacatggtgccggctgcgtccccgcccgcccgcgcgcgccctcaccgggccgcgcggtcccgcatgggagcttcctcgccgggccgtccgggccgagacgcgggcggggctggccccctggcccggcactggcccccggtgagccccgagtcactgccgtacgtccccgcgccggccgcgggtcccacgaagctccgaaccccaacggcccgcgcgcctggcccaagccctcgcccaagcccgggggccgcccggggcgccgctccgcatgctccgcgcccgcccgccgttccctcgctcgcttctcactcgttctccctcccgtctagctggctctcagctttcttaataatattattctaagcgggcatgaggcgcggcggcccgcgccctgattggtccggttatctgacccggggcctgccagcgccagacaatagtcggagtcaaattattcgccatggagacgctgtcagtcactggtaacccgagcctcggcgggccgggcggctccccccggccggctccgctgacagatcgccccgctccgcgcagaactgagggcggctctactggagcctggggcgctctgagagcctgggaggcggagaggggccgggttggggccggcggcggcggaga

SEQ ID NO: 48111 - DNA, 147 bp, Homo sapiens; identical to SEQ ID NO: 27202
  misc_feature 1..147: note = chr2:45237178-45237325
  misc_feature 1..147: note = hyper
  source 1..147: mol_type = genomic DNA

SEQ ID NO: 48112 - DNA, 28 bp, Homo sapiens
  misc_feature 1..28: note = chr2:45237645-45237673
  misc_feature 1..28: note = hyper
  source 1..28: mol_type = genomic DNA
gcagggactctaggacggtggtggggct

SEQ ID NO: 48113 - DNA, 148 bp, Homo sapiens
  misc_feature 1..148: note = chr2:45237795-45237943
  misc_feature 1..148: note = hyper
  source 1..148: mol_type = genomic DNA
tgaggtgctttaaaagggggtcctgttttttgcttctttgtcagggtgccaatggaaacatgtggtgctggtcctgtgggagaagggctcgcacaaaggtgggagaactgaggatgggtgtgttcttgctctacgttttgaaaagccc

SEQ ID NO: 48114 - DNA, 30 bp, Homo sapiens; identical to SEQ ID NO: 27205
  misc_feature 1..30: note = chr2:45240323-45240353
  misc_feature 1..30: note = hyper
  source 1..30: mol_type = genomic DNA

SEQ ID NO: 48115 - DNA, 352 bp, Homo sapiens; identical to SEQ ID NO: 17508
  misc_feature 1..352: note = chr2:45240784-45241136
  misc_feature 1..352: note = hyper
  source 1..352: mol_type = genomic DNA

SEQ ID NO: 48116 - DNA, 551 bp, Homo sapiens; identical to SEQ ID NO: 27208
  misc_feature 1..551: note = chr2:45241232-45241783
  misc_feature 1..551: note = hyper
  source 1..551: mol_type = genomic DNA

SEQ ID NO: 48117 - DNA, 155 bp, Homo sapiens; identical to SEQ ID NO: 17511
  misc_feature 1..155: note = chr2:45396160-45396315
  misc_feature 1..155: note = hyper
  source 1..155: mol_type = genomic DNA

SEQ ID NO: 48118 - DNA, 16 bp, Homo sapiens
  misc_feature 1..16: note = chr2:45396672-45396688
  misc_feature 1..16: note = hyper
  source 1..16: mol_type = genomic DNA
ccgccaccctctgggc

SEQ ID NO: 48119 - DNA, 33 bp, Homo sapiens; identical to SEQ ID NO: 6164
  misc_feature 1..33: note = chr2:45397223-45397256
  misc_feature 1..33: note = hyper
  source 1..33: mol_type = genomic DNA

SEQ ID NO: 48120 - DNA, 37 bp, Homo sapiens; identical to SEQ ID NO: 27213
  misc_feature 1..37: note = chr2:47596757-47596794
  misc_feature 1..37: note = hyper
  source 1..37: mol_type = genomic DNA

SEQ ID NO: 48121 - DNA, 29 bp, Homo sapiens
  misc_feature 1..29: note = chr2:47748494-47748523
  misc_feature 1..29: note = hyper
  source 1..29: mol_type = genomic DNA
ggaagttgcccaggcggtagagcccctgg

SEQ ID NO: 48122 - DNA, 40 bp, Homo sapiens; identical to SEQ ID NO: 27215
  misc_feature 1..40: note = chr2:47748726-47748766
  misc_feature 1..40: note = hyper
  source 1..40: mol_type = genomic DNA

SEQ ID NO: 48123 - DNA, 293 bp, Homo sapiens
  misc_feature 1..293: note = chr2:47796750-47797043
  misc_feature 1..293: note = hyper
  source 1..293: mol_type = genomic DNA
aaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggca

SEQ ID NO: 48124 - DNA, 145 bp, Homo sapiens; identical to SEQ ID NO: 17515
  misc_feature 1..145: note = chr2:47797818-47797963
  misc_feature 1..145: note = hyper
  source 1..145: mol_type = genomic DNA

SEQ ID NO: 48125 - DNA, 216 bp, Homo sapiens; identical to SEQ ID NO: 17516
  misc_feature 1..216: note = chr2:47797964-47798180
  misc_feature 1..216: note = hyper
  source 1..216: mol_type = genomic DNA

SEQ ID NO: 48126 - DNA, 291 bp, Homo sapiens; identical to SEQ ID NO: 17517
  misc_feature 1..291: note = chr2:47798663-47798954
  misc_feature 1..291: note = hyper
  source 1..291: mol_type = genomic DNA

SEQ ID NO: 48127 - DNA, 98 bp, Homo sapiens; identical to SEQ ID NO: 27219
  misc_feature 1..98: note = chr2:47799123-47799221
  misc_feature 1..98: note = hyper
  source 1..98: mol_type = genomic DNA

SEQ ID NO: 48128 - DNA, 32 bp, Homo sapiens
  misc_feature 1..32: note = chr2:48982866-48982898
  misc_feature 1..32: note = hyper
  source 1..32: mol_type = genomic DNA
gcccgcacccctctccccgccccttggctgcc

SEQ ID NO: 48129 - DNA, 111 bp, Homo sapiens
  misc_feature 1..111: note = chr2:50573484-50573595
  misc_feature 1..111: note = hyper
  source 1..111: mol_type = genomic DNA
cgccccatccggccactgagtgaccttctggcaactgacgcccccttcccgcggggcccagccgcgcgaccagggctggtcctttagtaggtgtccacatctctctcccag

SEQ ID NO: 48130 - DNA, 24 bp, Homo sapiens
  misc_feature 1..24: note = chr2:50574097-50574121
  misc_feature 1..24: note = hyper
  source 1..24: mol_type = genomic DNA
ccgccgaggggcagccgccgcggg

SEQ ID NO: 48131 - DNA, 57 bp, Homo sapiens; identical to SEQ ID NO: 27227
  misc_feature 1..57: note = chr2:51259509-51259566
  misc_feature 1..57: note = hyper
  source 1..57: mol_type = genomic DNA

SEQ ID NO: 48132 - DNA, 71 bp, Homo sapiens; identical to SEQ ID NO: 6177
  misc_feature 1..71: note = chr2:56149951-56150022
  misc_feature 1..71: note = hyper
  source 1..71: mol_type = genomic DNA

SEQ ID NO: 48133 - DNA, 206 bp, Homo sapiens; identical to SEQ ID NO: 27229
  misc_feature 1..206: note = chr2:56150227-56150433
  misc_feature 1..206: note = hyper
  source 1..206: mol_type = genomic DNA

SEQ ID NO: 48134 - DNA, 113 bp, Homo sapiens; identical to SEQ ID NO: 27231
  misc_feature 1..113: note = chr2:56411049-56411162
  misc_feature 1..113: note = hyper
  source 1..113: mol_type = genomic DNA

SEQ ID NO: 48135 - DNA, 33 bp, Homo sapiens; identical to SEQ ID NO: 17522
  misc_feature 1..33: note = chr2:56411733-56411766
  misc_feature 1..33: note = hyper
  source 1..33: mol_type = genomic DNA

SEQ ID NO: 48136 - DNA, 98 bp, Homo sapiens; identical to SEQ ID NO: 27233
  misc_feature 1..98: note = chr2:58655439-58655537
  misc_feature 1..98: note = hyper
  source 1..98: mol_type = genomic DNA

SEQ ID NO: 48137 - DNA, 51 bp, Homo sapiens; identical to SEQ ID NO: 17524
  misc_feature 1..51: note = chr2:58655998-58656049
  misc_feature 1..51: note = hyper
  source 1..51: mol_type = genomic DNA

SEQ ID NO: 48138 - DNA, 72 bp, Homo sapiens; identical to SEQ ID NO: 17525
  misc_feature 1..72: note = chr2:58656125-58656197
  misc_feature 1..72: note = hyper
  source 1..72: mol_type = genomic DNA

SEQ ID NO: 48139 - DNA, 39 bp, Homo sapiens; identical to SEQ ID NO: 27235
  misc_feature 1..39: note = chr2:60784424-60784463
  misc_feature 1..39: note = hyper
  source 1..39: mol_type = genomic DNA

SEQ ID NO: 48140 - DNA, 58 bp, Homo sapiens
  misc_feature 1..58: note = chr2:60796529-60796587
  misc_feature 1..58: note = hyper
  source 1..58: mol_type = genomic DNA
tgcattttgccttgccgcgtctcttcccacttccaacctacaccctctccaaatcttg

SEQ ID NO: 48141 - DNA, 20 bp, Homo sapiens
  misc_feature 1..20: note = chr2:60796669-60796689
  misc_feature 1..20: note = hyper
  source 1..20: mol_type = genomic DNA
acgcacgcacacacacactt

SEQ ID NO: 48142 - DNA, 99 bp, Homo sapiens
  misc_feature 1..99: note = chr2:60797038-60797137
  misc_feature 1..99: note = hyper
  source 1..99: mol_type = genomic DNA
tgtagtggaaatctacgtgggtttgcaggttcctgcttttcttgtgtagagcctccggtgccctccacctaaccctgccccaatgcctcgggtcttttt

SEQ ID NO: 48143 - DNA, 61 bp, Homo sapiens; identical to SEQ ID NO: 17527
  misc_feature 1..61: note = chr2:60797281-60797342
  misc_feature 1..61: note = hyper
  source 1..61: mol_type = genomic DNA

SEQ ID NO: 48144 - DNA, 294 bp, Homo sapiens; identical to SEQ ID NO: 27239
  misc_feature 1..294: note = chr2:60962755-60963049
  misc_feature 1..294: note = hyper
  source 1..294: mol_type = genomic DNA

SEQ ID NO: 48145 - DNA, 48 bp, Homo sapiens
  misc_feature 1..48: note = chr2:62798386-62798434
  misc_feature 1..48: note = hyper
  source 1..48: mol_type = genomic DNA
cgtgactcacccgtgtccctcgctctcagccatcggaacagcagaagc

SEQ ID NO: 48146 - DNA, 615 bp, Homo sapiens; identical to SEQ ID NO: 27241
  misc_feature 1..615: note = chr2:63275877-63276492
  misc_feature 1..615: note = hyper
  source 1..615: mol_type = genomic DNA

SEQ ID NO: 48147 - DNA, 259 bp, Homo sapiens
  misc_feature 1..259: note = chr2:63278703-63278962
  misc_feature 1..259: note = hyper
  source 1..259: mol_type = genomic DNA
gcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggcccc

SEQ ID NO: 48148 - DNA, 30 bp, Homo sapiens; identical to SEQ ID NO: 17533
  misc_feature 1..30: note = chr2:63278992-63279022
  misc_feature 1..30: note = hyper
  source 1..30: mol_type = genomic DNA

SEQ ID NO: 48149 - DNA, 66 bp, Homo sapiens; identical to SEQ ID NO: 27244
  misc_feature 1..66: note = chr2:63282650-63282716
  misc_feature 1..66: note = hyper
  source 1..66: mol_type = genomic DNA

SEQ ID NO: 48150 - DNA, 70 bp, Homo sapiens
  misc_feature 1..70: note = chr2:63283882-63283952
  misc_feature 1..70: note = hyper
  source 1..70: mol_type = genomic DNA
gcccattggagcacccgcacactactccaaatcaaaaccactaagagttcctcccgcgcagactgctgcc

SEQ ID NO: 48151 - DNA, 219 bp, Homo sapiens
  misc_feature 1..219: note = chr2:63284558-63284777
  misc_feature 1..219: note = hyper
  source 1..219: mol_type = genomic DNA
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccga

SEQ ID NO: 48152 - DNA, 270 bp, Homo sapiens
  misc_feature 1..270: note = chr2:63284811-63285081
  misc_feature 1..270: note = hyper
  source 1..270: mol_type = genomic DNA
tttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctgga

SEQ ID NO: 48153 - DNA, 143 bp, Homo sapiens; identical to SEQ ID NO: 27250
  misc_feature 1..143: note = chr2:64455493-64455636
  misc_feature 1..143: note = hyper
  source 1..143: mol_type = genomic DNA

SEQ ID NO: 48154 - DNA, 110 bp, Homo sapiens; identical to SEQ ID NO: 27251
  misc_feature 1..110: note = chr2:64836323-64836433
  misc_feature 1..110: note = hyper
  source 1..110: mol_type = genomic DNA

SEQ ID NO: 48155 - DNA, 163 bp, Homo sapiens; identical to SEQ ID NO: 6195
  misc_feature 1..163: note = chr2:64836470-64836633
  misc_feature 1..163: note = hyper
  source 1..163: mol_type = genomic DNA

SEQ ID NO: 48156 - skipped

SEQ ID NO: 48157 - DNA, 148 bp, Homo sapiens; identical to SEQ ID NO: 27254
  misc_feature 1..148: note = chr2:66653040-66653188
  misc_feature 1..148: note = hyper
  source 1..148: mol_type = genomic DNA

SEQ ID NO: 48158 - DNA, 268 bp, Homo sapiens
  misc_feature 1..268: note = chr2:66653496-66653764
  misc_feature 1..268: note = hyper
  source 1..268: mol_type = genomic DNA
gcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggat

SEQ ID NO: 48159 - DNA, 20 bp, Homo sapiens
  misc_feature 1..20: note = chr2:66653914-66653934
  misc_feature 1..20: note = hyper
  source 1..20: mol_type = genomic DNA
atcctgccgggacccccacc

SEQ ID NO: 48160 - DNA, 226 bp, Homo sapiens; identical to SEQ ID NO: 27256
  misc_feature 1..226: note = chr2:66659963-66660189
  misc_feature 1..226: note = hyper
  source 1..226: mol_type = genomic DNA

SEQ ID NO: 48161 - DNA, 47 bp, Homo sapiens; identical to SEQ ID NO: 17539
  misc_feature 1..47: note = chr2:66660603-66660650
  misc_feature 1..47: note = hyper
  source 1..47: mol_type = genomic DNA

SEQ ID NO: 48162 - DNA, 318 bp, Homo sapiens; identical to SEQ ID NO: 27258
  misc_feature 1..318: note = chr2:66802623-66802941
  misc_feature 1..318: note = hyper
  source 1..318: mol_type = genomic DNA

SEQ ID NO: 48163 - DNA, 157 bp, Homo sapiens; identical to SEQ ID NO: 27259
  misc_feature 1..157: note = chr2:66803441-66803598
  misc_feature 1..157: note = hyper
  source 1..157: mol_type = genomic DNA

SEQ ID NO: 48164 - DNA, 202 bp, Homo sapiens
  misc_feature 1..202: note = chr2:66809361-66809563
  misc_feature 1..202: note = hyper
  source 1..202: mol_type = genomic DNA
ctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtac

SEQ ID NO: 48165 - DNA, 75 bp, Homo sapiens; identical to SEQ ID NO: 17542
  misc_feature 1..75: note = chr2:68546249-68546324
  misc_feature 1..75: note = hyper
  source 1..75: mol_type = genomic DNA

SEQ ID NO: 48166 - DNA, 221 bp, Homo sapiens
  misc_feature 1..221: note = chr2:68546892-68547113
  misc_feature 1..221: note = hyper
  source 1..221: mol_type = genomic DNA
tgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcggg

SEQ ID NO: 48167 - DNA, 123 bp, Homo sapiens; identical to SEQ ID NO: 27264
  misc_feature 1..123: note = chr2:68870366-68870489
  misc_feature 1..123: note = hyper
  source 1..123: mol_type = genomic DNA

SEQ ID NO: 48168 - DNA, 292 bp, Homo sapiens; identical to SEQ ID NO: 27265
  misc_feature 1..292: note = chr2:68870746-68871038
  misc_feature 1..292: note = hyper
  source 1..292: mol_type = genomic DNA

SEQ ID NO: 48169 - DNA, 631 bp, Homo sapiens; identical to SEQ ID NO: 27266
  misc_feature 1..631: note = chr2:69240089-69240720
  misc_feature 1..631: note = hyper
  source 1..631: mol_type = genomic DNA

SEQ ID NO: 48170 - DNA, 40 bp, Homo sapiens; identical to SEQ ID NO: 27267
  misc_feature 1..40: note = chr2:69241225-69241265
  misc_feature 1..40: note = hyper
  source 1..40: mol_type = genomic DNA

SEQ ID NO: 48171 - DNA, 175 bp, Homo sapiens; identical to SEQ ID NO: 27268
  misc_feature 1..175: note = chr2:69533635-69533810
  misc_feature 1..175: note = hyper
  source 1..175: mol_type = genomic DNA

SEQ ID NO: 48172 - DNA, 57 bp, Homo sapiens; identical to SEQ ID NO: 27269
  misc_feature 1..57: note = chr2:70313348-70313405
  misc_feature 1..57: note = hyper
  source 1..57: mol_type = genomic DNA

SEQ ID NO: 48173 - DNA, 377 bp, Homo sapiens
  misc_feature 1..377: note = chr2:71503413-71503790
  misc_feature 1..377: note = hyper
  source 1..377: mol_type = genomic DNA
tctgtaaacagcaggcgaagaaattattagtcttaaaaaggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctg

SEQ ID NO: 48174 - DNA, 280 bp, Homo sapiens; identical to SEQ ID NO: 17549
  misc_feature 1..280: note = chr2:71503823-71504103
  misc_feature 1..280: note = hyper
  source 1..280: mol_type = genomic DNA

SEQ ID NO: 48175 - DNA, 174 bp, Homo sapiens
  misc_feature 1..174: note = chr2:71504148-71504322
  misc_feature 1..174: note = hyper
  source 1..174: mol_type = genomic DNA
ggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtcggtgaaatcgcttg

SEQ ID NO: 48176 - DNA, 149 bp, Homo sapiens
  misc_feature 1..149: note = chr2:71680684-71680833
  misc_feature 1..149: note = hyper
  source 1..149: mol_type = genomic DNA
tctcctgtccaagagcgagatctgggctacgccgggcgcccggagccctagtccagcccccggccatcgcggccgccgcccagccaggtgcaaaatgccgtgtcattgggagactccgcagccggagcattagattacagctcgacgga

SEQ ID NO: 48177 - DNA, 379 bp, Homo sapiens
  misc_feature 1..379: note = chr2:71680863-71681242
  misc_feature 1..379: note = hyper
  source 1..379: mol_type = genomic DNA
agcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggtaggaggggccgaccaccctcgccc

SEQ ID NO: 48178 - skipped

SEQ ID NO: 48179 - DNA, 43 bp, Homo sapiens; identical to SEQ ID NO: 27273
  misc_feature 1..43: note = chr2:71693820-71693863
  misc_feature 1..43: note = hyper
  source 1..43: mol_type = genomic DNA

SEQ ID NO: 48180 - DNA, 171 bp, Homo sapiens; identical to SEQ ID NO: 27274
  misc_feature 1..171: note = chr2:71694277-71694448
  misc_feature 1..171: note = hyper
  source 1..171: mol_type = genomic DNA

SEQ ID NO: 48181 - DNA, 30 bp, Homo sapiens; identical to SEQ ID NO: 27275
  misc_feature 1..30: note = chr2:72372207-72372237
  misc_feature 1..30: note = hyper
  source 1..30: mol_type = genomic DNA

SEQ ID NO: 48182 - DNA, 167 bp, Homo sapiens; identical to SEQ ID NO: 27276
  misc_feature 1..167: note = chr2:72372591-72372758
  misc_feature 1..167: note = hyper
  source 1..167: mol_type = genomic DNA

SEQ ID NO: 48183 - DNA, 127 bp, Homo sapiens; identical to SEQ ID NO: 6212
  misc_feature 1..127: note = chr2:72374563-72374690
  misc_feature 1..127: note = hyper
  source 1..127: mol_type = genomic DNA

SEQ ID NO: 48184 - DNA, 30 bp, Homo sapiens; identical to SEQ ID NO: 27279
  misc_feature 1..30: note = chr2:72375350-72375380
  misc_feature 1..30: note = hyper
  source 1..30: mol_type = genomic DNA

SEQ ID NO: 48185 - DNA, 30 bp, Homo sapiens; identical to SEQ ID NO: 27280
  misc_feature 1..30: note = chr2:72377270-72377300
  misc_feature 1..30: note = hyper
  source 1..30: mol_type = genomic DNA

SEQ ID NO: 48186 - DNA, 58 bp, Homo sapiens; identical to SEQ ID NO: 6214
  misc_feature 1..58: note = chr2:73142033-73142091
  misc_feature 1..58: note = hyper
  source 1..58: mol_type = genomic DNA

SEQ ID NO: 48187 - DNA, 30 bp, Homo sapiens; identical to SEQ ID NO: 27282
  misc_feature 1..30: note = chr2:73142786-73142816
  misc_feature 1..30: note = hyper
  source 1..30: mol_type = genomic DNA

SEQ ID NO: 48188 - DNA, 30 bp, Homo sapiens; identical to SEQ ID NO: 27283
  misc_feature 1..30: note = chr2:73143592-73143622
  misc_feature 1..30: note = hyper
  source 1..30: mol_type = genomic DNA

SEQ ID NO: 48189 - DNA, 30 bp, Homo sapiens; identical to SEQ ID NO: 6215
  misc_feature 1..30: note = chr2:73143902-73143932
  misc_feature 1..30: note = hyper
  source 1..30: mol_type = genomic DNA

SEQ ID NO: 48190 - DNA, 408 bp, Homo sapiens
  misc_feature 1..408: note = chr2:73145232-73145640
  misc_feature 1..408: note = hyper
  source 1..408: mol_type = genomic DNA
ctaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattcccagg

SEQ ID NO: 48191 - DNA, 230 bp, Homo sapiens
  misc_feature 1..230: note = chr2:73145694-73145924
  misc_feature 1..230: note = hyper
  source 1..230: mol_type = genomic DNA
caggaaagcaggtggagacctccaggcttttctagaaaatataccagttcggacgcaagcccaggcgcgtcctcggagcctgtgctggccctcgccacagcctgcccaattctctctcccagctgagccagtctcagaccagagtacaactcctcccgctctccctccgcccggcttaacctcgcaccacgcttctctcgcaagtccaccaccacctccgagacctcagc

SEQ ID NO: 48192 - DNA, 48 bp, Homo sapiens; identical to SEQ ID NO: 27286
  misc_feature 1..48: note = chr2:73146224-73146272
  misc_feature 1..48: note = hyper
  source 1..48: mol_type = genomic DNA

SEQ ID NO: 48193 - DNA, 157 bp, Homo sapiens
  misc_feature 1..157: note = chr2:73147167-73147324
  misc_feature 1..157: note = hyper
  source 1..157: mol_type = genomic DNA
aggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctgg

SEQ ID NO: 48194 - DNA, 17 bp, Homo sapiens
  misc_feature 1..17: note = chr2:73150907-73150924
  misc_feature 1..17: note = hyper
  source 1..17: mol_type = genomic DNA
gtgtgcctagcaccccg

SEQ ID NO: 48195 - DNA, 18 bp, Homo sapiens
  misc_feature 1..18: note = chr2:73151831-73151849
  misc_feature 1..18: note = hyper
  source 1..18: mol_type = genomic DNA
aagcgctaaagacctagc

SEQ ID NO: 48196 - DNA, 53 bp, Homo sapiens; identical to SEQ ID NO: 6222
  misc_feature 1..53: note = chr2:73152398-73152451
  misc_feature 1..53: note = hyper
  source 1..53: mol_type = genomic DNA

SEQ ID NO: 48197 - DNA, 241 bp, Homo sapiens
  misc_feature 1..241: note = chr2:73152754-73152995
  misc_feature 1..241: note = hyper
  source 1..241: mol_type = genomic DNA
accgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcagg

SEQ ID NO: 48198 - DNA, 168 bp, Homo sapiens
  misc_feature 1..168: note = chr2:73429355-73429523
  misc_feature 1..168: note = hyper
  source 1..168: mol_type = genomic DNA
caggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggt

SEQ ID NO: 48199 - DNA, 309 bp, Homo sapiens
  misc_feature 1..309: note = chr2:73429614-73429923
  misc_feature 1..309: note = hyper
  source 1..309: mol_type = genomic DNA
ggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccgga

SEQ ID NO: 48200 - DNA, 13 bp, Homo sapiens
  misc_feature 1..13: note = chr2:73430743-73430756
  misc_feature 1..13: note = hyper
  source 1..13: mol_type = genomic DNA
tgcatgcaatgct

SEQ ID NO: 48201 - DNA, 32 bp, Homo sapiens; identical to SEQ ID NO: 6228
  misc_feature 1..32: note = chr2:73512107-73512139
  misc_feature 1..32: note = hyper
  source 1..32: mol_type = genomic DNA

SEQ ID NO: 48202 - DNA, 187 bp, Homo sapiens; identical to SEQ ID NO: 17562
  misc_feature 1..187: note = chr2:73518261-73518448
  misc_feature 1..187: note = hyper
  source 1..187: mol_type = genomic DNA

SEQ ID NO: 48203 - DNA, 660 bp, Homo sapiens
  misc_feature 1..660: note = chr2:73518919-73519579
  misc_feature 1..660: note = hyper
  source 1..660: mol_type = genomic DNA
gcggccgcgggcagaagcagcgcgtgctgcatttgccgccgcggcgccccttgcgtcgcgccttggcctgggggaaaggggtgggcggcggcggcggcacgggtggtgcagccacgccactgcttccagggatgtccgccaccagaggtttagggaagtccgccgcggcggcgctgcgaaggcccagcggggaaagctgaggctgcgtactggccagaaactctccgccgtcgccgctactccctccctccccactaggaggggtcaggagcccagggaggccctcagccccctcccctaagtcacccggggccagcgggaaagcgtcataggccccgctgggatagagtctgttggctgggacggccggcagttccgcagggcagctgatggacagcaagtcctcaatcttggtccctattacgggaaaacgagcctccggggcggcctggtagtctccctgtgacccacagttccctggggcccccacagaaagcagctcccagggcgcgtagggacccttgaaggcagagacagcgtccagcgctggcgaggcgggaggcgcccggaggccgggcttgacgtcgggcggggagagctgaggctcatacaggcactgcgagggggcacccgcgcaaggcgaggcctcccagaacgcct

SEQ ID NO: 48204 - DNA, 26 bp, Homo sapiens
  misc_feature 1..26: note = chr2:73519841-73519867
  misc_feature 1..26: note = hyper
  source 1..26: mol_type = genomic DNA
gaagcaggagtcggctaagtccccac

SEQ ID NO: 48205 - DNA, 802 bp, Homo sapiens; identical to SEQ ID NO: 27300
  misc_feature 1..802: note = chr2:73520242-73521044
  misc_feature 1..802: note = hyper
  source 1..802: mol_type = genomic DNA

SEQ ID NO: 48206 - DNA, 35 bp, Homo sapiens; identical to SEQ ID NO: 27301
  misc_feature 1..35: note = chr2:74229462-74229497
  misc_feature 1..35: note = hyper
  source 1..35: mol_type = genomic DNA

SEQ ID NO: 48207 - DNA, 126 bp, Homo sapiens; identical to SEQ ID NO: 27302
  misc_feature 1..126: note = chr2:74230043-74230169
  misc_feature 1..126: note = hyper
  source 1..126: mol_type = genomic DNA

SEQ ID NO: 48208 - DNA, 44 bp, Homo sapiens; identical to SEQ ID NO: 6233
  misc_feature 1..44: note = chr2:74726199-74726243
  misc_feature 1..44: note = hyper
  source 1..44: mol_type = genomic DNA

SEQ ID NO: 48209 - DNA, 52 bp, Homo sapiens; identical to SEQ ID NO: 27305
  misc_feature 1..52: note = chr2:74730183-74730235
  misc_feature 1..52: note = hyper
  source 1..52: mol_type = genomic DNA

SEQ ID NO: 48210 - DNA, 30 bp, Homo sapiens; identical to SEQ ID NO: 27306
  misc_feature 1..30: note = chr2:74730614-74730644
  misc_feature 1..30: note = hyper
  source 1..30: mol_type = genomic DNA

SEQ ID NO: 48211 - DNA, 247 bp, Homo sapiens
  misc_feature 1..247: note = chr2:74740605-74740852
  misc_feature 1..247: note = hyper
  source 1..247: mol_type = genomic DNA
cacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactc

SEQ ID NO: 48212 - DNA, 448 bp, Homo sapiens
  misc_feature 1..448: note = chr2:74741387-74741835
  misc_feature 1..448: note = hyper
  source 1..448: mol_type = genomic DNA
ccatgctcgggcccctcccgcgctgagcctggctcctaacaccctggccccctgtccccctccccgcacatctccgccagccagccttccccctgcgcttggcgcaaacaggcgtcccttcccctttaactgctgggccccgcccctgccctacccccagcccccactacccacccgggccgatccgtcagtcactgccccagccggagctggccaaccctctccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctga

SEQ ID NO: 48213 - DNA, 196 bp, Homo sapiens
  misc_feature 1..196: note = chr2:74741955-74742151
  misc_feature 1..196: note = hyper
  source 1..196: mol_type = genomic DNA
cacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctc

SEQ ID NO: 48214 - DNA, 15 bp, Homo sapiens
  misc_feature 1..15: note = chr2:74743766-74743781
  misc_feature 1..15: note = hyper
  source 1..15: mol_type = genomic DNA
cgaagcaatagaggg

SEQ ID NO: 48215 - DNA, 135 bp, Homo sapiens
  misc_feature 1..135: note = chr2:74781946-74782081
  misc_feature 1..135: note = hyper
  source 1..135: mol_type = genomic DNA
ctggcgcatggatgccgaaccttatccgggctagtagtgggtgagagagcccagaaacagggagaggtgggcagcgggctggagagcggcgccgggagttggagagcctgtgactttcccgtgaagttgctttgc

SEQ ID NO: 48216 - DNA, 44 bp, Homo sapiens
  misc_feature 1..44: note = chr2:74782271-74782315
  misc_feature 1..44: note = hyper
  source 1..44: mol_type = genomic DNA
tctccctagaggtggaggaagacctgggccgtgctctacccggc

SEQ ID NO: 48217 - DNA, 80 bp, Homo sapiens; identical to SEQ ID NO: 27315
  misc_feature 1..80: note = chr2:75146976-75147056
  misc_feature 1..80: note = hyper
  source 1..80: mol_type = genomic DNA

SEQ ID NO: 48218 - DNA, 67 bp, Homo sapiens; identical to SEQ ID NO: 6243
  misc_feature 1..67: note = chr2:75426808-75426875
  misc_feature 1..67: note = hyper
  source 1..67: mol_type = genomic DNA

SEQ ID NO: 48219 - DNA, 405 bp, Homo sapiens
  misc_feature 1..405: note = chr2:75427525-75427930
  misc_feature 1..405: note = hyper
  source 1..405: mol_type = genomic DNA
cctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcg

SEQ ID NO: 48220 - DNA, 30 bp, Homo sapiens; identical to SEQ ID NO: 27318
  misc_feature 1..30: note = chr2:75428245-75428275
  misc_feature 1..30: note = hyper
  source 1..30: mol_type = genomic DNA

SEQ ID NO: 48221 - DNA, 157 bp, Homo sapiens; identical to SEQ ID NO: 27319
  misc_feature 1..157: note = chr2:75787200-75787357
  misc_feature 1..157: note = hyper
  source 1..157: mol_type = genomic DNA

SEQ ID NO: 48222 - DNA, 482 bp, Homo sapiens; identical to SEQ ID NO: 27320
  misc_feature 1..482: note = chr2:75787804-75788286
  misc_feature 1..482: note = hyper
  source 1..482: mol_type = genomic DNA

SEQ ID NO: 48223 - DNA, 15 bp, Homo sapiens
  misc_feature 1..15: note = chr2:75788330-75788345
  misc_feature 1..15: note = hyper
  source 1..15: mol_type = genomic DNA
cggtcctccaggctt

SEQ ID NO: 48224 - DNA, 166 bp, Homo sapiens; identical to SEQ ID NO: 27322
  misc_feature 1..166: note = chr2:79739850-79740016
  misc_feature 1..166: note = hyper
  source 1..166: mol_type = genomic DNA

SEQ ID NO: 48225 - DNA, 242 bp, Homo sapiens; identical to SEQ ID NO: 27323
  misc_feature 1..242: note = chr2:79740063-79740305
  misc_feature 1..242: note = hyper
  source 1..242: mol_type = genomic DNA

SEQ ID NO: 48226 - DNA, 79 bp, Homo sapiens
  misc_feature 1..79: note = chr2:80529299-80529378
  misc_feature 1..79: note = hyper
  source 1..79: mol_type = genomic DNA
cagcctggtgcccgccggcccgtcccggctgcccaggcgtatttggtagcgcatgggttgagagccactgggacaatca

SEQ ID NO: 48227 - DNA, 233 bp, Homo sapiens; identical to SEQ ID NO: 17576
  misc_feature 1..233: note = chr2:80530022-80530255
  misc_feature 1..233: note = hyper
  source 1..233: mol_type = genomic DNA

SEQ ID NO: 48228 - DNA, 72 bp, Homo sapiens; identical to SEQ ID NO: 27327
  misc_feature 1..72: note = chr2:80530256-80530328
  misc_feature 1..72: note = hyper
  source 1..72: mol_type = genomic DNA

SEQ ID NO: 48229 - DNA, 97 bp, Homo sapiens
  misc_feature 1..97: note = chr2:80530408-80530505
  misc_feature 1..97: note = hyper
  source 1..97: mol_type = genomic DNA
cgcacgggcacaaactggatggcgttggcccgcatatgcagcgtggtgagcttccgcagcccgtggaagaggtcgggcgcgagcgcctgcagcttgt

SEQ ID NO: 48230 - DNA, 29 bp, Homo sapiens
  misc_feature 1..29: note = chr2:80530558-80530587
  misc_feature 1..29: note = hyper
  source 1..29: mol_type = genomic DNA
ggcagttgggtgatctggttggaactcag

SEQ ID NO: 48231 - DNA, 397 bp, Homo sapiens
  misc_feature 1..397: note = chr2:80531328-80531725
  misc_feature 1..397: note = hyper
  source 1..397: mol_type = genomic DNA
taattatatgcagggcgagagaagacccctctgtgtttccgaggcagccccggtccgcggccggcggatctggcaggcgcacaatgtctcactttgctgctcggctcggggctgcaagggcggccggcaaggcggggaggcgacttctaggacccgcaagtttcccaactacgtgccggagcccgagcttcgccttcctgccgccttcctttccctctgcagttcggactgtgacgttgtggggggaaaaaactccaaactcggggctcgcgactccccaggatctgacagtctggttaatgtccgtcattggaaacgaccactgaccggcgccaccttttactccgcggaaacagcctgccattcgcgccccgggcagctgcagagagcgggctca

SEQ ID NO: 48232 - DNA, 258 bp, Homo sapiens
  misc_feature 1..258: note = chr2:80531755-80532013
  misc_feature 1..258: note = hyper
  source 1..258: mol_type = genomic DNA
ggcgggcggtggggaggtgcggacggcggcgcggggagcggcgagcggcgcccgggctccttccctccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttca

SEQ ID NO: 48233 - DNA, 14 bp, Homo sapiens
  misc_feature 1..14: note = chr2:80549571-80549585
  misc_feature 1..14: note = hyper
  source 1..14: mol_type = genomic DNA
cacaattcgggccc

SEQ ID NO: 48234 - DNA, 19 bp, Homo sapiens
  misc_feature 1..19: note = chr2:85107435-85107454
  misc_feature 1..19: note = hyper
  source 1..19: mol_type = genomic DNA
aacatctaaagcgcccggc

SEQ ID NO: 48235 - DNA, 114 bp, Homo sapiens
  misc_feature 1..114: note = chr2:85107538-85107652
  misc_feature 1..114: note = hyper
  source 1..114: mol_type = genomic DNA
tcccagatcggtaaaaacaagggaaatggcttcaactccctaaagtcccttctaactcaggcactgaacatatgaaggttaagccaagcagcttcagggcgctgttaatatttt

SEQ ID NO: 48236 - DNA, 401 bp, Homo sapiens; identical to SEQ ID NO: 27332
  misc_feature 1..401: note = chr2:85360051-85360452
  misc_feature 1..401: note = hyper
  source 1..401: mol_type = genomic DNA

SEQ ID NO: 48237 - DNA, 90 bp, Homo sapiens; identical to SEQ ID NO: 27333
  misc_feature 1..90: note = chr2:85360920-85361010
  misc_feature 1..90: note = hyper
  source 1..90: mol_type = genomic DNA

SEQ ID NO: 48238 - DNA, 15 bp, Homo sapiens
  misc_feature 1..15: note = chr2:85361295-85361310
  misc_feature 1..15: note = hyper
  source 1..15: mol_type = genomic DNA
cgcacccttgccctc

SEQ ID NO: 48239 - skipped

SEQ ID NO: 48240 - DNA, 238 bp, Homo sapiens
  misc_feature 1..238: note = chr2:87016636-87016874
  misc_feature 1..238: note = hyper
  source 1..238: mol_type = genomic DNA
gcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgc

SEQ ID NO: 48241 - DNA, 67 bp, Homo sapiens; identical to SEQ ID NO: 17584
  misc_feature 1..67: note = chr2:87017729-87017796
  misc_feature 1..67: note = hyper
  source 1..67: mol_type = genomic DNA

SEQ ID NO: 48242 - DNA, 367 bp, Homo sapiens; identical to SEQ ID NO: 27338
  misc_feature 1..367: note = chr2:87088683-87089050
  misc_feature 1..367: note = hyper
  source 1..367: mol_type = genomic DNA

SEQ ID NO: 48243 - DNA, 30 bp, Homo sapiens; identical to SEQ ID NO: 27339
  misc_feature 1..30: note = chr2:88469803-88469833
  misc_feature 1..30: note = hyper
  source 1..30: mol_type = genomic DNA

SEQ ID NO: 48244 - DNA, 16 bp, Homo sapiens
  misc_feature 1..16: note = chr2:88751800-88751816
  misc_feature 1..16: note = hyper
  source 1..16: mol_type = genomic DNA
ggggcggcggcggcgg

SEQ ID NO: 48245 - DNA, 113 bp, Homo sapiens; identical to SEQ ID NO: 17587
  misc_feature 1..113: note = chr2:88751942-88752055
  misc_feature 1..113: note = hyper
  source 1..113: mol_type = genomic DNA

SEQ ID NO: 48246 - DNA, 318 bp, Homo sapiens
  misc_feature 1..318: note = chr2:88752285-88752603
  misc_feature 1..318: note = hyper
  source 1..318: mol_type = genomic DNA
ggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctc

SEQ ID NO: 48247 - DNA, 50 bp, Homo sapiens
  misc_feature 1..50: note = chr2:88752785-88752835
  misc_feature 1..50: note = hyper
  source 1..50: mol_type = genomic DNA
agtttttctaaccaaactgtaggttcgctcacattcgggaagcatttatt

SEQ ID NO: 48248 - DNA, 38 bp, Homo sapiens; identical to SEQ ID NO: 27343
  misc_feature 1..38: note = chr2:88753098-88753136
  misc_feature 1..38: note = hyper
  source 1..38: mol_type = genomic DNA

SEQ ID NO: 48249 - DNA, 221 bp, Homo sapiens
  misc_feature 1..221: note = chr2:89065278-89065499
  misc_feature 1..221: note = hyper
  source 1..221: mol_type = genomic DNA
gctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctaca

SEQ ID NO: 48250 - DNA, 192 bp, Homo sapiens; identical to SEQ ID NO: 27346
  misc_feature 1..192: note = chr2:91635152-91635344
  misc_feature 1..192: note = hyper
  source 1..192: mol_type = genomic DNA

SEQ ID NO: 48251 - DNA, 118 bp, Homo sapiens
  misc_feature 1..118: note = chr2:95664014-95664132
  misc_feature 1..118: note = hyper
  source 1..118: mol_type = genomic DNA
cggccctcggtggggtcgactgggcggagccgccgcctcctatcttcccttgaaggcacctgcgcagggggacccgcggtgcctgggaggggagggggactttcgcatgaagcccctc

SEQ ID NO: 48252 - DNA, 243 bp, Homo sapiens
  misc_feature 1..243: note = chr2:95690793-95691036
  misc_feature 1..243: note = hyper
  source 1..243: mol_type = genomic DNA
ccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcac

SEQ ID NO: 48253 - DNA, 231 bp, Homo sapiens; identical to SEQ ID NO: 17593
  misc_feature 1..231: note = chr2:95691269-95691500
  misc_feature 1..231: note = hyper
  source 1..231: mol_type = genomic DNA

SEQ ID NO: 48254 - DNA, 29 bp, Homo sapiens
  misc_feature 1..29: note = chr2:95691501-95691530
  misc_feature 1..29: note = hyper
  source 1..29: mol_type = genomic DNA
ctcgtcccgtcccaaggccgacgccagca

SEQ ID NO: 48255 - DNA, 225 bp, Homo sapiens
  misc_feature 1..225: note = chr2:95691769-95691994
  misc_feature 1..225: note = hyper
  source 1..225: mol_type = genomic DNA
aagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgc

SEQ ID NO: 48256 - DNA, 98 bp, Homo sapiens; identical to SEQ ID NO: 27350
  misc_feature 1..98: note = chr2:95873425-95873523
  misc_feature 1..98: note = hyper
  source 1..98: mol_type = genomic DNA

SEQ ID NO: 48257 - DNA, 204 bp, Homo sapiens; identical to SEQ ID NO: 27351
  misc_feature 1..204: note = chr2:96012452-96012656
  misc_feature 1..204: note = hyper
  source 1..204: mol_type = genomic DNA

SEQ ID NO: 48258 - DNA, 41 bp, Homo sapiens; identical to SEQ ID NO: 27352
  misc_feature 1..41: note = chr2:96192504-96192545
  misc_feature 1..41: note = hyper
  source 1..41: mol_type = genomic DNA

SEQ ID NO: 48259 - DNA, 77 bp, Homo sapiens; identical to SEQ ID NO: 27353
  misc_feature 1..77: note = chr2:96781907-96781984
  misc_feature 1..77: note = hyper
  source 1..77: mol_type = genomic DNA

SEQ ID NO: 48260 - DNA, 196 bp, Homo sapiens; identical to SEQ ID NO: 27354
  misc_feature 1..196: note = chr2:96782022-96782218
  misc_feature 1..196: note = hyper
  source 1..196: mol_type = genomic DNA

SEQ ID NO: 48261 - DNA, 69 bp, Homo sapiens; identical to SEQ ID NO: 27355
  misc_feature 1..69: note = chr2:96987148-96987217
  misc_feature 1..69: note = hyper
  source 1..69: mol_type = genomic DNA

SEQ ID NO: 48262 - DNA, 17 bp, Homo sapiens
  misc_feature 1..17: note = chr2:96990881-96990898
  misc_feature 1..17: note = hyper
  source 1..17: mol_type = genomic DNA
agggaggccgagcagcg

SEQ ID NO: 48263 - DNA, 49 bp, Homo sapiens; identical to SEQ ID NO: 27357
  misc_feature 1..49: note = chr2:97193015-97193064
  misc_feature 1..49: note = hyper
  source 1..49: mol_type = genomic DNA

SEQ ID NO: 48264 - DNA, 26 bp, Homo sapiens
  misc_feature 1..26: note = chr2:97193626-97193652
  misc_feature 1..26: note = hyper
  source 1..26: mol_type = genomic DNA
aatcgccgttacgggaaaagtaaaac

SEQ ID NO: 48265 - DNA, 104 bp, Homo sapiens; identical to SEQ ID NO: 27359
  misc_feature 1..104: note = chr2:97203428-97203532
  misc_feature 1..104: note = hyper
  source 1..104: mol_type = genomic DNA

SEQ ID NO: 48266 - DNA, 206 bp, Homo sapiens
  misc_feature 1..206: note = chr2:98962692-98962898
  misc_feature 1..206: note = hyper
  source 1..206: mol_type = genomic DNA
ggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccggga

SEQ ID NO: 48267 - DNA, 227 bp, Homo sapiens; identical to SEQ ID NO: 17600
  misc_feature 1..227: note = chr2:98963599-98963826
  misc_feature 1..227: note = hyper
  source 1..227: mol_type = genomic DNA

SEQ ID NO: 48268 - DNA, 123 bp, Homo sapiens
  misc_feature 1..123: note = chr2:98964473-98964596
  misc_feature 1..123: note = hyper
  source 1..123: mol_type = genomic DNA
caactgggtcttctacgccagagtcccagttgtagaaaagtcggccaggtcagaggacccagatgggatttcactaagctggtgggagcttctttgcgttctttggggtagggggaaggacag

SEQ ID NO: 48269 - DNA, 73 bp, Homo sapiens; identical to SEQ ID NO: 17601
  misc_feature 1..73: note = chr2:98964645-98964718
  misc_feature 1..73: note = hyper
  source 1..73: mol_type = genomic DNA

SEQ ID NO: 48270 - DNA, 477 bp, Homo sapiens; identical to SEQ ID NO: 27366
  misc_feature 1..477: note = chr2:99552170-99552647
  misc_feature 1..477: note = hyper
  source 1..477: mol_type = genomic DNA

SEQ ID NO: 48271 - DNA, 74 bp, Homo sapiens; identical to SEQ ID NO: 27367
  misc_feature 1..74: note = chr2:99553081-99553155
  misc_feature 1..74: note = hyper
  source 1..74: mol_type = genomic DNA

SEQ ID NO: 48272 - DNA, 186 bp, Homo sapiens; identical to SEQ ID NO: 27369
  misc_feature 1..186: note = chr2:100720888-100721074
  misc_feature 1..186: note = hyper
  source 1..186: mol_type = genomic DNA

SEQ ID NO: 48273 - DNA, 30 bp, Homo sapiens; identical to SEQ ID NO: 27370
  misc_feature 1..30: note = chr2:100721292-100721322
  misc_feature 1..30: note = hyper
  source 1..30: mol_type = genomic DNA

SEQ ID NO: 48274 - DNA, 21 bp, Homo sapiens
  misc_feature 1..21: note = chr2:100939155-100939176
  misc_feature 1..21: note = hyper
  source 1..21: mol_type = genomic DNA
tagcttcgacttaggaaattg

SEQ ID NO: 48275 - DNA, 61 bp, Homo sapiens; identical to SEQ ID NO: 27376
  misc_feature 1..61: note = chr2:101033731-101033792
  misc_feature 1..61: note = hyper
  source 1..61: mol_type = genomic DNA

SEQ ID NO: 48276 - DNA, 244 bp, Homo sapiens
  misc_feature 1..244: note = chr2:101033998-101034242
  misc_feature 1..244: note = hyper
  source 1..244: mol_type = genomic DNA
ggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttc

SEQ ID NO: 48277 - DNA, 41 bp, Homo sapiens; identical to SEQ ID NO: 27378
  misc_feature 1..41: note = chr2:101436001-101436042
  misc_feature 1..41: note = hyper
  source 1..41: mol_type = genomic DNA

SEQ ID NO: 48278 - DNA, 159 bp, Homo sapiens; identical to SEQ ID NO: 27379
  misc_feature 1..159: note = chr2:102003995-102004154
  misc_feature 1..159: note = hyper
  source 1..159: mol_type = genomic DNA

SEQ ID NO: 48279 - DNA, 825 bp, Homo sapiens
  misc_feature 1..825: note = chr2:102090355-102091180
  misc_feature 1..825: note = hyper
  source 1..825: mol_type = genomic DNA
gcagggtccaaccaacgggtccccgcggggcagaccggatggctttccgcgggaagggtgacaacggggaagtcacagatgggaagcccggccccatcgccgattcgggcccggggcttttacgcgtgtgcgtgcatggcaggtccctccgcgctgcggcgggcgagcatcagaaagcgctgggcctggggccgctcctcacacccggctttgacccggcgtcccgagggcagccgtagcgggaaccacgcttcccctccccggccccacctcctccatcccagcgtcccaggcgcctggcggctcaccactggatgacgccgctgtgcgggccccggctaccctcgccgctcgacggcgaggccggcaccccctcggccatggctcggccccgggcctgcagcaccgaggcaggcagcgagcggcggccgtgggcggcgctgggttgcaccggtcctgctaccgccgctcctcggtgtttactttagaaaggagcgcgcggggggcgcgcggggcgcggggcgggagcccagtcctccaggcccgagcccgggggcgcggaaggcgcgcggcgagtacgggaggccacagctccccaacccccgcgccccgccgaggatgcgcggaccccgccctgcatcctgcggtgtgggctggagctgcctcccgctctcacccagcgcccttcccaccggcgtagcaaccagtcaaacagggacgcgaacaacaagcaccaacttacaccttttccaatctggtcgcggtgttgagtccgtgggtgtccttgacttgcttgagcgttggagttattcaggcagttttcaa

SEQ ID NO: 48280 - DNA, 37 bp, Homo sapiens; identical to SEQ ID NO: 27381
  misc_feature 1..37: note = chr2:103236062-103236099
  misc_feature 1..37: note = hyper
  source 1..37: mol_type = genomic DNA

SEQ ID NO: 48281 - DNA, 124 bp, Homo sapiens
  misc_feature 1..124: note = chr2:105458957-105459081
  misc_feature 1..124: note = hyper
  source 1..124: mol_type = genomic DNA
ttgggaagactcaggcgaaagagggagatgcccgtgtagagaaccgaggaggggggctggggtagaataatcagctctaaggttgcagatttagatctcaaggctgaaaaggataagcttccac

SEQ ID NO: 48282 - skipped

SEQ ID NO: 48283 - DNA, 114 bp, Homo sapiens
  misc_feature 1..114: note = chr2:105460951-105461065
  misc_feature 1..114: note = hyper
  source 1..114: mol_type = genomic DNA
tgctaaatgcagtggcgagaggagggagcagcgtctacatgaagcgaacttttcaagcgcagagccctgactcccaggcgcgggggctcaccgggaggggcccgggcgagagag

SEQ ID NO: 48284 - DNA, 24 bp, Homo sapiens
  misc_feature 1..24: note = chr2:105461163-105461187
  misc_feature 1..24: note = hyper
  source 1..24: mol_type = genomic DNA
cggccggtgggcagccctcgaccc

SEQ ID NO: 48285 - DNA, 171 bp, Homo sapiens
  misc_feature 1..171: note = chr2:105461243-105461414
  misc_feature 1..171: note = hyper
  source 1..171: mol_type = genomic DNA
ggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctg

SEQ ID NO: 48286 - skipped

SEQ ID NO: 48287 - DNA, 228 bp, Homo sapiens
  misc_feature 1..228: note = chr2:105468563-105468791
  misc_feature 1..228: note = hyper
  source 1..228: mol_type = genomic DNA
ttatatatacatatacgcatacgtaaatataaaaagcaacctttgggggccgcagaggaaaaaaatccgttctgtttggggtttggttaccaccgcctttggtatctataccttggcaataatggctttgctaaaacctacctacgatggtatctcacccggcaagcaggagctggacaagagcctacataaattctacgcgtctagtgttaatcttgagatcacgcg

SEQ ID NO: 48288 - DNA, 737 bp, Homo sapiens
  misc_feature 1..737: note = chr2:105468908-105469645
  misc_feature 1..737: note = hyper
  source 1..737: mol_type = genomic DNA
cggagcgcaccggcggccgctcctcggctgcgtcctgggctgccgctcgggctcgggactgccagatgcaggctctggctgggggcggcgggcgcaagcgggcgcacccgcagctaggggtgcggggtgcacgcacacgcacgctcattaagagccatgtatttattgaatgtccgagttgggttagttcattggaaatccccgaggagggctcaatttgcccttgttttcgttgccactttctcttttttcttggttcgctgaggttcctctgtgcagcgtttccgcttggccgcgtccccccaccccaccccaccccacccccgcttctctcgcctaccgggtgcactccccctcccatcccccttaactctttcagctgggttagagctgagaaagcatttgtcgccgccagccccatccaccacgcaaatccatctgagacagaaaggaaagaaaaaaaagcaccaccatgcctaagaatagagagcgagcaaacccccccaccgctaatcacacacacacacacacacacacacacacacacacacgaggaagcggtggagcagagaagggcgcggctagccgatcccggttctttcgcccggctcctgctgccacagggaattcctaaagccattggggtcgaatacacttacgatgaatctatgggggaaggtcggactgattgcttttcaaatacatcgcacggctccgctgaccggcaccctccaaac

SEQ ID NO: 48289 - DNA, 259 bp, Homo sapiens; identical to SEQ ID NO: 17614
  misc_feature 1..259: note = chr2:105470091-105470350
  misc_feature 1..259: note = hyper
  source 1..259: mol_type = genomic DNA

SEQ ID NO: 48290 - DNA, 127 bp, Homo sapiens
  misc_feature 1..127: note = chr2:105470840-105470967
  misc_feature 1..127: note = hyper
  source 1..127: mol_type = genomic DNA
acacacacacctccacctccaccaatgcactcttcttcctcctccttctccagacaactgctgggaaaaaaataaaacaccaaccccaaccgtcagcaacaaggtaacagagcgattcgacatcatt

SEQ ID NO: 48291 - DNA, 658 bp, Homo sapiens
  misc_feature 1..658: note = chr2:105471573-105472231
  misc_feature 1..658: note = hyper
  source 1..658: mol_type = genomic DNA
gccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgcagccgggggccgcggcggcggcggcggcggcgggggcggaggcggcggcggaggaggaggcggcgaaggcggcggggccggcgggggcccggggcgggggcggggaaggagggggggaggaggcgggaggcggggggcgcggcggcggcggcggcggcggcggccgcggctgctgctgcggcggcggcggcggtggtggcggcggtggggtggcgggagcggagcggcatggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcgg

SEQ ID NO: 48292 - DNA, 403 bp, Homo sapiens; identical to SEQ ID NO: 17617
  misc_feature 1..403: note = chr2:105472845-105473248
  misc_feature 1..403: note = hyper
  source 1..403: mol_type = genomic DNA

SEQ ID NO: 48293 - DNA, 215 bp, Homo sapiens; identical to SEQ ID NO: 6307
  misc_feature 1..215: note = chr2:105473599-105473814
  misc_feature 1..215: note = hyper
  source 1..215: mol_type = genomic DNA

SEQ ID NO: 48294 - DNA, 78 bp, Homo sapiens
  misc_feature 1..78: note = chr2:105478684-105478762
  misc_feature 1..78: note = hyper
  source 1..78: mol_type = genomic DNA
cgttcttgatgagtccggtcttcctcaaggaagagttggctctggaagtgacctcagaggggtctgggaagagggcaa

SEQ ID NO: 48295 - DNA, 13 bp, Homo sapiens
  misc_feature 1..13: note = chr2:105479089-105479102
  misc_feature 1..13: note = hyper
  source 1..13: mol_type = genomic DNA
gccagactgtggc

SEQ ID NO: 48296 - DNA, 210 bp, Homo sapiens; identical to SEQ ID NO: 27398
  misc_feature 1..210: note = chr2:105479657-105479867
  misc_feature 1..210: note = hyper
  source 1..210: mol_type = genomic DNA

SEQ ID NO: 48297 - DNA, 64 bp, Homo sapiens; identical to SEQ ID NO: 27399
  misc_feature 1..64: note = chr2:105483752-105483816
  misc_feature 1..64: note = hyper
  source 1..64: mol_type = genomic DNA

SEQ ID NO: 48298 - DNA, 236 bp, Homo sapiens; identical to SEQ ID NO: 27400
  misc_feature 1..236: note = chr2:105484041-105484277
  misc_feature 1..236: note = hyper
  source 1..236: mol_type = genomic DNA

SEQ ID NO: 48299 - DNA, 156 bp, Homo sapiens; identical to SEQ ID NO: 17620
  misc_feature 1..156: note = chr2:105488281-105488437
  misc_feature 1..156: note = hyper
  source 1..156: mol_type = genomic DNA

SEQ ID NO: 48300 - DNA, 686 bp, Homo sapiens; identical to SEQ ID NO: 27402
  misc_feature 1..686: note = chr2:105488548-105489234
  misc_feature 1..686: note = hyper
  source 1..686: mol_type = genomic DNA

SEQ ID NO: 48301 - DNA, 45 bp, Homo sapiens; identical to SEQ ID NO: 27403
  misc_feature 1..45: note = chr2:105489909-105489954
  misc_feature 1..45: note = hyper
  source 1..45: mol_type = genomic DNA

SEQ ID NO: 48302 - DNA, 81 bp, Homo sapiens; identical to SEQ ID NO: 27404
  misc_feature 1..81: note = chr2:105760590-105760671
  misc_feature 1..81: note = hyper
  source 1..81: mol_type = genomic DNA

SEQ ID NO: 48303 - DNA, 44 bp, Homo sapiens
  misc_feature 1..44: note = chr2:105760937-105760981
  misc_feature 1..44: note = hyper
  source 1..44: mol_type = genomic DNA
tctgggcagaggccacgcggggacggaggaggcagagaggacgg

SEQ ID NO: 48304 - DNA, 47 bp, Homo sapiens; identical to SEQ ID NO: 17623
  misc_feature 1..47: note = chr2:105761037-105761084
  misc_feature 1..47: note = hyper
  source 1..47: mol_type = genomic DNA

SEQ ID NO: 48305 - DNA, 171 bp, Homo sapiens; identical to SEQ ID NO: 27406
  misc_feature 1..171: note = chr2:106014945-106015116
  misc_feature 1..171: note = hyper
  source 1..171: mol_type = genomic DNA

SEQ ID NO: 48306 - skipped

SEQ ID NO: 48307 - DNA, 30 bp, Homo sapiens; identical to SEQ ID NO: 27409
  misc_feature 1..30: note = chr2:106682246-106682276
  misc_feature 1..30: note = hyper
  source 1..30: mol_type = genomic DNA

SEQ ID NO: 48308 - DNA, 47 bp, Homo sapiens
  misc_feature 1..47: note = chr2:107103818-107103865
  misc_feature 1..47: note = hyper
  source 1..47: mol_type = genomic DNA
cacccaccccagccgcgactgtctccgccgagcccccggggccaggt

SEQ ID NO: 48309 - DNA, 212 bp, Homo sapiens
  misc_feature 1..212: note = chr2:107103928-107104140
  misc_feature 1..212: note = hyper
  source 1..212: mol_type = genomic DNA
aggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttggcaggcagggtccctaagggtggaaataaaatacccccatatcgcattaccccgggggaccggagagcccctgac

SEQ ID NO: 48310 - DNA, 19 bp, Homo sapiens
  misc_feature 1..19: note = chr2:107502581-107502600
  misc_feature 1..19: note = hyper
  source 1..19: mol_type = genomic DNA
cgacaccgtggtgctcggt

SEQ ID NO: 48311 - DNA, 43 bp, Homo sapiens; identical to SEQ ID NO: 2030
  misc_feature 1..43: note = chr2:107502865-107502908
  misc_feature 1..43: note = hyper
  source 1..43: mol_type = genomic DNA

SEQ ID NO: 48312 - DNA, 111 bp, Homo sapiens
  misc_feature 1..111: note = chr2:107503421-107503532
  misc_feature 1..111: note = hyper
  source 1..111: mol_type = genomic DNA
cgaaggttacctgcacagtacccgcctggcaccgcgcctggacacctccggggcactcgggtcccgggcggcggcaggaatgcaggaatgcgcacaggctgtgggcggcca

SEQ ID NO: 48313 - DNA, 101 bp, Homo sapiens
  misc_feature 1..101: note = chr2:107503561-107503662
  misc_feature 1..101: note = hyper
  source 1..101: mol_type = genomic DNA
aagtgagtctttgtgtaccctgtccaacacctccccccgccagcgcggaaggccgggctacctgcgcgcctggcagcgcctggcagccggctgggtggggc

SEQ ID NO: 48314 - DNA, 221 bp, Homo sapiens
  misc_feature 1..221: note = chr2:107503663-107503884
  misc_feature 1..221: note = hyper
  source 1..221: mol_type = genomic DNA
caggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccc

SEQ ID NO: 48315 - DNA, 30 bp, Homo sapiens; identical to SEQ ID NO: 27415
  misc_feature 1..30: note = chr2:108602866-108602896
  misc_feature 1..30: note = hyper
  source 1..30: mol_type = genomic DNA

SEQ ID NO: 48316 - DNA, 114 bp, Homo sapiens; identical to SEQ ID NO: 27416
  misc_feature 1..114: note = chr2:108603211-108603325
  misc_feature 1..114: note = hyper
  source 1..114: mol_type = genomic DNA

SEQ ID NO: 48317 - DNA, 41 bp, Homo sapiens
  misc_feature 1..41: note = chr2:109648039-109648080
  misc_feature 1..41: note = hyper
  source 1..41: mol_type = genomic DNA
gtgcggcgaggagggcgcagtgaagttctgctgtgtgcacc

SEQ ID NO: 48318 - DNA, 51 bp, Homo sapiens; identical to SEQ ID NO: 17630
  misc_feature 1..51: note = chr2:109648222-109648273
  misc_feature 1..51: note = hyper
  source 1..51: mol_type = genomic DNA

SEQ ID NO: 48319 - DNA, 30 bp, Homo sapiens; identical to SEQ ID NO: 6319
  misc_feature 1..30: note = chr2:109744973-109745003
  misc_feature 1..30: note = hyper
  source 1..30: mol_type = genomic DNA

SEQ ID NO: 48320 - DNA, 755 bp, Homo sapiens
  misc_feature 1..755: note = chr2:109745234-109745989
  misc_feature 1..755: note = hyper
  source 1..755: mol_type = genomic DNA
aggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgc

SEQ ID NO: 48321 - DNA, 210 bp, Homo sapiens
  misc_feature 1..210: note = chr2:109746079-109746289
  misc_feature 1..210: note = hyper
  source 1..210: mol_type = genomic DNA
cgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccg

SEQ ID NO: 48322 - DNA, 24 bp, Homo sapiens
  misc_feature 1..24: note = chr2:109746477-109746501
  misc_feature 1..24: note = hyper
  source 1..24: mol_type = genomic DNA
cgggttccccggttttcctctccg

SEQ ID NO: 48323 - DNA, 69 bp, Homo sapiens; identical to SEQ ID NO: 27421
  misc_feature 1..69: note = chr2:110371731-110371800
  misc_feature 1..69: note = hyper
  source 1..69: mol_type = genomic DNA

SEQ ID NO: 48324 - DNA, 119 bp, Homo sapiens; identical to SEQ ID NO: 27422
  misc_feature 1..119: note = chr2:111490570-111490689
  misc_feature 1..119: note = hyper
  source 1..119: mol_type = genomic DNA

SEQ ID NO: 48325 - DNA, 434 bp, Homo sapiens
  misc_feature 1..434: note = chr2:112656599-112657033
  misc_feature 1..434: note = hyper
  source 1..434: mol_type = genomic DNA
gcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaac

SEQ ID NO: 48326 - DNA, 53 bp, Homo sapiens; identical to SEQ ID NO: 27425
  misc_feature 1..53: note = chr2:113190973-113191026
  misc_feature 1..53: note = hyper
  source 1..53: mol_type = genomic DNA

SEQ ID NO: 48327 - DNA, 38 bp, Homo sapiens
  misc_feature 1..38: note = chr2:114256940-114256978
  misc_feature 1..38: note = hyper
  source 1..38: mol_type = genomic DNA
agacgaggtggaagacgaggaggaggaggcgagccaga

SEQ ID NO: 48328 - DNA, 51 bp, Homo sapiens; identical to SEQ ID NO: 17637
  misc_feature 1..51: note = chr2:114257137-114257188
  misc_feature 1..51: note = hyper
  source 1..51: mol_type = genomic DNA

SEQ ID NO: 48329 - DNA, 301 bp, Homo sapiens
  misc_feature 1..301: note = chr2:114260999-114261300
  misc_feature 1..301: note = hyper
  source 1..301: mol_type = genomic DNA
tcctcccggcctctgcgccaccgcccccggtgcaggacgcgctttgctctcgccgagacccagacgcgctgaaagcctcgcgcgggcagttccccgccccacgccccgggctgcgcgttctcccgcaaagcctctgccgagtgcgcgcaacggcgccgccggactccccgggaccgcgctcccgcgcacgcctgaccggagcaccccgcttcacgggggcgttctgcgcgtccttcctccccggtgcgatttccattctttttcctctcgcggtccccaggagcccaggcacccctcgact

SEQ ID NO: 48330 - DNA, 19 bp, Homo sapiens
  misc_feature 1..19: note = chr2:114261458-114261477
  misc_feature 1..19: note = hyper
  source 1..19: mol_type = genomic DNA
tgcccgggaagctgggctg

SEQ ID NO: 48331 - DNA, 78 bp, Homo sapiens
  misc_feature 1..78: note = chr2:115920534-115920612
  misc_feature 1..78: note = hyper
  source 1..78: mol_type = genomic DNA
aggtgcgctcacgtttgcatcaattaggaactccgggcagagagagctgcacttaggtcagggattaactgtggaccc

SEQ ID NO: 48332 - DNA, 57 bp, Homo sapiens; identical to SEQ ID NO: 27432
  misc_feature 1..57: note = chr2:115920613-115920670
  misc_feature 1..57: note = hyper
  source 1..57: mol_type = genomic DNA

SEQ ID NO: 48333 - DNA, 25 bp, Homo sapiens
  misc_feature 1..25: note = chr2:118982497-118982522
  misc_feature 1..25: note = hyper
  source 1..25: mol_type = genomic DNA
aaaagtcattcgtgatctttgggta

SEQ ID NO: 48334 - DNA, 77 bp, Homo sapiens
  misc_feature 1..77: note = chr2:119068049-119068126
  misc_feature 1..77: note = hyper
  source 1..77: mol_type = genomic DNA
ccccccaccggccccctcccgggctcccctccccggtaaacagaaaagaaaacttctgtgggcgaaggagggagaaa

SEQ ID NO: 48335 - DNA, 78 bp, Homo sapiens
  misc_feature 1..78: note = chr2:119532083-119532161
  misc_feature 1..78: note = hyper
  source 1..78: mol_type = genomic DNA
tgaaagcctcagtagcggacccggccgggaaaggcggagccgacagctgtcgcggggcggggcttccagggccgggag

SEQ ID NO: 48336 - DNA, 73 bp, Homo sapiens
  misc_feature 1..73: note = chr2:119532255-119532328
  misc_feature 1..73: note = hyper
  source 1..73: mol_type = genomic DNA
tcgctctgactcctattgcggtgggatgtggtctctgagtctccgtttaccgattttacggaatggaacttat

SEQ ID NO: 48337 - DNA, 68 bp, Homo sapiens
  misc_feature 1..68: note = chr2:119566171-119566239
  misc_feature 1..68: note = hyper
  source 1..68: mol_type = genomic DNA
tcgcagcaaagggcccgggctgggtgttgccgagcggtcctcggctccccggtggaccatgcccctcc

SEQ ID NO: 48338 - DNA, 578 bp, Homo sapiens
  misc_feature 1..578: note = chr2:119590773-119591351
  misc_feature 1..578: note = hyper
  source 1..578: mol_type = genomic DNA
gatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaaggg

SEQ ID NO: 48339 - DNA, 15 bp, Homo sapiens
  misc_feature 1..15: note = chr2:119591658-119591673
  misc_feature 1..15: note = hyper
  source 1..15: mol_type = genomic DNA
cgccgcccgggaccc

SEQ ID NO: 48340 - DNA, 396 bp, Homo sapiens
  misc_feature 1..396: note = chr2:119593567-119593963
  misc_feature 1..396: note = hyper
  source 1..396: mol_type = genomic DNA
tttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 48341 - DNA, 30 bp, Homo sapiens; identical to SEQ ID NO: 27443
  misc_feature 1..30: note = chr2:119594194-119594224
  misc_feature 1..30: note = hyper
  source 1..30: mol_type = genomic DNA

SEQ ID NO: 48342 - DNA, 30 bp, Homo sapiens; identical to SEQ ID NO: 27444
  misc_feature 1..30: note = chr2:119594750-119594780
  misc_feature 1..30: note = hyper
  source 1..30: mol_type = genomic DNA

SEQ ID NO: 48343 - DNA, 31 bp, Homo sapiens
  misc_feature 1..31: note = chr2:119599895-119599926
  misc_feature 1..31: note = hyper
  source 1..31: mol_type = genomic DNA
ccgacagaagggacccgggaggtgggggaga

SEQ ID NO: 48344 - DNA, 301 bp, Homo sapiens
  misc_feature 1..301: note = chr2:119600031-119600332
  misc_feature 1..301: note = hyper
  source 1..301: mol_type = genomic DNA
attcaaatgaaaaaggcaacgaaaacgaaactgggcgggggcagcgaggcggtgggggaggggataaaataattataataattataataattataacaataataataaaggagattaataaaaatgtccagcaaatagagatcgctacacgtatgtgttttccttacctgaaattaaatatatacaaggtcgtaagcggtttggctagatagagctttaaggagttcgcagtttcgtcccttatactgggaatagagaatggatcttatttttcgatagcacctgtccgagtctttctccc

SEQ ID NO: 48345 - DNA, 15 bp, Homo sapiens
  misc_feature 1..15: note = chr2:119600555-119600570
  misc_feature 1..15: note = hyper
  source 1..15: mol_type = genomic DNA
gttgtacagtccctg

SEQ ID NO: 48346 - DNA, 117 bp, Homo sapiens
  misc_feature 1..117: note = chr2:119600747-119600864
  misc_feature 1..117: note = hyper
  source 1..117: mol_type = genomic DNA
cagctgctcggccgtgaacgcggtccgcggccgcttgtcctccttctcgttcttcttcttcttcagcttcctggtgcgcggacctgcagcggcggagagggccggggtggggtgggg

SEQ ID NO: 48347 - DNA, 25 bp, Homo sapiens
  misc_feature 1..25: note = chr2:119603086-119603111
  misc_feature 1..25: note = hyper
  source 1..25: mol_type = genomic DNA
aagcgccgcgcggggaggatgcggg

SEQ ID NO: 48348 - DNA, 30 bp, Homo sapiens; identical to SEQ ID NO: 27448
  misc_feature 1..30: note = chr2:119603388-119603418
  misc_feature 1..30: note = hyper
  source 1..30: mol_type = genomic DNA

SEQ ID NO: 48349 - DNA, 215 bp, Homo sapiens
  misc_feature 1..215: note = chr2:119603817-119604032
  misc_feature 1..215: note = hyper
  source 1..215: mol_type = genomic DNA
cttggcgttctggggcggtccgcggggccagaaggcatggcgcagcccggagttgggtactcaccggaggatggacgatccgaataacgtgtgcagtacacccaggcgggccatacgagaggctgctgcgagtcagttttgaccacgggcccgccgttggctgagcccataagtaggatagccgggttgccgtgctccgggtatttggtgccctg

SEQ ID NO: 48350 - DNA, 522 bp, Homo sapiens
  misc_feature 1..522: note = chr2:119604158-119604680
  misc_feature 1..522: note = hyper
  source 1..522: mol_type = genomic DNA
agctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 48351 - DNA, 120 bp, Homo sapiens; identical to SEQ ID NO: 17649
  misc_feature 1..120: note = chr2:119604689-119604809
  misc_feature 1..120: note = hyper
  source 1..120: mol_type = genomic DNA

SEQ ID NO: 48352 - DNA, 30 bp, Homo sapiens; identical to SEQ ID NO: 27452
  misc_feature 1..30: note = chr2:119605356-119605386
  misc_feature 1..30: note = hyper
  source 1..30: mol_type = genomic DNA

SEQ ID NO: 48353 - DNA, 30 bp, Homo sapiens; identical to SEQ ID NO: 27453
  misc_feature 1..30: note = chr2:119605745-119605775
  misc_feature 1..30: note = hyper
  source 1..30: mol_type = genomic DNA

SEQ ID NO: 48354 - DNA, 103 bp, Homo sapiens
  misc_feature 1..103: note = chr2:119606839-119606942
  misc_feature 1..103: note = hyper
  source 1..103: mol_type = genomic DNA
agagaaaggatccctttggaaatattgtctatttgtgacatgcgaaagaatccccctacctccagttttccagaaaagtcacagagggttaggctaggaggaa

SEQ ID NO: 48355 - DNA, 182 bp, Homo sapiens; identical to SEQ ID NO: 2039
  misc_feature 1..182: note = chr2:119607442-119607624
  misc_feature 1..182: note = hyper
  source 1..182: mol_type = genomic DNA

SEQ ID NO: 48356 - DNA, 15 bp, Homo sapiens
  misc_feature 1..15: note = chr2:119607847-119607862
  misc_feature 1..15: note = hyper
  source 1..15: mol_type = genomic DNA
cgtccccccacctcc

SEQ ID NO: 48357 - DNA, 139 bp, Homo sapiens; identical to SEQ ID NO: 27457
  misc_feature 1..139: note = chr2:119610236-119610375
  misc_feature 1..139: note = hyper
  source 1..139: mol_type = genomic DNA

SEQ ID NO: 48358 - DNA, 79 bp, Homo sapiens; identical to SEQ ID NO: 27458
  misc_feature 1..79: note = chr2:119610540-119610619
  misc_feature 1..79: note = hyper
  source 1..79: mol_type = genomic DNA

SEQ ID NO: 48359 - DNA, 179 bp, Homo sapiens
  misc_feature 1..179: note = chr2:119611566-119611745
  misc_feature 1..179: note = hyper
  source 1..179: mol_type = genomic DNA
ctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcaga

SEQ ID NO: 48360 - DNA, 59 bp, Homo sapiens; identical to SEQ ID NO: 27461
  misc_feature 1..59: note = chr2:119612755-119612814
  misc_feature 1..59: note = hyper
  source 1..59: mol_type = genomic DNA

SEQ ID NO: 48361 - DNA, 738 bp, Homo sapiens; identical to SEQ ID NO: 27462
  misc_feature 1..738: note = chr2:119613153-119613891
  misc_feature 1..738: note = hyper
  source 1..738: mol_type = genomic DNA

SEQ ID NO: 48362 - DNA, 178 bp, Homo sapiens
  misc_feature 1..178: note = chr2:119614602-119614780
  misc_feature 1..178: note = hyper
  source 1..178: mol_type = genomic DNA
cgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactg

SEQ ID NO: 48363 - DNA, 203 bp, Homo sapiens; identical to SEQ ID NO: 17656
  misc_feature 1..203: note = chr2:119614852-119615055
  misc_feature 1..203: note = hyper
  source 1..203: mol_type = genomic DNA

SEQ ID NO: 48364 - DNA, 180 bp, Homo sapiens
  misc_feature 1..180: note = chr2:119615975-119616155
  misc_feature 1..180: note = hyper
  source 1..180: mol_type = genomic DNA
catgcccataccaagcgggaaacgaagcaccgaatatttccccagctcgtaggaagccagatgggggccagttccctcaggagacgctccaagtcgccctgcgggctccaggtggggacaggagttataaccttccctgcccttccccctgcaacacacgcgaggtctcagcgctcccag

SEQ ID NO: 48365 - DNA, 150 bp, Homo sapiens; identical to SEQ ID NO: 6359
  misc_feature 1..150: note = chr2:119769161-119769311
  misc_feature 1..150: note = hyper
  source 1..150: mol_type = genomic DNA

SEQ ID NO: 48366 - DNA, 40 bp, Homo sapiens; identical to SEQ ID NO: 27467
  misc_feature 1..40: note = chr2:119914013-119914053
  misc_feature 1..40: note = hyper
  source 1..40: mol_type = genomic DNA

SEQ ID NO: 48367 - DNA, 191 bp, Homo sapiens
  misc_feature 1..191: note = chr2:119914529-119914720
  misc_feature 1..191: note = hyper
  source 1..191: mol_type = genomic DNA
cgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccag

SEQ ID NO: 48368 - DNA, 147 bp, Homo sapiens
  misc_feature 1..147: note = chr2:119914752-119914899
  misc_feature 1..147: note = hyper
  source 1..147: mol_type = genomic DNA
gaaatagggagaggggaagcttcatgaacactgacccagagtggaagggtgggagccaggggccagggccaagaggaaaggaggctgcagggcaagggggcgacctggagagaactaaagaactgaggtttccgagaagcccacgga

SEQ ID NO: 48369 - DNA, 456 bp, Homo sapiens; identical to SEQ ID NO: 27469
  misc_feature 1..456: note = chr2:119915151-119915607
  misc_feature 1..456: note = hyper
  source 1..456: mol_type = genomic DNA

SEQ ID NO: 48370 - DNA, 337 bp, Homo sapiens; identical to SEQ ID NO: 27471
  misc_feature 1..337: note = chr2:120190015-120190352
  misc_feature 1..337: note = hyper
  source 1..337: mol_type = genomic DNA

SEQ ID NO: 48371 - DNA, 120 bp, Homo sapiens
  misc_feature 1..120: note = chr2:120281693-120281813
  misc_feature 1..120: note = hyper
  source 1..120: mol_type = genomic DNA
ctcgggtccccagcctgcagaagggcgcagtactcaccgagtgcgcggcgcaggcgagcagcaccggcagtagtagctgctgcagcggcggcgacaggtggggacgcatggtgcccgcac

SEQ ID NO: 48372 - DNA, 87 bp, Homo sapiens; identical to SEQ ID NO: 27473
  misc_feature 1..87: note = chr2:120281814-120281901
  misc_feature 1..87: note = hyper
  source 1..87: mol_type = genomic DNA

SEQ ID NO: 48373 - DNA, 36 bp, Homo sapiens; identical to SEQ ID NO: 27474
  misc_feature 1..36: note = chr2:121103048-121103084
  misc_feature 1..36: note = hyper
  source 1..36: mol_type = genomic DNA

SEQ ID NO: 48374 - DNA, 47 bp, Homo sapiens; identical to SEQ ID NO: 27475
  misc_feature 1..47: note = chr2:121103883-121103930
  misc_feature 1..47: note = hyper
  source 1..47: mol_type = genomic DNA

SEQ ID NO: 48375 - DNA, 394 bp, Homo sapiens; identical to SEQ ID NO: 27476
  misc_feature 1..394: note = chr2:121104242-121104636
  misc_feature 1..394: note = hyper
  source 1..394: mol_type = genomic DNA

SEQ ID NO: 48376 - DNA, 514 bp, Homo sapiens; identical to SEQ ID NO: 27477
  misc_feature 1..514: note = chr2:121104696-121105210
  misc_feature 1..514: note = hyper
  source 1..514: mol_type = genomic DNA

SEQ ID NO: 48377 - DNA, 46 bp, Homo sapiens; identical to SEQ ID NO: 27478
  misc_feature 1..46: note = chr2:121200039-121200085
  misc_feature 1..46: note = hyper
  source 1..46: mol_type = genomic DNA

SEQ ID NO: 48378 - DNA, 180 bp, Homo sapiens; identical to SEQ ID NO: 27480
  misc_feature 1..180: note = chr2:121344837-121345017
  misc_feature 1..180: note = hyper
  source 1..180: mol_type = genomic DNA

SEQ ID NO: 48379 - DNA, 36 bp, Homo sapiens; identical to SEQ ID NO: 27481
  misc_feature 1..36: note = chr2:121412155-121412191
  misc_feature 1..36: note = hyper
  source 1..36: mol_type = genomic DNA

SEQ ID NO: 48380 - DNA, 498 bp, Homo sapiens; identical to SEQ ID NO: 27482
  misc_feature 1..498: note = chr2:121493449-121493947
  misc_feature 1..498: note = hyper
  source 1..498: mol_type = genomic DNA

SEQ ID NO: 48381 - DNA, 88 bp, Homo sapiens; identical to SEQ ID NO: 27483
  misc_feature 1..88: note = chr2:121494156-121494244
  misc_feature 1..88: note = hyper
  source 1..88: mol_type = genomic DNA

SEQ ID NO: 48382 - DNA, 30 bp, Homo sapiens; identical to SEQ ID NO: 27484
  misc_feature 1..30: note = chr2:121494978-121495008
  misc_feature 1..30: note = hyper
  source 1..30: mol_type = genomic DNA

SEQ ID NO: 48383 - DNA, 44 bp, Homo sapiens; identical to SEQ ID NO: 27485
  misc_feature 1..44: note = chr2:122042116-122042160
  misc_feature 1..44: note = hyper
  source 1..44: mol_type = genomic DNA

SEQ ID NO: 48384 - DNA, 30 bp, Homo sapiens; identical to SEQ ID NO: 27486
  misc_feature 1..30: note = chr2:122042918-122042948
  misc_feature 1..30: note = hyper
  source 1..30: mol_type = genomic DNA

SEQ ID NO: 48385 - DNA, 234 bp, Homo sapiens
  misc_feature 1..234: note = chr2:124782458-124782692
  misc_feature 1..234: note = hyper
  source 1..234: mol_type = genomic DNA
gttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccct

SEQ ID NO: 48386 - DNA, 308 bp, Homo sapiens
  misc_feature 1..308: note = chr2:124783097-124783405
  misc_feature 1..308: note = hyper
  source 1..308: mol_type = genomic DNA
gagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 48387 - DNA, 30 bp, Homo sapiens; identical to SEQ ID NO: 27488
  misc_feature 1..30: note = chr2:127534517-127534547
  misc_feature 1..30: note = hyper
  source 1..30: mol_type = genomic DNA

SEQ ID NO: 48388 - DNA, 39 bp, Homo sapiens; identical to SEQ ID NO: 27489
  misc_feature 1..39: note = chr2:127534774-127534813
  misc_feature 1..39: note = hyper
  source 1..39: mol_type = genomic DNA

SEQ ID NO: 48389 - DNA, 121 bp, Homo sapiens; identical to SEQ ID NO: 27490
  misc_feature 1..121: note = chr2:127643980-127644101
  misc_feature 1..121: note = hyper
  source 1..121: mol_type = genomic DNA

SEQ ID NO: 48390 - DNA, 324 bp, Homo sapiens; identical to SEQ ID NO: 17669
  misc_feature 1..324: note = chr2:127783257-127783581
  misc_feature 1..324: note = hyper
  source 1..324: mol_type = genomic DNA

SEQ ID NO: 48391 - DNA, 113 bp, Homo sapiens
  misc_feature 1..113: note = chr2:127863488-127863601
  misc_feature 1..113: note = hyper
  source 1..113: mol_type = genomic DNA
ggcgtcagcagctggcgtgatccaattcaataaaccagaggtggcttgggatagacaactgaccgggtgcagacccccgcccctcaatctctgcatttcctgcacgctctggg

SEQ ID NO: 48392 - DNA, 153 bp, Homo sapiens
  misc_feature 1..153: note = chr2:127863725-127863878
  misc_feature 1..153: note = hyper
  source 1..153: mol_type = genomic DNA
ccagtgccgccacccgctccccggccgccggaaacgctaagcccctgctggggcgagggcacctccttgcggggtgcgtagccctgggctcccggtggggccgggctgggcgggagcttccaggccgcaggcacctctcgggaaaggaaaccc

SEQ ID NO: 48393 - DNA, 93 bp, Homo sapiens
  misc_feature 1..93: note = chr2:127976374-127976467
  misc_feature 1..93: note = hyper
  source 1..93: mol_type = genomic DNA
ccagaaataacagtgcgtgctgggccgggcacccggggaggcggacgatgggcgaaggcatcggagggcgccgccgcggctcgggtgcagtgc

SEQ ID NO: 48394 - DNA, 154 bp, Homo sapiens
  misc_feature 1..154: note = chr2:127976672-127976826
  misc_feature 1..154: note = hyper
  source 1..154: mol_type = genomic DNA
ccgagcctccgtcccctcttcccccgccattacaaaatacaaaaaggactagaaatgaatacacacggtctcggccacctaaggacaccgagctccgcagagcctagaggagctagggaacctagcgctcccctcgggccggccccaggcagca

SEQ ID NO: 48395 - DNA, 38 bp, Homo sapiens; identical to SEQ ID NO: 27495
  misc_feature 1..38: note = chr2:128421812-128421850
  misc_feature 1..38: note = hyper
  source 1..38: mol_type = genomic DNA

SEQ ID NO: 48396 - DNA, 24 bp, Homo sapiens
  misc_feature 1..24: note = chr2:128421947-128421971
  misc_feature 1..24: note = hyper
  source 1..24: mol_type = genomic DNA
cagccgggccgccatggcgcgggg

SEQ ID NO: 48397 - DNA, 78 bp, Homo sapiens; identical to SEQ ID NO: 27497
  misc_feature 1..78: note = chr2:128432415-128432493
  misc_feature 1..78: note = hyper
  source 1..78: mol_type = genomic DNA

SEQ ID NO: 48398 - DNA, 434 bp, Homo sapiens; identical to SEQ ID NO: 27498
  misc_feature 1..434: note = chr2:128433069-128433503
  misc_feature 1..434: note = hyper
  source 1..434: mol_type = genomic DNA

SEQ ID NO: 48399 - DNA, 15 bp, Homo sapiens
  misc_feature 1..15: note = chr2:130737190-130737205
  misc_feature 1..15: note = hyper
  source 1..15: mol_type = genomic DNA
aaaactgtgttgagg

SEQ ID NO: 48400 - DNA, 182 bp, Homo sapiens; identical to SEQ ID NO: 27500
  misc_feature 1..182: note = chr2:130737475-130737657
  misc_feature 1..182: note = hyper
  source 1..182: mol_type = genomic DNA

SEQ ID NO: 48401 - DNA, 100 bp, Homo sapiens
  misc_feature 1..100: note = chr2:130763484-130763584
  misc_feature 1..100: note = hyper
  source 1..100: mol_type = genomic DNA
gcagtcccagcgctccgaacgacggtgcctccggttgacagcaacctgagcggacccgcgcctaggccctccgccaggcctgcgctgcctcgccccggga

SEQ ID NO: 48402 - DNA, 54 bp, Homo sapiens
  misc_feature 1..54: note = chr2:130763623-130763677
  misc_feature 1..54: note = hyper
  source 1..54: mol_type = genomic DNA
ggcccgtttcctttcagcgatcagtcccctggcgtcccagcagcgccttccccg

SEQ ID NO: 48403 - DNA, 104 bp, Homo sapiens; identical to SEQ ID NO: 27502
  misc_feature 1..104: note = chr2:130763729-130763833
  misc_feature 1..104: note = hyper
  source 1..104: mol_type = genomic DNA

SEQ ID NO: 48404 - DNA, 51 bp, Homo sapiens; identical to SEQ ID NO: 27503
  misc_feature 1..51: note = chr2:130970991-130971042
  misc_feature 1..51: note = hyper
  source 1..51: mol_type = genomic DNA

SEQ ID NO: 48405 - DNA, 87 bp, Homo sapiens
  misc_feature 1..87: note = chr2:130971062-130971149
  misc_feature 1..87: note = hyper
  source 1..87: mol_type = genomic DNA
cgctgctgcccgccggcctccgggcatggtccccccggagcccccgccccggtccccgggctcagccccagcccgcctggggagtcc

SEQ ID NO: 48406 - DNA, 759 bp, Homo sapiens; identical to SEQ ID NO: 27505
  misc_feature 1..759: note = chr2:131484847-131485606
  misc_feature 1..759: note = hyper
  source 1..759: mol_type = genomic DNA

SEQ ID NO: 48407 - DNA, 479 bp, Homo sapiens; identical to SEQ ID NO: 27506
  misc_feature 1..479: note = chr2:131513547-131514026
  misc_feature 1..479: note = hyper
  source 1..479: mol_type = genomic DNA

SEQ ID NO: 48408 - DNA, 150 bp, Homo sapiens; identical to SEQ ID NO: 27507
  misc_feature 1..150: note = chr2:131594772-131594922
  misc_feature 1..150: note = hyper
  source 1..150: mol_type = genomic DNA

SEQ ID NO: 48409 - DNA, 42 bp, Homo sapiens
  misc_feature 1..42: note = chr2:131594947-131594989
  misc_feature 1..42: note = hyper
  source 1..42: mol_type = genomic DNA
cgcttggcgcagtaccagctgttttgggaaggagggctggtg

SEQ ID NO: 48410 - DNA, 208 bp, Homo sapiens
  misc_feature 1..208: note = chr2:131595019-131595227
  misc_feature 1..208: note = hyper
  source 1..208: mol_type = genomic DNA
ctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggc

SEQ ID NO: 48411 - DNA, 66 bp, Homo sapiens
  misc_feature 1..66: note = chr2:131720786-131720852
  misc_feature 1..66: note = hyper
  source 1..66: mol_type = genomic DNA
cggccccttaatcaccacagggtgtgtcctgcccgggctgtcaggagggtcgcaggcgcccggtgg

SEQ ID NO: 48412 - DNA, 24 bp, Homo sapiens
  misc_feature 1..24: note = chr2:131721437-131721461
  misc_feature 1..24: note = hyper
  source 1..24: mol_type = genomic DNA
cggctgagagcctccttaacggag

SEQ ID NO: 48413 - DNA, 55 bp, Homo sapiens; identical to SEQ ID NO: 27512
  misc_feature 1..55: note = chr2:131722233-131722288
  misc_feature 1..55: note = hyper
  source 1..55: mol_type = genomic DNA

SEQ ID NO: 48414 - DNA, 38 bp, Homo sapiens
  misc_feature 1..38: note = chr2:131792222-131792260
  misc_feature 1..38: note = hyper
  source 1..38: mol_type = genomic DNA
catccctccccaaagcgccggtgccaggcgttttggcc

SEQ ID NO: 48415 - DNA, 49 bp, Homo sapiens; identical to SEQ ID NO: 27516
  misc_feature 1..49: note = chr2:132088590-132088639
  misc_feature 1..49: note = hyper
  source 1..49: mol_type = genomic DNA

SEQ ID NO: 48416 - DNA, 28 bp, Homo sapiens
  misc_feature 1..28: note = chr2:132088828-132088856
  misc_feature 1..28: note = hyper
  source 1..28: mol_type = genomic DNA
cagccacctgagccgggctcagtcttcc

SEQ ID NO: 48417 - DNA, 207 bp, Homo sapiens; identical to SEQ ID NO: 27518
  misc_feature 1..207: note = chr2:132121322-132121529
  misc_feature 1..207: note = hyper
  source 1..207: mol_type = genomic DNA

SEQ ID NO: 48418 - DNA, 129 bp, Homo sapiens
  misc_feature 1..129: note = chr2:132152232-132152361
  misc_feature 1..129: note = hyper
  source 1..129: mol_type = genomic DNA
ggtgcggccctgacccgaaagcggggcaggggtgcggaggacaggatctccgatgtccctgctccgcgggcgcccgcagtgctgagccgaagctcggcggggctgagctccagctgggggcgggtagct

SEQ ID NO: 48419 - DNA, 29 bp, Homo sapiens
  misc_feature 1..29: note = chr2:132152495-132152524
  misc_feature 1..29: note = hyper
  source 1..29: mol_type = genomic DNA
tttcttgtgtcctccgtgttcccctgtgg

SEQ ID NO: 48420 - DNA, 39 bp, Homo sapiens
  misc_feature 1..39: note = chr2:132182751-132182790
  misc_feature 1..39: note = hyper
  source 1..39: mol_type = genomic DNA
ggcgggcgcgggaggcgggcgcgggaggcgggcgcggga

SEQ ID NO: 48421 - DNA, 164 bp, Homo sapiens
  misc_feature 1..164: note = chr2:132183089-132183253
  misc_feature 1..164: note = hyper
  source 1..164: mol_type = genomic DNA
cccggttccccgcccgcccggcaaccctgtgatgaagttttcacatacgttcatttcattgaaacaaaagtcttgtaggcaccattggcaggggcaagaaacaagcacacaggttatttgcagaagaccacagaactggcaaatgacagcgccaggattcaatt

SEQ ID NO: 48422 - DNA, 109 bp, Homo sapiens
  misc_feature 1..109: note = chr2:132767348-132767457
  misc_feature 1..109: note = hyper
  source 1..109: mol_type = genomic DNA
ggcaaaaagcctaggcggagggggcaaaaagccgcggcggcgggggcaaaaaggagcgggggcaaaaaccccacaaaaacccgcggcgacggggggaaaaaaccgcggc

SEQ ID NO: 48423 - DNA, 180 bp, Homo sapiens; identical to SEQ ID NO: 27522
  misc_feature 1..180: note = chr2:132767750-132767930
  misc_feature 1..180: note = hyper
  source 1..180: mol_type = genomic DNA

SEQ ID NO: 48424 - DNA, 120 bp, Homo sapiens; identical to SEQ ID NO: 27523
  misc_feature 1..120: note = chr2:132795879-132795999
  misc_feature 1..120: note = hyper
  source 1..120: mol_type = genomic DNA

SEQ ID NO: 48425 - DNA, 120 bp, Homo sapiens; identical to SEQ ID NO: 27524
  misc_feature 1..120: note = chr2:132796059-132796179
  misc_feature 1..120: note = hyper
  source 1..120: mol_type = genomic DNA

SEQ ID NO: 48426 - DNA, 160 bp, Homo sapiens
  misc_feature 1..160: note = chr2:133015323-133015483
  misc_feature 1..160: note = hyper
  source 1..160: mol_type = genomic DNA
gggggcctgcggtaccaggaaaaatctgcgtgcggcaaccttgagccttcgcggtctgggcagggggcctggccgctgcgcgtgcgcgcaatccccgaagggccccctagtccaccagcctcctttctcccaggcaaagcacctccaagtaaacccacac

SEQ ID NO: 48427 - DNA, 156 bp, Homo sapiens; identical to SEQ ID NO: 27526
  misc_feature 1..156: note = chr2:133015543-133015699
  misc_feature 1..156: note = hyper
  source 1..156: mol_type = genomic DNA

SEQ ID NO: 48428 - DNA, 96 bp, Homo sapiens
  misc_feature 1..96: note = chr2:133062389-133062485
  misc_feature 1..96: note = hyper
  source 1..96: mol_type = genomic DNA
tgctgggttgagtcccggctggaccgcgcccctctcggaagtgtagccaggagtaggggtgtaggatgtgcagctgtgacccgtccctgtggactg

SEQ ID NO: 48429 - DNA, 26 bp, Homo sapiens
  misc_feature 1..26: note = chr2:133426223-133426249
  misc_feature 1..26: note = hyper
  source 1..26: mol_type = genomic DNA
ccactcctgggtctccgggtagggct

SEQ ID NO: 48430 - DNA, 88 bp, Homo sapiens
  misc_feature 1..88: note = chr2:133426279-133426367
  misc_feature 1..88: note = hyper
  source 1..88: mol_type = genomic DNA
cgggtacctagggtcctacggaagaaagtggaatagtgcccgccacccctggaccccggctctagacacaaagcgcccatccattacc

SEQ ID NO: 48431 - DNA, 152 bp, Homo sapiens; identical to SEQ ID NO: 27529
  misc_feature 1..152: note = chr2:133427110-133427262
  misc_feature 1..152: note = hyper
  source 1..152: mol_type = genomic DNA

SEQ ID NO: 48432 - DNA, 166 bp, Homo sapiens; identical to SEQ ID NO: 27530
  misc_feature 1..166: note = chr2:133427471-133427637
  misc_feature 1..166: note = hyper
  source 1..166: mol_type = genomic DNA

SEQ ID NO: 48433 - DNA, 221 bp, Homo sapiens; identical to SEQ ID NO: 27531
  misc_feature 1..221: note = chr2:133427885-133428106
  misc_feature 1..221: note = hyper
  source 1..221: mol_type = genomic DNA

SEQ ID NO: 48434 - DNA, 39 bp, Homo sapiens; identical to SEQ ID NO: 27532
  misc_feature 1..39: note = chr2:135475588-135475627
  misc_feature 1..39: note = hyper
  source 1..39: mol_type = genomic DNA

SEQ ID NO: 48435 - DNA, 506 bp, Homo sapiens; identical to SEQ ID NO: 27533
  misc_feature 1..506: note = chr2:135475865-135476371
  misc_feature 1..506: note = hyper
  source 1..506: mol_type = genomic DNA

SEQ ID NO: 48436 - DNA, 183 bp, Homo sapiens; identical to SEQ ID NO: 27534
  misc_feature 1..183: note = chr2:135476823-135477006
  misc_feature 1..183: note = hyper
  source 1..183: mol_type = genomic DNA

SEQ ID NO: 48437 - DNA, 148 bp, Homo sapiens; identical to SEQ ID NO: 27535
  misc_feature 1..148: note = chr2:136875889-136876037
  misc_feature 1..148: note = hyper
  source 1..148: mol_type = genomic DNA

SEQ ID NO: 48438 - DNA, 654 bp, Homo sapiens; identical to SEQ ID NO: 27536
  misc_feature 1..654: note = chr2:136876374-136877028
  misc_feature 1..654: note = hyper
  source 1..654: mol_type = genomic DNA

SEQ ID NO: 48439 - DNA, 104 bp, Homo sapiens
  misc_feature 1..104: note = chr2:137522341-137522445
  misc_feature 1..104: note = hyper
  source 1..104: mol_type = genomic DNA
gcacccagctcccggcgtttcccggagtcaccacaatgtttccctttctctctcccccacgtatgctgctaggggtactccccagataggattttctttgtctt

SEQ ID NO: 48440 - DNA, 275 bp, Homo sapiens
  misc_feature 1..275: note = chr2:137522475-137522750
  misc_feature 1..275: note = hyper
  source 1..275: mol_type = genomic DNA
cccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccc

SEQ ID NO: 48441 - DNA, 34 bp, Homo sapiens; identical to SEQ ID NO: 27538
  misc_feature 1..34: note = chr2:137522848-137522882
  misc_feature 1..34: note = hyper
  source 1..34: mol_type = genomic DNA

SEQ ID NO: 48442 - DNA, 29 bp, Homo sapiens
  misc_feature 1..29: note = chr2:137523364-137523393
  misc_feature 1..29: note = hyper
  source 1..29: mol_type = genomic DNA
actttgctctttcctcgccggacagccat

SEQ ID NO: 48443 - DNA, 78 bp, Homo sapiens; identical to SEQ ID NO: 27540
  misc_feature 1..78: note = chr2:137523516-137523594
  misc_feature 1..78: note = hyper
  source 1..78: mol_type = genomic DNA

SEQ ID NO: 48444 - DNA, 298 bp, Homo sapiens
  misc_feature 1..298: note = chr2:139537145-139537443
  misc_feature 1..298: note = hyper
  source 1..298: mol_type = genomic DNA
aagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcactatgctgtgctttgggagaagtgtctgtgtgcatctgggcaaaacaccacgtgaaaaataaacaccaccaagcctctcaaactgtgaacaggaggaaggtctttctgccccttctcatcctatcaatttactttc

SEQ ID NO: 48445 - DNA, 292 bp, Homo sapiens
  misc_feature 1..292: note = chr2:139537865-139538157
  misc_feature 1..292: note = hyper
  source 1..292: mol_type = genomic DNA
catctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctg

SEQ ID NO: 48446 - DNA, 251 bp, Homo sapiens
  misc_feature 1..251: note = chr2:142888097-142888348
  misc_feature 1..251: note = hyper
  source 1..251: mol_type = genomic DNA
cccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctggcaatcggcaataatcccgagagagtgagtaaggcgaggagaaactcggacattgtggtcgcccggtaaggaagcctgcgctggagactgctcggcggcacct

SEQ ID NO: 48447 - DNA, 123 bp, Homo sapiens
  misc_feature 1..123: note = chr2:142888418-142888541
  misc_feature 1..123: note = hyper
  source 1..123: mol_type = genomic DNA
tcactggaaattcttcagctcaatgagtccagccagtcagccttctcctgcctggagcaggatgtggaaggtggagggatgcgcgcgtgcgggagagaggaggcagagcgtgtgtgagcgcga

SEQ ID NO: 48448 - DNA, 35 bp, Homo sapiens; identical to SEQ ID NO: 27544
  misc_feature 1..35: note = chr2:142889151-142889186
  misc_feature 1..35: note = hyper
  source 1..35: mol_type = genomic DNA

SEQ ID NO: 48449 - DNA, 76 bp, Homo sapiens
  misc_feature 1..76: note = chr2:144694291-144694367
  misc_feature 1..76: note = hyper
  source 1..76: mol_type = genomic DNA
aaaggtagtaggcatcggtgtttctggttttgcttagtgcgtcttcatcgtattccctcgctgaggactgagcctg

SEQ ID NO: 48450 - DNA, 122 bp, Homo sapiens; identical to SEQ ID NO: 17705
  misc_feature 1..122: note = chr2:144695135-144695257
  misc_feature 1..122: note = hyper
  source 1..122: mol_type = genomic DNA

SEQ ID NO: 48451 - DNA, 67 bp, Homo sapiens; identical to SEQ ID NO: 27547
  misc_feature 1..67: note = chr2:144695258-144695325
  misc_feature 1..67: note = hyper
  source 1..67: mol_type = genomic DNA

SEQ ID NO: 48452 - DNA, 77 bp, Homo sapiens; identical to SEQ ID NO: 17707
  misc_feature 1..77: note = chr2:145273327-145273404
  misc_feature 1..77: note = hyper
  source 1..77: mol_type = genomic DNA

SEQ ID NO: 48453 - DNA, 39 bp, Homo sapiens; identical to SEQ ID NO: 17708
  misc_feature 1..39: note = chr2:145273751-145273790
  misc_feature 1..39: note = hyper
  source 1..39: mol_type = genomic DNA

SEQ ID NO: 48454 - DNA, 106 bp, Homo sapiens; identical to SEQ ID NO: 17709
  misc_feature 1..106: note = chr2:145274080-145274186
  misc_feature 1..106: note = hyper
  source 1..106: mol_type = genomic DNA

SEQ ID NO: 48455 - DNA, 56 bp, Homo sapiens; identical to SEQ ID NO: 17710
  misc_feature 1..56: note = chr2:145274455-145274511
  misc_feature 1..56: note = hyper
  source 1..56: mol_type = genomic DNA

SEQ ID NO: 48456 - DNA, 238 bp, Homo sapiens; identical to SEQ ID NO: 17711
  misc_feature 1..238: note = chr2:145274576-145274814
  misc_feature 1..238: note = hyper
  source 1..238: mol_type = genomic DNA

SEQ ID NO: 48457 - DNA, 404 bp, Homo sapiens
  misc_feature 1..404: note = chr2:145275213-145275617
  misc_feature 1..404: note = hyper
  source 1..404: mol_type = genomic DNA
gacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatat

SEQ ID NO: 48458 - DNA, 39 bp, Homo sapiens; identical to SEQ ID NO: 27552
  misc_feature 1..39: note = chr2:145275852-145275891
  misc_feature 1..39: note = hyper
  source 1..39: mol_type = genomic DNA

SEQ ID NO: 48459 - DNA, 457 bp, Homo sapiens; identical to SEQ ID NO: 27553
  misc_feature 1..457: note = chr2:145277493-145277950
  misc_feature 1..457: note = hyper
  source 1..457: mol_type = genomic DNA

SEQ ID NO: 48460 - DNA, 740 bp, Homo sapiens; identical to SEQ ID NO: 27554
  misc_feature 1..740: note = chr2:145281202-145281942
  misc_feature 1..740: note = hyper
  source 1..740: mol_type = genomic DNA

SEQ ID NO: 48461 - DNA, 36 bp, Homo sapiens; identical to SEQ ID NO: 6423
  misc_feature 1..36: note = chr2:145281943-145281979
  misc_feature 1..36: note = hyper
  source 1..36: mol_type = genomic DNA

SEQ ID NO: 48462 - DNA, 78 bp, Homo sapiens; identical to SEQ ID NO: 6424
  misc_feature 1..78: note = chr2:145282041-145282119
  misc_feature 1..78: note = hyper
  source 1..78: mol_type = genomic DNA

SEQ ID NO: 48463 - skipped

SEQ ID NO: 48464 - DNA, 30 bp, Homo sapiens; identical to SEQ ID NO: 27557
  misc_feature 1..30: note = chr2:148601319-148601349
  misc_feature 1..30: note = hyper
  source 1..30: mol_type = genomic DNA

SEQ ID NO: 48465 - DNA, 216 bp, Homo sapiens; identical to SEQ ID NO: 27558
  misc_feature 1..216: note = chr2:149632642-149632858
  misc_feature 1..216: note = hyper
  source 1..216: mol_type = genomic DNA

SEQ ID NO: 48466 - DNA, 209 bp, Homo sapiens
  misc_feature 1..209: note = chr2:149632888-149633097
  misc_feature 1..209: note = hyper
  source 1..209: mol_type = genomic DNA
cgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctg

SEQ ID NO: 48467 - DNA, 345 bp, Homo sapiens; identical to SEQ ID NO: 17718
  misc_feature 1..345: note = chr2:149633399-149633744
  misc_feature 1..345: note = hyper
  source 1..345: mol_type = genomic DNA

SEQ ID NO: 48468 - DNA, 92 bp, Homo sapiens; identical to SEQ ID NO: 17719
  misc_feature 1..92: note = chr2:149633965-149634057
  misc_feature 1..92: note = hyper
  source 1..92: mol_type = genomic DNA

SEQ ID NO: 48469 - DNA, 30 bp, Homo sapiens; identical to SEQ ID NO: 27563
  misc_feature 1..30: note = chr2:151343607-151343637
  misc_feature 1..30: note = hyper
  source 1..30: mol_type = genomic DNA

SEQ ID NO: 48470 - DNA, 411 bp, Homo sapiens; identical to SEQ ID NO: 27564
  misc_feature 1..411: note = chr2:152954623-152955034
  misc_feature 1..411: note = hyper
  source 1..411: mol_type = genomic DNA

SEQ ID NO: 48471 - DNA, 32 bp, Homo sapiens; identical to SEQ ID NO: 27565
  misc_feature 1..32: note = chr2:152956018-152956050
  misc_feature 1..32: note = hyper
  source 1..32: mol_type = genomic DNA

SEQ ID NO: 48472 - DNA, 186 bp, Homo sapiens
  misc_feature 1..186: note = chr2:154333349-154333535
  misc_feature 1..186: note = hyper
  source 1..186: mol_type = genomic DNA
gcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacg

SEQ ID NO: 48473 - DNA, 164 bp, Homo sapiens; identical to SEQ ID NO: 17722
  misc_feature 1..164: note = chr2:154333567-154333731
  misc_feature 1..164: note = hyper
  source 1..164: mol_type = genomic DNA

SEQ ID NO: 48474 - DNA, 221 bp, Homo sapiens
  misc_feature 1..221: note = chr2:154334051-154334272
  misc_feature 1..221: note = hyper
  source 1..221: mol_type = genomic DNA
agaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagca

SEQ ID NO: 48475 - DNA, 193 bp, Homo sapiens
  misc_feature 1..193: note = chr2:154335271-154335464
  misc_feature 1..193: note = hyper
  source 1..193: mol_type = genomic DNA
cttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctc

SEQ ID NO: 48476 - DNA, 51 bp, Homo sapiens; identical to SEQ ID NO: 27570
  misc_feature 1..51: note = chr2:154727941-154727992
  misc_feature 1..51: note = hyper
  source 1..51: mol_type = genomic DNA

SEQ ID NO: 48477 - DNA, 21 bp, Homo sapiens
  misc_feature 1..21: note = chr2:154729240-154729261
  misc_feature 1..21: note = hyper
  source 1..21: mol_type = genomic DNA
cagccccggctgcgttgcggg

SEQ ID NO: 48478 - DNA, 314 bp, Homo sapiens; identical to SEQ ID NO: 27572
  misc_feature 1..314: note = chr2:154729747-154730061
  misc_feature 1..314: note = hyper
  source 1..314: mol_type = genomic DNA

SEQ ID NO: 48479 - DNA, 228 bp, Homo sapiens
  misc_feature 1..228: note = chr2:157176364-157176592
  misc_feature 1..228: note = hyper
  source 1..228: mol_type = genomic DNA
ccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctccta

SEQ ID NO: 48480 - DNA, 286 bp, Homo sapiens
  misc_feature 1..286: note = chr2:157176717-157177003
  misc_feature 1..286: note = hyper
  source 1..286: mol_type = genomic DNA
gagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaa

SEQ ID NO: 48481 - DNA, 214 bp, Homo sapiens; identical to SEQ ID NO: 27576
  misc_feature 1..214: note = chr2:160760685-160760899
  misc_feature 1..214: note = hyper
  source 1..214: mol_type = genomic DNA

SEQ ID NO: 48482 - DNA, 111 bp, Homo sapiens
  misc_feature 1..111: note = chr2:160760959-160761070
  misc_feature 1..111: note = hyper
  source 1..111: mol_type = genomic DNA
cggctccagagcccccccgccccaacagcaaagcagccgtgacctgccccaggggcgcagccctgccccaggctggaaggcagcagagctgtggcgtcgaggcacccagcg

SEQ ID NO: 48483 - DNA, 50 bp, Homo sapiens; identical to SEQ ID NO: 27578
  misc_feature 1..50: note = chr2:160918710-160918760
  misc_feature 1..50: note = hyper
  source 1..50: mol_type = genomic DNA

SEQ ID NO: 48484 - DNA, 30 bp, Homo sapiens; identical to SEQ ID NO: 27579
  misc_feature 1..30: note = chr2:161560586-161560616
  misc_feature 1..30: note = hyper
  source 1..30: mol_type = genomic DNA

SEQ ID NO: 48485 - DNA, 30 bp, Homo sapiens; identical to SEQ ID NO: 27580
  misc_feature 1..30: note = chr2:162094291-162094321
  misc_feature 1..30: note = hyper
  source 1..30: mol_type = genomic DNA

SEQ ID NO: 48486 - DNA, 30 bp, Homo sapiens; identical to SEQ ID NO: 27581
  misc_feature 1..30: note = chr2:162094680-162094710
  misc_feature 1..30: note = hyper
  source 1..30: mol_type = genomic DNA

SEQ ID NO: 48487 - DNA, 128 bp, Homo sapiens; identical to SEQ ID NO: 27582
  misc_feature 1..128: note = chr2:162095511-162095639
  misc_feature 1..128: note = hyper
  source 1..128: mol_type = genomic DNA

SEQ ID NO: 48488 - DNA, 100 bp, Homo sapiens
  misc_feature 1..100: note = chr2:162274338-162274438
  misc_feature 1..100: note = hyper
  source 1..100: mol_type = genomic DNA
aaggcaagtccttccaattaacacattttcttgacacttatttaggtgagaatgattaattaaagcctttgtggactggctcgagcgacttttaaaacga

SEQ ID NO: 48489 - DNA, 280 bp, Homo sapiens
  misc_feature 1..280: note = chr2:162274866-162275146
  misc_feature 1..280: note = hyper
  source 1..280: mol_type = genomic DNA
tctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggag

SEQ ID NO: 48490 - DNA, 15 bp, Homo sapiens
  misc_feature 1..15: note = chr2:162279873-162279888
  misc_feature 1..15: note = hyper
  source 1..15: mol_type = genomic DNA
ccgcaggatctacac

SEQ ID NO: 48491 - DNA, 85 bp, Homo sapiens
  misc_feature 1..85: note = chr2:162280956-162281041
  misc_feature 1..85: note = hyper
  source 1..85: mol_type = genomic DNA
ctgtaaaccttttggttttcctacttactcttcttctgtggagttatcctcctacaattcccctccccctcgtctttctcttacc

SEQ ID NO: 48492 - DNA, 30 bp, Homo sapiens; identical to SEQ ID NO: 27591
  misc_feature 1..30: note = chr2:162282450-162282480
  misc_feature 1..30: note = hyper
  source 1..30: mol_type = genomic DNA

SEQ ID NO: 48493 - DNA, 48 bp, Homo sapiens
  misc_feature 1..48: note = chr2:162284055-162284103
  misc_feature 1..48: note = hyper
  source 1..48: mol_type = genomic DNA
gtcttgtccctttaaaacatgatcatttctcctcgcttccaagaagtc

SEQ ID NO: 48494 - DNA, 183 bp, Homo sapiens; identical to SEQ ID NO: 27594
  misc_feature 1..183: note = chr2:162284325-162284508
  misc_feature 1..183: note = hyper
  source 1..183: mol_type = genomic DNA

SEQ ID NO: 48495 - DNA, 26 bp, Homo sapiens
  misc_feature 1..26: note = chr2:162930218-162930244
  misc_feature 1..26: note = hyper
  source 1..26: mol_type = genomic DNA
ttctctacccctgcccgggttcgggc

SEQ ID NO: 48496 - DNA, 40 bp, Homo sapiens; identical to SEQ ID NO: 27596
  misc_feature 1..40: note = chr2:162930245-162930285
  misc_feature 1..40: note = hyper
  source 1..40: mol_type = genomic DNA

SEQ ID NO: 48497 - DNA, 260 bp, Homo sapiens; identical to SEQ ID NO: 27597
  misc_feature 1..260: note = chr2:162930338-162930598
  misc_feature 1..260: note = hyper
  source 1..260: mol_type = genomic DNA

SEQ ID NO: 48498 - DNA, 113 bp, Homo sapiens; identical to SEQ ID NO: 27598
  misc_feature 1..113: note = chr2:163694871-163694984
  misc_feature 1..113: note = hyper
  source 1..113: mol_type = genomic DNA

SEQ ID NO: 48499 - DNA, 261 bp, Homo sapiens; identical to SEQ ID NO: 27599
  misc_feature 1..261: note = chr2:163695246-163695507
  misc_feature 1..261: note = hyper
  source 1..261: mol_type = genomic DNA

SEQ ID NO: 48500 - DNA, 141 bp, Homo sapiens; identical to SEQ ID NO: 6454
  misc_feature 1..141: note = chr2:164592629-164592770
  misc_feature 1..141: note = hyper
  source 1..141: mol_type = genomic DNA

SEQ ID NO: 48501 - DNA, 84 bp, Homo sapiens
  misc_feature 1..84: note = chr2:164593137-164593221
  misc_feature 1..84: note = hyper
  source 1..84: mol_type = genomic DNA
cccgcgggctcttccctgccggttcccggccctctcgacagctgcggcccgtccgcccttccccaccccctctgcgcacgggac

SEQ ID NO: 48502 - DNA, 148 bp, Homo sapiens; identical to SEQ ID NO: 27602
  misc_feature 1..148: note = chr2:164593222-164593370
  misc_feature 1..148: note = hyper
  source 1..148: mol_type = genomic DNA

SEQ ID NO: 48503 - DNA, 149 bp, Homo sapiens; identical to SEQ ID NO: 27603
  misc_feature 1..149: note = chr2:165478206-165478355
  misc_feature 1..149: note = hyper
  source 1..149: mol_type = genomic DNA

SEQ ID NO: 48504 - DNA, 31 bp, Homo sapiens; identical to SEQ ID NO: 6456
  misc_feature 1..31: note = chr2:167233063-167233094
  misc_feature 1..31: note = hyper
  source 1..31: mol_type = genomic DNA

SEQ ID NO: 48505 - DNA, 35 bp, Homo sapiens; identical to SEQ ID NO: 27605
  misc_feature 1..35: note = chr2:168149198-168149233
  misc_feature 1..35: note = hyper
  source 1..35: mol_type = genomic DNA

SEQ ID NO: 48506 - DNA, 53 bp, Homo sapiens; identical to SEQ ID NO: 27606
  misc_feature 1..53: note = chr2:168149503-168149556
  misc_feature 1..53: note = hyper
  source 1..53: mol_type = genomic DNA

SEQ ID NO: 48507 - DNA, 215 bp, Homo sapiens; identical to SEQ ID NO: 27607
  misc_feature 1..215: note = chr2:168149776-168149991
  misc_feature 1..215: note = hyper
  source 1..215: mol_type = genomic DNA

SEQ ID NO: 48508 - DNA, 77 bp, Homo sapiens
  misc_feature 1..77: note = chr2:168149992-168150069
  misc_feature 1..77: note = hyper
  source 1..77: mol_type = genomic DNA
cgcccgtgcggctccagctggtgcgttctcccttccgcgctcacagactttgacagcgcggggatggcattgtgtga

SEQ ID NO: 48509 - DNA, 506 bp, Homo sapiens
  misc_feature 1..506: note = chr2:168150245-168150751
  misc_feature 1..506: note = hyper
  source 1..506: mol_type = genomic DNA
tggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcag

SEQ ID NO: 48510 - DNA, 125 bp, Homo sapiens; identical to SEQ ID NO: 27609
  misc_feature 1..125: note = chr2:170218695-170218820
  misc_feature 1..125: note = hyper
  source 1..125: mol_type = genomic DNA

SEQ ID NO: 48511 - DNA, 298 bp, Homo sapiens; identical to SEQ ID NO: 27610
  misc_feature 1..298: note = chr2:170219260-170219558
  misc_feature 1..298: note = hyper
  source 1..298: mol_type = genomic DNA

SEQ ID NO: 48512 - DNA, 251 bp, Homo sapiens; identical to SEQ ID NO: 27611
  misc_feature 1..251: note = chr2:170219911-170220162
  misc_feature 1..251: note = hyper
  source 1..251: mol_type = genomic DNA

SEQ ID NO: 48513 - DNA, 65 bp, Homo sapiens; identical to SEQ ID NO: 27612
  misc_feature 1..65: note = chr2:170220494-170220559
  misc_feature 1..65: note = hyper
  source 1..65: mol_type = genomic DNA

SEQ ID NO: 48514 - DNA, 34 bp, Homo sapiens; identical to SEQ ID NO: 27613
  misc_feature 1..34: note = chr2:170335909-170335943
  misc_feature 1..34: note = hyper
  source 1..34: mol_type = genomic DNA

SEQ ID NO: 48515 - DNA, 366 bp, Homo sapiens; identical to SEQ ID NO: 27614
  misc_feature 1..366: note = chr2:171568345-171568711
  misc_feature 1..366: note = hyper
  source 1..366: mol_type = genomic DNA

SEQ ID NO: 48516 - DNA, 15 bp, Homo sapiens
  misc_feature 1..15: note = chr2:171570047-171570062
  misc_feature 1..15: note = hyper
  source 1..15: mol_type = genomic DNA
gggagaaggtgggcc

SEQ ID NO: 48517 - DNA, 214 bp, Homo sapiens; identical to SEQ ID NO: 17745
  misc_feature 1..214: note = chr2:171570470-171570684
  misc_feature 1..214: note = hyper
  source 1..214: mol_type = genomic DNA

SEQ ID NO: 48518 - DNA, 224 bp, Homo sapiens
  misc_feature 1..224: note = chr2:171570733-171570957
  misc_feature 1..224: note = hyper
  source 1..224: mol_type = genomic DNA
ttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtggcctggggagaagggggcgggacagcacagcttcttcccctcgggtgggcatgacg

SEQ ID NO: 48519 - DNA, 44 bp, Homo sapiens; identical to SEQ ID NO: 27618
  misc_feature 1..44: note = chr2:171571200-171571244
  misc_feature 1..44: note = hyper
  source 1..44: mol_type = genomic DNA

SEQ ID NO: 48520 - DNA, 43 bp, Homo sapiens
  misc_feature 1..43: note = chr2:171571846-171571889
  misc_feature 1..43: note = hyper
  source 1..43: mol_type = genomic DNA
agaccgcgcgcggggcgagcgagcggggcgcggcgaggggcaa

SEQ ID NO: 48521 - DNA, 230 bp, Homo sapiens; identical to SEQ ID NO: 27620
  misc_feature 1..230: note = chr2:171572347-171572577
  misc_feature 1..230: note = hyper
  source 1..230: mol_type = genomic DNA

SEQ ID NO: 48522 - DNA, 503 bp, Homo sapiens
  misc_feature 1..503: note = chr2:171669846-171670349
  misc_feature 1..503: note = hyper
  source 1..503: mol_type = genomic DNA
aatggaccttagctccgacttaagcagaatgaaaggttaagtaacgcttcccccagttctcgtctcgggagacagacgtttaaccggtgagcactgccattttttttttcctttctggtcataaattagacacttaaaatagattttaaggagccagctgaaacgaaccaataccatggctctaaattacgtttcctggaggctaaaaattctaattgcgtcaaaaaaaattgacgtgtcctgtctactcaccttgactgaccacgttttaggcgtgaagatctccccgcagcccgtttgggcgctccttcaacgcctcacgctcctcctactcacccgtttttccctttgcagaaaaggcttggccccaaatccggttggaatatctttaaacaatcccccacccacccacgacggggaaaggaataaagggcattgtgggcggagggtcgtgttcccaagtcccagcggtggttgacctaaggaaacgttatcctcggcag

SEQ ID NO: 48523 - DNA, 270 bp, Homo sapiens; identical to SEQ ID NO: 27622
  misc_feature 1..270: note = chr2:171670471-171670741
  misc_feature 1..270: note = hyper
  source 1..270: mol_type = genomic DNA

SEQ ID NO: 48524 - DNA, 181 bp, Homo sapiens
  misc_feature 1..181: note = chr2:171671306-171671487
  misc_feature 1..181: note = hyper
  source 1..181: mol_type = genomic DNA
agattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatg

SEQ ID NO: 48525 - DNA, 125 bp, Homo sapiens; identical to SEQ ID NO: 27625
  misc_feature 1..125: note = chr2:171674091-171674216
  misc_feature 1..125: note = hyper
  source 1..125: mol_type = genomic DNA

SEQ ID NO: 48526 - DNA, 41 bp, Homo sapiens
  misc_feature 1..41: note = chr2:171674698-171674739
  misc_feature 1..41: note = hyper
  source 1..41: mol_type = genomic DNA
tcccccacacccttgcgtcttgtactggccttggaccccca

SEQ ID NO: 48527 - DNA, 55 bp, Homo sapiens
  misc_feature 1..55: note = chr2:171675306-171675361
  misc_feature 1..55: note = hyper
  source 1..55: mol_type = genomic DNA
atggggctctgaccccgtccctgccagaggtcattcggctgtcagggacgctagg

SEQ ID NO: 48528 - DNA, 73 bp, Homo sapiens
  misc_feature 1..73: note = chr2:171675592-171675665
  misc_feature 1..73: note = hyper
  source 1..73: mol_type = genomic DNA
tgacctcctcctttccccctgggctgtgttcaaagtctataatcagcggaaatttcgacgttaattgcagctt

SEQ ID NO: 48529 - DNA, 234 bp, Homo sapiens; identical to SEQ ID NO: 27629
  misc_feature 1..234: note = chr2:171677989-171678223
  misc_feature 1..234: note = hyper
  source 1..234: mol_type = genomic DNA

SEQ ID NO: 48530 - DNA, 53 bp, Homo sapiens; identical to SEQ ID NO: 27630
  misc_feature 1..53: note = chr2:171678293-171678346
  misc_feature 1..53: note = hyper
  source 1..53: mol_type = genomic DNA

SEQ ID NO: 48531 - DNA, 57 bp, Homo sapiens; identical to SEQ ID NO: 27631
  misc_feature 1..57: note = chr2:171678980-171679037
  misc_feature 1..57: note = hyper
  source 1..57: mol_type = genomic DNA

SEQ ID NO: 48532 - DNA, 117 bp, Homo sapiens; identical to SEQ ID NO: 27632
  misc_feature 1..117: note = chr2:172379586-172379703
  misc_feature 1..117: note = hyper
  source 1..117: mol_type = genomic DNA

SEQ ID NO: 48533 - DNA, 43 bp, Homo sapiens
  misc_feature 1..43: note = chr2:172946211-172946254
  misc_feature 1..43: note = hyper
  source 1..43: mol_type = genomic DNA
gcttcaggaacaggaatccaagggcccacgctctgtctgccaa

SEQ ID NO: 48534 - DNA, 30 bp, Homo sapiens; identical to SEQ ID NO: 27635
  misc_feature 1..30: note = chr2:172946606-172946636
  misc_feature 1..30: note = hyper
  source 1..30: mol_type = genomic DNA

SEQ ID NO: 48535 - DNA, 179 bp, Homo sapiens
  misc_feature 1..179: note = chr2:172948314-172948493
  misc_feature 1..179: note = hyper
  source 1..179: mol_type = genomic DNA
ttgcttttgcttttctttttgctccaaccactctgcctgaaatatttctgcccccagcattgtgcccttaaaccaaaggagaggaattctgcgggcagcagcagctggtacagaagttaaaaaaaaagagaaaccccctctactaatatctgtaacgacagcaccgatgtaatttgttt

SEQ ID NO: 48536 - DNA, 501 bp, Homo sapiens
  misc_feature 1..501: note = chr2:172949711-172950212
  misc_feature 1..501: note = hyper
  source 1..501: mol_type = genomic DNA
tcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagct

SEQ ID NO: 48537 - DNA, 292 bp, Homo sapiens; identical to SEQ ID NO: 6480
  misc_feature 1..292: note = chr2:172951251-172951543
  misc_feature 1..292: note = hyper
  source 1..292: mol_type = genomic DNA

SEQ ID NO: 48538 - DNA, 60 bp, Homo sapiens; identical to SEQ ID NO: 27641
  misc_feature 1..60: note = chr2:172951983-172952043
  misc_feature 1..60: note = hyper
  source 1..60: mol_type = genomic DNA

SEQ ID NO: 48539 - DNA, 140 bp, Homo sapiens
  misc_feature 1..140: note = chr2:172952381-172952521
  misc_feature 1..140: note = hyper
  source 1..140: mol_type = genomic DNA
tcggtgttatgcaggcgctgtatcttccgcaggcggtagccacggtcggactgagcccctggcaggctaaggcctggatcccggttctcccctcatcacaactcctccctggctctctgagagctgcccccgtgggctga

SEQ ID NO: 48540 - DNA, 249 bp, Homo sapiens; identical to SEQ ID NO: 17758
  misc_feature 1..249: note = chr2:172955545-172955794
  misc_feature 1..249: note = hyper
  source 1..249: mol_type = genomic DNA

SEQ ID NO: 48541 - DNA, 98 bp, Homo sapiens
  misc_feature 1..98: note = chr2:172957809-172957907
  misc_feature 1..98: note = hyper
  source 1..98: mol_type = genomic DNA
gtcacccccacccaccgctttcctaccccctccctcatcccccaatcttcgaggattaacacttcctgaaacatcaagtgtttttataaaaaggaaaa

SEQ ID NO: 48542 - DNA, 30 bp, Homo sapiens; identical to SEQ ID NO: 27647
  misc_feature 1..30: note = chr2:172958321-172958351
  misc_feature 1..30: note = hyper
  source 1..30: mol_type = genomic DNA

SEQ ID NO: 48543 - DNA, 107 bp, Homo sapiens; identical to SEQ ID NO: 27648
  misc_feature 1..107: note = chr2:172960759-172960866
  misc_feature 1..107: note = hyper
  source 1..107: mol_type = genomic DNA

SEQ ID NO: 48544 - DNA, 73 bp, Homo sapiens; identical to SEQ ID NO: 17759
  misc_feature 1..73: note = chr2:172961325-172961398
  misc_feature 1..73: note = hyper
  source 1..73: mol_type = genomic DNA

SEQ ID NO: 48545 - DNA, 99 bp, Homo sapiens
  misc_feature 1..99: note = chr2:172961598-172961697
  misc_feature 1..99: note = hyper
  source 1..99: mol_type = genomic DNA
ccatttttcattcgcgctttggggagctcagtagagcacggggggagcgtgtctgcgcggcggcgggctgatcacaggactccgcgtctccgggcgggc

SEQ ID NO: 48546 - DNA, 82 bp, Homo sapiens; identical to SEQ ID NO: 27650
  misc_feature 1..82: note = chr2:172961935-172962017
  misc_feature 1..82: note = hyper
  source 1..82: mol_type = genomic DNA

SEQ ID NO: 48547 - DNA, 459 bp, Homo sapiens; identical to SEQ ID NO: 27651
  misc_feature 1..459: note = chr2:172963633-172964092
  misc_feature 1..459: note = hyper
  source 1..459: mol_type = genomic DNA

SEQ ID NO: 48548 - DNA, 74 bp, Homo sapiens
  misc_feature 1..74: note = chr2:172964747-172964821
  misc_feature 1..74: note = hyper
  source 1..74: mol_type = genomic DNA
caggaaggaaagaagcggcggggccgcccgggtcaaggggccacgtgggggagggcgggcaggcgggaccggga

SEQ ID NO: 48549 - DNA, 14 bp, Homo sapiens
  misc_feature 1..14: note = chr2:172966250-172966264
  misc_feature 1..14: note = hyper
  source 1..14: mol_type = genomic DNA
tgagtcttttggaa

SEQ ID NO: 48550 - DNA, 610 bp, Homo sapiens; identical to SEQ ID NO: 17763
  misc_feature 1..610: note = chr2:172966442-172967052
  misc_feature 1..610: note = hyper
  source 1..610: mol_type = genomic DNA

SEQ ID NO: 48551 - DNA, 173 bp, Homo sapiens; identical to SEQ ID NO: 27656
  misc_feature 1..173: note = chr2:172970574-172970747
  misc_feature 1..173: note = hyper
  source 1..173: mol_type = genomic DNA

SEQ ID NO: 48552 - DNA, 420 bp, Homo sapiens; identical to SEQ ID NO: 27657
  misc_feature 1..420: note = chr2:172970950-172971370
  misc_feature 1..420: note = hyper
  source 1..420: mol_type = genomic DNA

SEQ ID NO: 48553 - DNA, 53 bp, Homo sapiens; identical to SEQ ID NO: 27658
  misc_feature 1..53: note = chr2:172971641-172971694
  misc_feature 1..53: note = hyper
  source 1..53: mol_type = genomic DNA

SEQ ID NO: 48554 - DNA, 37 bp, Homo sapiens
  misc_feature 1..37: note = chr2:172973218-172973255
  misc_feature 1..37: note = hyper
  source 1..37: mol_type = genomic DNA
tccagccgtggcctttccgcggcgctgggcttctggt

SEQ ID NO: 48555 - DNA, 30 bp, Homo sapiens; identical to SEQ ID NO: 27660
  misc_feature 1..30: note = chr2:172974228-172974258
  misc_feature 1..30: note = hyper
  source 1..30: mol_type = genomic DNA

SEQ ID NO: 48556 - DNA, 88 bp, Homo sapiens
  misc_feature 1..88: note = chr2:173099696-173099784
  misc_feature 1..88: note = hyper
  source 1..88: mol_type = genomic DNA
cggcgccgggggagccgcgctcggggacagctggcggctcaacggcagcatcggcagcatcgagaaaggtgacgagttctgcaaataa

SEQ ID NO: 48557 - DNA, 283 bp, Homo sapiens; identical to SEQ ID NO: 17767
  misc_feature 1..283: note = chr2:173099814-173100097
  misc_feature 1..283: note = hyper
  source 1..283: mol_type = genomic DNA

SEQ ID NO: 48558 - DNA, 164 bp, Homo sapiens; identical to SEQ ID NO: 17768
  misc_feature 1..164: note = chr2:173100098-173100262
  misc_feature 1..164: note = hyper
  source 1..164: mol_type = genomic DNA

SEQ ID NO: 48559 - DNA, 454 bp, Homo sapiens; identical to SEQ ID NO: 27663
  misc_feature 1..454: note = chr2:173600547-173601001
  misc_feature 1..454: note = hyper
  source 1..454: mol_type = genomic DNA

SEQ ID NO: 48560 - DNA, 100 bp, Homo sapiens
  misc_feature 1..100: note = chr2:175190771-175190871
  misc_feature 1..100: note = hyper
  source 1..100: mol_type = genomic DNA
gaagaaagagaaactcgcgacaacagagttgccgaaagagaagtgttggcgcctcaaacttgaggatcagcttcttgggccccactccagggtgtcgcgg

SEQ ID NO: 48561 - DNA, 82 bp, Homo sapiens
  misc_feature 1..82: note = chr2:175193823-175193905
  misc_feature 1..82: note = hyper
  source 1..82: mol_type = genomic DNA
tatgacgaactagaggctgggcccggttcttctccagaacagcgtgtggatgtaaaggagatgaaatcgtcctcccccactg

SEQ ID NO: 48562 - DNA, 122 bp, Homo sapiens
  misc_feature 1..122: note = chr2:175196967-175197089
  misc_feature 1..122: note = hyper
  source 1..122: mol_type = genomic DNA
aaaaaatctgtcagacgaaaaaaatctggacttcctccgaaagatttccttggggccccaccttagagttgaagtggcccgggtgtttgcctgcgttcgtttggaagatttccctaactttt

SEQ ID NO: 48563 - DNA, 146 bp, Homo sapiens
  misc_feature 1..146: note = chr2:175197119-175197265
  misc_feature 1..146: note = hyper
  source 1..146: mol_type = genomic DNA
atatgcgagtgcccacgtctagagtctgacagctggaactacggggaaaacggcgggagggggaggggaggggatccgaggggaggaggagaagaggaaggcgagcagggcgccggagcccgaggtgtctgcgagaactgttttaa

SEQ ID NO: 48564 - DNA, 65 bp, Homo sapiens; identical to SEQ ID NO: 27670
  misc_feature 1..65: note = chr2:175197980-175198045
  misc_feature 1..65: note = hyper
  source 1..65: mol_type = genomic DNA

SEQ ID NO: 48565 - DNA, 79 bp, Homo sapiens
  misc_feature 1..79: note = chr2:175199448-175199527
  misc_feature 1..79: note = hyper
  source 1..79: mol_type = genomic DNA
cttcagtccccagcccgccctcgccccccccccgcaagtatcccccactactcccccccacccccgcggccctagctag

SEQ ID NO: 48566 - DNA, 59 bp, Homo sapiens; identical to SEQ ID NO: 17774
  misc_feature 1..59: note = chr2:175202652-175202711
  misc_feature 1..59: note = hyper
  source 1..59: mol_type = genomic DNA

SEQ ID NO: 48567 - DNA, 30 bp, Homo sapiens; identical to SEQ ID NO: 6510
  misc_feature 1..30: note = chr2:175203142-175203172
  misc_feature 1..30: note = hyper
  source 1..30: mol_type = genomic DNA

SEQ ID NO: 48568 - DNA, 24 bp, Homo sapiens
  misc_feature 1..24: note = chr2:175204150-175204174
  misc_feature 1..24: note = hyper
  source 1..24: mol_type = genomic DNA
ccgtcaaatggccctcgcaggtta

SEQ ID NO: 48569 - DNA, 200 bp, Homo sapiens; identical to SEQ ID NO: 17776
  misc_feature 1..200: note = chr2:175207028-175207228
  misc_feature 1..200: note = hyper
  source 1..200: mol_type = genomic DNA

SEQ ID NO: 48570 - DNA, 278 bp, Homo sapiens; identical to SEQ ID NO: 17777
  misc_feature 1..278: note = chr2:175207258-175207536
  misc_feature 1..278: note = hyper
  source 1..278: mol_type = genomic DNA

SEQ ID NO: 48571 - DNA, 330 bp, Homo sapiens
  misc_feature 1..330: note = chr2:175207981-175208311
  misc_feature 1..330: note = hyper
  source 1..330: mol_type = genomic DNA
cccacccttcccagacgctggagtgtatagaaatatgtatgaggtaaatacatacagacatgcctcccccatatattgttgatgtaaatatagactgtgtgtttgcatctccagttaaggaaagggtttcagaatgtccgtggggacacgtccctccagggccggctgtcgaggacccggaaaaccacagcccctaagagttccagattttccaagacccttatactctcttcctgtagaatttcatactgggggttttgcattgttttgcaggcatgtaaccatttctgggtgattcatttatctataaaggaaatgcaaagtggcagg

SEQ ID NO: 48572 - DNA, 43 bp, Homo sapiens; identical to SEQ ID NO: 27688
  misc_feature 1..43: note = chr2:175351019-175351062
  misc_feature 1..43: note = hyper
  source 1..43: mol_type = genomic DNA

SEQ ID NO: 48573 - DNA, 219 bp, Homo sapiens
  misc_feature 1..219: note = chr2:175546822-175547041
  misc_feature 1..219: note = hyper
  source 1..219: mol_type = genomic DNA
tgtctctggagagttcgggggatcaccccccctcaacccccgtccccactccgggcgaaaagcactgaccgggactggagatgtctctaaggtcgacgcagacccctaacgcgcgcgtctacgccgacctggggcgagcgggccgcccgggagggccgggagggaggcgggctggagcgcgggaggggcacggttcccatagacaggcaggcgggcggt

SEQ ID NO: 48574 - DNA, 244 bp, Homo sapiens
  misc_feature 1..244: note = chr2:175547140-175547384
  misc_feature 1..244: note = hyper
  source 1..244: mol_type = genomic DNA
cgagacctacggagatagtgggtcccgagccccacggggcggccccgggtccgcggagtccagcggtgagctcagcccgaggcgcgggacccaggctgtccacggccccttcctccccgggccatcagcgggcagcagaacgcgcgggccgctggcctggaattgcgcccctcccgaggccgcgcgcccgcgcccaccgctcgcaggggacgcggcctcgacgtccccagccgccccacccgcg

SEQ ID NO: 48575 - DNA, 655 bp, Homo sapiens
  misc_feature 1..655: note = chr2:175547413-175548068
  misc_feature 1..655: note = hyper
  source 1..655: mol_type = genomic DNA
ccgccgtcgagcccagcccctcccggcgtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaacttcgccgagatgtgggccctcccctccggcgccgccgcccccccgccgccccgccacatgtggacgcgccgcgaggccccgccggcccgcgccctgccctccgcgcgcccgcctgccccgccagcaatggggctctgcgcctgcagcttcggcccgcagaggatcgcggcggggcgggatggtcggggctggagtccgcagtttcctcagtcccgctcccctgcgcggcgaggggaccgaggcaagaggacaggagtttgcagaggggcgggaactggaaggggagtctagcccagggcctttccccccaactcttgaatcttctccaccttcttgcggctgctggcggggggatcgggtgggggtgttccctctgttcgagccggaaggaacgccttttcccacgctttcccgtctgctctcaaaa

SEQ ID NO: 48576 - DNA, 30 bp, Homo sapiens; identical to SEQ ID NO: 27691
  misc_feature 1..30: note = chr2:176940611-176940641
  misc_feature 1..30: note = hyper
  source 1..30: mol_type = genomic DNA

SEQ ID NO: 48577 - DNA, 199 bp, Homo sapiens
  misc_feature 1..199: note = chr2:176943568-176943767
  misc_feature 1..199: note = hyper
  source 1..199: mol_type = genomic DNA
attattagcatcaaacttgacgtggcagttaacactagtgggttttgatgtacctttcttcaagttcaaggaaacccctccagtagccgggttggcagagcgggtctcagcaacccagcggtggctttgcagaggcgaaggcgcaatagacatgcgtgagaaatatgccaagaaccatttcacccgaggaaaaggaaag

SEQ ID NO: 48578 - DNA, 59 bp, Homo sapiens; identical to SEQ ID NO: 27693
  misc_feature 1..59: note = chr2:176944083-176944142
  misc_feature 1..59: note = hyper
  source 1..59: mol_type = genomic DNA

SEQ ID NO: 48579 - DNA, 59 bp, Homo sapiens; identical to SEQ ID NO: 240
  misc_feature 1..59: note = chr2:176944346-176944405
  misc_feature 1..59: note = hyper
  source 1..59: mol_type = genomic DNA

SEQ ID NO: 48580 - DNA, 562 bp, Homo sapiens
  misc_feature 1..562: note = chr2:176945784-176946346
  misc_feature 1..562: note = hyper
  source 1..562: mol_type = genomic DNA
cccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaatta

SEQ ID NO: 48581 - DNA, 37 bp, Homo sapiens
  misc_feature 1..37: note = chr2:176947903-176947940
  misc_feature 1..37: note = hyper
  source 1..37: mol_type = genomic DNA
agcagaactggaaggcacggtcccagacatgcgtccc

SEQ ID NO: 48582 - DNA, 74 bp, Homo sapiens; identical to SEQ ID NO: 27701
  misc_feature 1..74: note = chr2:176947941-176948015
  misc_feature 1..74: note = hyper
  source 1..74: mol_type = genomic DNA

SEQ ID NO: 48583 - DNA, 303 bp, Homo sapiens
  misc_feature 1..303: note = chr2:176948742-176949045
  misc_feature 1..303: note = hyper
  source 1..303: mol_type = genomic DNA
tacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttag

SEQ ID NO: 48584 - DNA, 46 bp, Homo sapiens; identical to SEQ ID NO: 27703
  misc_feature 1..46: note = chr2:176949372-176949418
  misc_feature 1..46: note = hyper
  source 1..46: mol_type = genomic DNA

SEQ ID NO: 48585 - DNA, 14 bp, Homo sapiens
  misc_feature 1..14: note = chr2:176949681-176949695
  misc_feature 1..14: note = hyper
  source 1..14: mol_type = genomic DNA
tttcctgaggggaa

SEQ ID NO: 48586 - DNA, 133 bp, Homo sapiens
  misc_feature 1..133: note = chr2:176949869-176950002
  misc_feature 1..133: note = hyper
  source 1..133: mol_type = genomic DNA
aaagaggagacagccttcttcccctacctccccgctgccctcccttcccctttgcttttcttccttctctctttcctcccctcatcaaccccagccccttacctgcggccacaggtattcccagcgttgggtc

SEQ ID NO: 48587 - DNA, 68 bp, Homo sapiens; identical to SEQ ID NO: 17784
  misc_feature 1..68: note = chr2:176950074-176950142
  misc_feature 1..68: note = hyper
  source 1..68: mol_type = genomic DNA

SEQ ID NO: 48588 - skipped

SEQ ID NO: 48589 - DNA, 352 bp, Homo sapiens; identical to SEQ ID NO: 27706
  misc_feature 1..352: note = chr2:176952741-176953093
  misc_feature 1..352: note = hyper
  source 1..352: mol_type = genomic DNA

SEQ ID NO: 48590 - DNA, 216 bp, Homo sapiens
  misc_feature 1..216: note = chr2:176957199-176957415
  misc_feature 1..216: note = hyper
  source 1..216: mol_type = genomic DNA
ggggggagggcgggaatgggaggtggaccctgcaaggggcaggagaggggtgggggccggagtgggtgggtccagccaggcctgggccgggagccaggctcccccgcgttcctacccccacgtggccgcgcgcagccaatggcacgcccccggcgggggccctcggggcgggaggcggccccccgaccggcccaggccccctcccaacctgaactt

SEQ ID NO: 48591 - DNA, 219 bp, Homo sapiens
  misc_feature 1..219: note = chr2:176957919-176958138
  misc_feature 1..219: note = hyper
  source 1..219: mol_type = genomic DNA
ctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctgg

SEQ ID NO: 48592 - DNA, 141 bp, Homo sapiens
  misc_feature 1..141: note = chr2:176959148-176959289
  misc_feature 1..141: note = hyper
  source 1..141: mol_type = genomic DNA
ctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagct

SEQ ID NO: 48593 - DNA, 65 bp, Homo sapiens; identical to SEQ ID NO: 27711
  misc_feature 1..65: note = chr2:176963189-176963254
  misc_feature 1..65: note = hyper
  source 1..65: mol_type = genomic DNA

SEQ ID NO: 48594 - DNA, 127 bp, Homo sapiens
  misc_feature 1..127: note = chr2:176963321-176963448
  misc_feature 1..127: note = hyper
  source 1..127: mol_type = genomic DNA
cgagggtcctgctgcaggctgagactggcgccggtcaccgggtctcccagggtcttgggatcagaggcaggaggggaggacccctagtcctctggccggactaggcaagagggccagcgacggggtc

SEQ ID NO: 48595 - DNA, 175 bp, Homo sapiens
  misc_feature 1..175: note = chr2:176963522-176963697
  misc_feature 1..175: note = hyper
  source 1..175: mol_type = genomic DNA
cccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttg

SEQ ID NO: 48596 - skipped

SEQ ID NO: 48597 - DNA, 18 bp, Homo sapiens
  misc_feature 1..18: note = chr2:176965492-176965510
  misc_feature 1..18: note = hyper
  source 1..18: mol_type = genomic DNA
gcgcgtggccagggccgg

SEQ ID NO: 48598 - DNA, 207 bp, Homo sapiens
  misc_feature 1..207: note = chr2:176969256-176969463
  misc_feature 1..207: note = hyper
  source 1..207: mol_type = genomic DNA
cggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctg

SEQ ID NO: 48599 - DNA, 68 bp, Homo sapiens; identical to SEQ ID NO: 27718
  misc_feature 1..68: note = chr2:176970219-176970287
  misc_feature 1..68: note = hyper
  source 1..68: mol_type = genomic DNA

SEQ ID NO: 48600 - DNA, 30 bp, Homo sapiens; identical to SEQ ID NO: 27719
  misc_feature 1..30: note = chr2:176970603-176970633
  misc_feature 1..30: note = hyper
  source 1..30: mol_type = genomic DNA

SEQ ID NO: 48601 - DNA, 95 bp, Homo sapiens; identical to SEQ ID NO: 27720
  misc_feature 1..95: note = chr2:176971337-176971432
  misc_feature 1..95: note = hyper
  source 1..95: mol_type = genomic DNA

SEQ ID NO: 48602 - DNA, 216 bp, Homo sapiens; identical to SEQ ID NO: 27721
  misc_feature 1..216: note = chr2:176972742-176972958
  misc_feature 1..216: note = hyper
  source 1..216: mol_type = genomic DNA

SEQ ID NO: 48603 - DNA, 30 bp, Homo sapiens; identical to SEQ ID NO: 27722
  misc_feature 1..30: note = chr2:176974082-176974112
  misc_feature 1..30: note = hyper
  source 1..30: mol_type = genomic DNA

SEQ ID NO: 48604 - DNA, 67 bp, Homo sapiens
  misc_feature 1..67: note = chr2:176982517-176982584
  misc_feature 1..67: note = hyper
  source 1..67: mol_type = genomic DNA
cgcccgggcagaggaaaagcttgccggttttatttttcctgagctagacctgaacacaacaaaagag

SEQ ID NO: 48605 - DNA, 30 bp, Homo sapiens; identical to SEQ ID NO: 6548
  misc_feature 1..30: note = chr2:176983753-176983783
  misc_feature 1..30: note = hyper
  source 1..30: mol_type = genomic DNA

SEQ ID NO: 48606 - skipped

SEQ ID NO: 48607 - DNA, 209 bp, Homo sapiens; identical to SEQ ID NO: 17795
  misc_feature 1..209: note = chr2:176986848-176987057
  misc_feature 1..209: note = hyper
  source 1..209: mol_type = genomic DNA

SEQ ID NO: 48608 - DNA, 83 bp, Homo sapiens
  misc_feature 1..83: note = chr2:176993464-176993547
  misc_feature 1..83: note = hyper
  source 1..83: mol_type = genomic DNA
gctttgggaaaaattcgtaactttgaggcctgcgcgctctctcggcagtaatttcacaggcttggcggaggaagtaggatcgt

SEQ ID NO: 48609 - DNA, 176 bp, Homo sapiens
  misc_feature 1..176: note = chr2:176993855-176994031
  misc_feature 1..176: note = hyper
  source 1..176: mol_type = genomic DNA
tctatcaagggtgaaatgatggaaactatattcatgggcatgatttccattaaatatcaattaacctgagagcctcggccaggcttgcggtgcgtcaagggtaaatgtacatctcatttccacagggcccgctcggctggaaaagaaaggctttgatttgctttgataacgccagg

SEQ ID NO: 48610 - DNA, 38 bp, Homo sapiens; identical to SEQ ID NO: 6554
  misc_feature 1..38: note = chr2:176996261-176996299
  misc_feature 1..38: note = hyper
  source 1..38: mol_type = genomic DNA

SEQ ID NO: 48611 - DNA, 185 bp, Homo sapiens; identical to SEQ ID NO: 27734
  misc_feature 1..185: note = chr2:176997536-176997721
  misc_feature 1..185: note = hyper
  source 1..185: mol_type = genomic DNA

SEQ ID NO: 48612 - DNA, 43 bp, Homo sapiens; identical to SEQ ID NO: 27735
  misc_feature 1..43: note = chr2:177000770-177000813
  misc_feature 1..43: note = hyper
  source 1..43: mol_type = genomic DNA

SEQ ID NO: 48613 - DNA, 72 bp, Homo sapiens
  misc_feature 1..72: note = chr2:177001976-177002048
  misc_feature 1..72: note = hyper
  source 1..72: mol_type = genomic DNA
aggatcccactgcctagatggagagcccctcaatcctaccctaggaaagtgtatagacgggttactactgaa

SEQ ID NO: 48614 - DNA, 320 bp, Homo sapiens; identical to SEQ ID NO: 27739
  misc_feature 1..320: note = chr2:177003734-177004054
  misc_feature 1..320: note = hyper
  source 1..320: mol_type = genomic DNA

SEQ ID NO: 48615 - DNA, 48 bp, Homo sapiens; identical to SEQ ID NO: 27740
  misc_feature 1..48: note = chr2:177004450-177004498
  misc_feature 1..48: note = hyper
  source 1..48: mol_type = genomic DNA

SEQ ID NO: 48616 - DNA, 11 bp, Homo sapiens
  misc_feature 1..11: note = chr2:177004555-177004566
  misc_feature 1..11: note = hyper
  source 1..11: mol_type = genomic DNA
cgcatgtgcag

SEQ ID NO: 48617 - DNA, 48 bp, Homo sapiens
  misc_feature 1..48: note = chr2:177004658-177004706
  misc_feature 1..48: note = hyper
  source 1..48: mol_type = genomic DNA
acccgatctttccattctccctccgtcaaggctcgctactcatcttgc

SEQ ID NO: 48618 - DNA, 697 bp, Homo sapiens; identical to SEQ ID NO: 27742
  misc_feature 1..697: note = chr2:177004982-177005679
  misc_feature 1..697: note = hyper
  source 1..697: mol_type = genomic DNA

SEQ ID NO: 48619 - DNA, 224 bp, Homo sapiens; identical to SEQ ID NO: 27743
  misc_feature 1..224: note = chr2:177042579-177042803
  misc_feature 1..224: note = hyper
  source 1..224: mol_type = genomic DNA

SEQ ID NO: 48620 - DNA, 71 bp, Homo sapiens
  misc_feature 1..71: note = chr2:177042913-177042984
  misc_feature 1..71: note = hyper
  source 1..71: mol_type = genomic DNA
cggccaggctgcgggcggggtgggctggcgctcctgatccacctggaacacttttgcaaagacagacggtg

SEQ ID NO: 48621 - DNA, 41 bp, Homo sapiens
  misc_feature 1..41: note = chr2:177043515-177043556
  misc_feature 1..41: note = hyper
  source 1..41: mol_type = genomic DNA
aataccgctctacacccagagagggacgaatacacctctga

SEQ ID NO: 48622 - DNA, 132 bp, Homo sapiens; identical to SEQ ID NO: 27746
  misc_feature 1..132: note = chr2:177052963-177053095
  misc_feature 1..132: note = hyper
  source 1..132: mol_type = genomic DNA

SEQ ID NO: 48623 - DNA, 48 bp, Homo sapiens; identical to SEQ ID NO: 27749
  misc_feature 1..48: note = chr2:177053906-177053954
  misc_feature 1..48: note = hyper
  source 1..48: mol_type = genomic DNA

SEQ ID NO: 48624 - DNA, 114 bp, Homo sapiens; identical to SEQ ID NO: 17803
  misc_feature 1..114: note = chr2:177053999-177054113
  misc_feature 1..114: note = hyper
  source 1..114: mol_type = genomic DNA

SEQ ID NO: 48625 - DNA, 12 bp, Homo sapiens
  misc_feature 1..12: note = chr2:177054351-177054363
  misc_feature 1..12: note = hyper
  source 1..12: mol_type = genomic DNA
aaaatgtgccag

SEQ ID NO: 48626 - DNA, 42 bp, Homo sapiens; identical to SEQ ID NO: 27751
  misc_feature 1..42: note = chr2:177502246-177502288
  misc_feature 1..42: note = hyper
  source 1..42: mol_type = genomic DNA

SEQ ID NO: 48627 - DNA, 374 bp, Homo sapiens; identical to SEQ ID NO: 27752
  misc_feature 1..374: note = chr2:177502526-177502900
  misc_feature 1..374: note = hyper
  source 1..374: mol_type = genomic DNA

SEQ ID NO: 48628 - DNA, 441 bp, Homo sapiens; identical to SEQ ID NO: 27753
  misc_feature 1..441: note = chr2:179278428-179278869
  misc_feature 1..441: note = hyper
  source 1..441: mol_type = genomic DNA

SEQ ID NO: 48629 - DNA, 487 bp, Homo sapiens; identical to SEQ ID NO: 6570
  misc_feature 1..487: note = chr2:180725172-180725659
  misc_feature 1..487: note = hyper
  source 1..487: mol_type = genomic DNA

SEQ ID NO: 48630 - DNA, 146 bp, Homo sapiens; identical to SEQ ID NO: 27755
  misc_feature 1..146: note = chr2:180725935-180726081
  misc_feature 1..146: note = hyper
  source 1..146: mol_type = genomic DNA

SEQ ID NO: 48631 - DNA, 30 bp, Homo sapiens; identical to SEQ ID NO: 27756
  misc_feature 1..30: note = chr2:180726333-180726363
  misc_feature 1..30: note = hyper
  source 1..30: mol_type = genomic DNA

SEQ ID NO: 48632 - DNA, 58 bp, Homo sapiens; identical to SEQ ID NO: 27757
  misc_feature 1..58: note = chr2:180726645-180726703
  misc_feature 1..58: note = hyper
  source 1..58: mol_type = genomic DNA

SEQ ID NO: 48633 - DNA, 79 bp, Homo sapiens; identical to SEQ ID NO: 27759
  misc_feature 1..79: note = chr2:182321759-182321838
  misc_feature 1..79: note = hyper
  source 1..79: mol_type = genomic DNA

SEQ ID NO: 48634 - DNA, 22 bp, Homo sapiens
  misc_feature 1..22: note = chr2:182322170-182322192
  misc_feature 1..22: note = hyper
  source 1..22: mol_type = genomic DNA
gcgagtgcgcggcatcccaggc

SEQ ID NO: 48635 - DNA, 242 bp, Homo sapiens; identical to SEQ ID NO: 27762
  misc_feature 1..242: note = chr2:182521404-182521646
  misc_feature 1..242: note = hyper
  source 1..242: mol_type = genomic DNA

SEQ ID NO: 48636 - DNA, 37 bp, Homo sapiens; identical to SEQ ID NO: 27763
  misc_feature 1..37: note = chr2:182542469-182542506
  misc_feature 1..37: note = hyper
  source 1..37: mol_type = genomic DNA

SEQ ID NO: 48637 - DNA, 25 bp, Homo sapiens
  misc_feature 1..25: note = chr2:182542878-182542903
  misc_feature 1..25: note = hyper
  source 1..25: mol_type = genomic DNA
agctgtccatggtaccgtaaggcgg

SEQ ID NO: 48638 - DNA, 385 bp, Homo sapiens; identical to SEQ ID NO: 17813
  misc_feature 1..385: note = chr2:182542933-182543318
  misc_feature 1..385: note = hyper
  source 1..385: mol_type = genomic DNA

SEQ ID NO: 48639 - skipped

SEQ ID NO: 48640 - DNA, 177 bp, Homo sapiens
  misc_feature 1..177: note = chr2:182543925-182544102
  misc_feature 1..177: note = hyper
  source 1..177: mol_type = genomic DNA
tgtggaaatgactgtacatttcagcgacttcatgtttatccaaatgtgttcaaagttactcacaactccataaaaaaaaaaaaaagctgtaaaatcacacattctacttccatttctgtcctggcttccagatacttagcgatttaagttgaacagccattgcgtaatttactaata

SEQ ID NO: 48641 - DNA, 30 bp, Homo sapiens; identical to SEQ ID NO: 27766
  misc_feature 1..30: note = chr2:182544495-182544525
  misc_feature 1..30: note = hyper
  source 1..30: mol_type = genomic DNA

SEQ ID NO: 48642 - DNA, 14 bp, Homo sapiens
  misc_feature 1..14: note = chr2:182545197-182545211
  misc_feature 1..14: note = hyper
  source 1..14: mol_type = genomic DNA
cctggggcctccgg

SEQ ID NO: 48643 - DNA, 264 bp, Homo sapiens
  misc_feature 1..264: note = chr2:182545275-182545539
  misc_feature 1..264: note = hyper
  source 1..264: mol_type = genomic DNA
gcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacc

SEQ ID NO: 48644 - DNA, 254 bp, Homo sapiens
  misc_feature 1..254: note = chr2:182545694-182545948
  misc_feature 1..254: note = hyper
  source 1..254: mol_type = genomic DNA
gaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattgg

SEQ ID NO: 48645 - DNA, 47 bp, Homo sapiens
  misc_feature 1..47: note = chr2:182546388-182546435
  misc_feature 1..47: note = hyper
  source 1..47: mol_type = genomic DNA
gttccctggccagcccgccctggacggcctcggctctctagtccagg

SEQ ID NO: 48646 - DNA, 70 bp, Homo sapiens
  misc_feature 1..70: note = chr2:182546465-182546535
  misc_feature 1..70: note = hyper
  source 1..70: mol_type = genomic DNA
cgccacagccggacctgcgctcttgctcccctcagtctcgggtctgtataagatacttgattcagacaag

SEQ ID NO: 48647 - DNA, 186 bp, Homo sapiens
  misc_feature 1..186: note = chr2:182547199-182547385
  misc_feature 1..186: note = hyper
  source 1..186: mol_type = genomic DNA
acttggctgacaaagcgcataggggaggataaaataattcacccaggagcctgggcccaggatttacccctgtactgtctgtatcttcagtgttgggctaaaactcgagggcgtcggagtactagcccttagaagatagtacacagcccgacgtttgcggcagggccaggttaagtactgcccctc

SEQ ID NO: 48648 - DNA, 319 bp, Homo sapiens; identical to SEQ ID NO: 17817
  misc_feature 1..319: note = chr2:182547613-182547932
  misc_feature 1..319: note = hyper
  source 1..319: mol_type = genomic DNA

SEQ ID NO: 48649 - DNA, 389 bp, Homo sapiens; identical to SEQ ID NO: 27773
  misc_feature 1..389: note = chr2:182548400-182548789
  misc_feature 1..389: note = hyper
  source 1..389: mol_type = genomic DNA

SEQ ID NO: 48650 - DNA, 207 bp, Homo sapiens; identical to SEQ ID NO: 27774
  misc_feature 1..207: note = chr2:182548819-182549026
  misc_feature 1..207: note = hyper
  source 1..207: mol_type = genomic DNA

SEQ ID NO: 48651 - DNA, 51 bp, Homo sapiens
  misc_feature 1..51: note = chr2:182549037-182549088
  misc_feature 1..51: note = hyper
  source 1..51: mol_type = genomic DNA
cgcctccgccccgggggaggcagttgggctcccgggtcctggcctgaggct

SEQ ID NO: 48652 - DNA, 203 bp, Homo sapiens; identical to SEQ ID NO: 17821
  misc_feature 1..203: note = chr2:182549134-182549337
  misc_feature 1..203: note = hyper
  source 1..203: mol_type = genomic DNA

SEQ ID NO: 48653 - DNA, 91 bp, Homo sapiens
  misc_feature 1..91: note = chr2:182549454-182549545
  misc_feature 1..91: note = hyper
  source 1..91: mol_type = genomic DNA
ttggaaggacttgtctctgattccctgtcaggatccaggggctttccttaaaccatccaacactcagaatcaacaacgtaaaatcaactca

SEQ ID NO: 48654 - DNA, 131 bp, Homo sapiens; identical to SEQ ID NO: 27776
  misc_feature 1..131: note = chr2:182549876-182550007
  misc_feature 1..131: note = hyper
  source 1..131: mol_type = genomic DNA

SEQ ID NO: 48655 - DNA, 41 bp, Homo sapiens
  misc_feature 1..41: note = chr2:182550053-182550094
  misc_feature 1..41: note = hyper
  source 1..41: mol_type = genomic DNA
cggcgccggagcgtcgcaagaacaatggttgctgcagtggg

SEQ ID NO: 48656 - DNA, 18 bp, Homo sapiens
  misc_feature 1..18: note = chr2:182819030-182819048
  misc_feature 1..18: note = hyper
  source 1..18: mol_type = genomic DNA
gcgcgcacacacacacac

SEQ ID NO: 48657 - DNA, 133 bp, Homo sapiens; identical to SEQ ID NO: 17822
  misc_feature 1..133: note = chr2:182819216-182819349
  misc_feature 1..133: note = hyper
  source 1..133: mol_type = genomic DNA

SEQ ID NO: 48658 - DNA, 121 bp, Homo sapiens
  misc_feature 1..121: note = chr2:183731173-183731294
  misc_feature 1..121: note = hyper
  source 1..121: mol_type = genomic DNA
tcacaggctgcagcccgagccccgggcacccggagcaggcagagagcagccagggcaagcagcccggcccgcagcagcagcatccctcccgggctgccgcagaccatgatcccggcaggat

SEQ ID NO: 48659 - DNA, 285 bp, Homo sapiens; identical to SEQ ID NO: 17824
  misc_feature 1..285: note = chr2:183731524-183731809
  misc_feature 1..285: note = hyper
  source 1..285: mol_type = genomic DNA

SEQ ID NO: 48660 - DNA, 30 bp, Homo sapiens; identical to SEQ ID NO: 17825
  misc_feature 1..30: note = chr2:183732076-183732106
  misc_feature 1..30: note = hyper
  source 1..30: mol_type = genomic DNA

SEQ ID NO: 48661 - DNA, 230 bp, Homo sapiens
  misc_feature 1..230: note = chr2:185462639-185462869
  misc_feature 1..230: note = hyper
  source 1..230: mol_type = genomic DNA
acaactaccctcccccgaaactatcatcaacacaagcacttacggtatctacaaatgtgtgggagcaggggtgggtggggggcatattttctttcctcgcctttccctaagactgaacagggtaccagcctccataccaaacacacattaaataacaaaatcaaataagccaaacccagtggatagcaattatcttgagaaagaagccgctgctggcaccggcctggatt

SEQ ID NO: 48662 - DNA, 213 bp, Homo sapiens
  misc_feature 1..213: note = chr2:185462980-185463193
  misc_feature 1..213: note = hyper
  source 1..213: mol_type = genomic DNA
ctctccgcccccaccttccaggagtctcccacttggcggtggccgtcgcgtccccggccctctgcggcagcggcgccgcgcggggcgctcccactcgcgctcgggctggcgcggccgcgggtcccggcggcggggtgggcgggggaggcagcgggtgacagatgtactcctctgacagctctcagtatcagcccagtggctccctgccattgg

SEQ ID NO: 48663 - DNA, 45 bp, Homo sapiens
  misc_feature 1..45: note = chr2:186603443-186603488
  misc_feature 1..45: note = hyper
  source 1..45: mol_type = genomic DNA
ccctcaggaggccaccgcccttctggggccgctaccattggaagc

SEQ ID NO: 48664 - DNA, 135 bp, Homo sapiens
  misc_feature 1..135: note = chr2:186603518-186603653
  misc_feature 1..135: note = hyper
  source 1..135: mol_type = genomic DNA
tgggctctggccattcctggtcaggtccggacagagggacaacggggtgctagagaaggagagcggggcgggtgaggaaggggctgagggggctgtgccggccatggagctgtacctcggcgcctgctccaagcc

SEQ ID NO: 48665 - DNA, 210 bp, Homo sapiens; identical to SEQ ID NO: 27783
  misc_feature 1..210: note = chr2:189156634-189156844
  misc_feature 1..210: note = hyper
  source 1..210: mol_type = genomic DNA

SEQ ID NO: 48666 - DNA, 75 bp, Homo sapiens; identical to SEQ ID NO: 27784
  misc_feature 1..75: note = chr2:190445180-190445255
  misc_feature 1..75: note = hyper
  source 1..75: mol_type = genomic DNA

SEQ ID NO: 48667 - DNA, 61 bp, Homo sapiens; identical to SEQ ID NO: 27785
  misc_feature 1..61: note = chr2:191045133-191045194
  misc_feature 1..61: note = hyper
  source 1..61: mol_type = genomic DNA

SEQ ID NO: 48668 - DNA, 32 bp, Homo sapiens; identical to SEQ ID NO: 27786
  misc_feature 1..32: note = chr2:192015371-192015403
  misc_feature 1..32: note = hyper
  source 1..32: mol_type = genomic DNA

SEQ ID NO: 48669 - DNA, 14 bp, Homo sapiens
  misc_feature 1..14: note = chr2:193059011-193059025
  misc_feature 1..14: note = hyper
  source 1..14: mol_type = genomic DNA
ggtctgtgctggat

SEQ ID NO: 48670 - DNA, 318 bp, Homo sapiens; identical to SEQ ID NO: 17829
  misc_feature 1..318: note = chr2:193060067-193060385
  misc_feature 1..318: note = hyper
  source 1..318: mol_type = genomic DNA

SEQ ID NO: 48671 - DNA, 242 bp, Homo sapiens
  misc_feature 1..242: note = chr2:193060441-193060683
  misc_feature 1..242: note = hyper
  source 1..242: mol_type = genomic DNA
ctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcggg

SEQ ID NO: 48672 - DNA, 55 bp, Homo sapiens; identical to SEQ ID NO: 17831
  misc_feature 1..55: note = chr2:193060891-193060946
  misc_feature 1..55: note = hyper
  source 1..55: mol_type = genomic DNA

SEQ ID NO: 48673 - DNA, 1078 bp, Homo sapiens; identical to SEQ ID NO: 27791
  misc_feature 1..1078: note = chr2:197457183-197458261
  misc_feature 1..1078: note = hyper
  source 1..1078: mol_type = genomic DNA

SEQ ID NO: 48674 - DNA, 90 bp, Homo sapiens; identical to SEQ ID NO: 27792
  misc_feature 1..90: note = chr2:198651504-198651594
  misc_feature 1..90: note = hyper
  source 1..90: mol_type = genomic DNA

SEQ ID NO: 48675 - DNA, 35 bp, Homo sapiens; identical to SEQ ID NO: 27793
  misc_feature 1..35: note = chr2:198670222-198670257
  misc_feature 1..35: note = hyper
  source 1..35: mol_type = genomic DNA

SEQ ID NO: 48676 - DNA, 60 bp, Homo sapiens; identical to SEQ ID NO: 27794
  misc_feature 1..60: note = chr2:200321938-200321998
  misc_feature 1..60: note = hyper
  source 1..60: mol_type = genomic DNA

SEQ ID NO: 48677 - DNA, 219 bp, Homo sapiens; identical to SEQ ID NO: 27796
  misc_feature 1..219: note = chr2:200327575-200327794
  misc_feature 1..219: note = hyper
  source 1..219: mol_type = genomic DNA

SEQ ID NO: 48678 - DNA, 133 bp, Homo sapiens; identical to SEQ ID NO: 27797
  misc_feature 1..133: note = chr2:200328171-200328304
  misc_feature 1..133: note = hyper
  source 1..133: mol_type = genomic DNA

SEQ ID NO: 48679 - DNA, 18 bp, Homo sapiens
  misc_feature 1..18: note = chr2:200328667-200328685
  misc_feature 1..18: note = hyper
  source 1..18: mol_type = genomic DNA
gaggctatgggcccacgc

SEQ ID NO: 48680 - DNA, 77 bp, Homo sapiens
  misc_feature 1..77: note = chr2:200329668-200329745
  misc_feature 1..77: note = hyper
  source 1..77: mol_type = genomic DNA
tcggcgtcacgcgtccaaccctggggctgatttaaataactaataagctcagagaaattttacgaggggaacttttc

SEQ ID NO: 48681 - DNA, 15 bp, Homo sapiens
  misc_feature 1..15: note = chr2:200333744-200333759
  misc_feature 1..15: note = hyper
  source 1..15: mol_type = genomic DNA
gtctgcgtgcctcac

SEQ ID NO: 48682 - DNA, 30 bp, Homo sapiens; identical to SEQ ID NO: 6604
  misc_feature 1..30: note = chr2:200334190-200334220
  misc_feature 1..30: note = hyper
  source 1..30: mol_type = genomic DNA

SEQ ID NO: 48683 - DNA, 82 bp, Homo sapiens; identical to SEQ ID NO: 6607
  misc_feature 1..82: note = chr2:200336264-200336346
  misc_feature 1..82: note = hyper
  source 1..82: mol_type = genomic DNA

SEQ ID NO: 48684 - DNA, 81 bp, Homo sapiens; identical to SEQ ID NO: 27808
  misc_feature 1..81: note = chr2:200524136-200524217
  misc_feature 1..81: note = hyper
  source 1..81: mol_type = genomic DNA

SEQ ID NO: 48685 - DNA, 66 bp, Homo sapiens; identical to SEQ ID NO: 17839
  misc_feature 1..66: note = chr2:201450490-201450556
  misc_feature 1..66: note = hyper
  source 1..66: mol_type = genomic DNA

SEQ ID NO: 48686 - DNA, 36 bp, Homo sapiens
  misc_feature 1..36: note = chr2:201450707-201450743
  misc_feature 1..36: note = hyper
  source 1..36: mol_type = genomic DNA
ggactttaggctccagcaagccccgccccactcggc

SEQ ID NO: 48687 - DNA, 178 bp, Homo sapiens; identical to SEQ ID NO: 27810
  misc_feature 1..178: note = chr2:201450744-201450922
  misc_feature 1..178: note = hyper
  source 1..178: mol_type = genomic DNA

SEQ ID NO: 48688 - DNA, 38 bp, Homo sapiens
  misc_feature 1..38: note = chr2:201451040-201451078
  misc_feature 1..38: note = hyper
  source 1..38: mol_type = genomic DNA
gcctccggggcagctaaaggctgcgttttcagggactg

SEQ ID NO: 48689 - DNA, 147 bp, Homo sapiens
  misc_feature 1..147: note = chr2:202899715-202899862
  misc_feature 1..147: note = hyper
  source 1..147: mol_type = genomic DNA
gccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaac

SEQ ID NO: 48690 - DNA, 77 bp, Homo sapiens
  misc_feature 1..77: note = chr2:202899891-202899968
  misc_feature 1..77: note = hyper
  source 1..77: mol_type = genomic DNA
cggccccactgcctaccctaccgcgccctacctgccggacctgcccttcaccgcgctgcccccgggggcctcagatg

SEQ ID NO: 48691 - DNA, 30 bp, Homo sapiens; identical to SEQ ID NO: 27813
  misc_feature 1..30: note = chr2:206546689-206546719
  misc_feature 1..30: note = hyper
  source 1..30: mol_type = genomic DNA

SEQ ID NO: 48692 - DNA, 30 bp, Homo sapiens; identical to SEQ ID NO: 27814
  misc_feature 1..30: note = chr2:206550029-206550059
  misc_feature 1..30: note = hyper
  source 1..30: mol_type = genomic DNA

SEQ ID NO: 48693 - DNA, 429 bp, Homo sapiens; identical to SEQ ID NO: 27815
  misc_feature 1..429: note = chr2:206550262-206550691
  misc_feature 1..429: note = hyper
  source 1..429: mol_type = genomic DNA

SEQ ID NO: 48694 - DNA, 42 bp, Homo sapiens; identical to SEQ ID NO: 27816
  misc_feature 1..42: note = chr2:206550973-206551015
  misc_feature 1..42: note = hyper
  source 1..42: mol_type = genomic DNA

SEQ ID NO: 48695 - DNA, 24 bp, Homo sapiens
  misc_feature 1..24: note = chr2:206551450-206551474
  misc_feature 1..24: note = hyper
  source 1..24: mol_type = genomic DNA
cggcttctgcggctccggctgaat

SEQ ID NO: 48696 - DNA, 22 bp, Homo sapiens
  misc_feature 1..22: note = chr2:207139050-207139072
  misc_feature 1..22: note = hyper
  source 1..22: mol_type = genomic DNA
tagctctcttagccccgttttc

SEQ ID NO: 48697 - DNA, 53 bp, Homo sapiens
  misc_feature 1..53: note = chr2:207139102-207139155
  misc_feature 1..53: note = hyper
  source 1..53: mol_type = genomic DNA
gcaagcagtttttatttggaccctcaaacgctaaaaccttggtctctacttcg

SEQ ID NO: 48698 - DNA, 130 bp, Homo sapiens; identical to SEQ ID NO: 17843
  misc_feature 1..130: note = chr2:207139217-207139347
  misc_feature 1..130: note = hyper
  source 1..130: mol_type = genomic DNA

SEQ ID NO: 48699 - DNA, 218 bp, Homo sapiens; identical to SEQ ID NO: 17844
  misc_feature 1..218: note = chr2:207139605-207139823
  misc_feature 1..218: note = hyper
  source 1..218: mol_type = genomic DNA

SEQ ID NO: 48700 - DNA, 120 bp, Homo sapiens; identical to SEQ ID NO: 27821
  misc_feature 1..120: note = chr2:207140044-207140164
  misc_feature 1..120: note = hyper
  source 1..120: mol_type = genomic DNA

SEQ ID NO: 48701 - DNA, 15 bp, Homo sapiens
  misc_feature 1..15: note = chr2:207307463-207307478
  misc_feature 1..15: note = hyper
  source 1..15: mol_type = genomic DNA
tctgtattgcttccc

SEQ ID NO: 48702 - DNA, 1240 bp, Homo sapiens
  misc_feature 1..1240: note = chr2:207307562-207308802
  misc_feature 1..1240: note = hyper
  source 1..1240: mol_type = genomic DNA
tcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccag

SEQ ID NO: 48703 - DNA, 63 bp, Homo sapiens; identical to SEQ ID NO: 17850
  misc_feature 1..63: note = chr2:207308857-207308920
  misc_feature 1..63: note = hyper
  source 1..63: mol_type = genomic DNA

SEQ ID NO: 48704 - DNA, 30 bp, Homo sapiens; identical to SEQ ID NO: 27824
  misc_feature 1..30: note = chr2:207309199-207309229
  misc_feature 1..30: note = hyper
  source 1..30: mol_type = genomic DNA

SEQ ID NO: 48705 - DNA, 60 bp, Homo sapiens; identical to SEQ ID NO: 27826
  misc_feature 1..60: note = chr2:208030115-208030175
  misc_feature 1..60: note = hyper
  source 1..60: mol_type = genomic DNA

SEQ ID NO: 48706 - DNA, 87 bp, Homo sapiens; identical to SEQ ID NO: 27827
  misc_feature 1..87: note = chr2:208546197-208546284
  misc_feature 1..87: note = hyper
  source 1..87: mol_type = genomic DNA

SEQ ID NO: 48707 - DNA, 30 bp, Homo sapiens; identical to SEQ ID NO: 27828
  misc_feature 1..30: note = chr2:208633276-208633306
  misc_feature 1..30: note = hyper
  source 1..30: mol_type = genomic DNA

SEQ ID NO: 48708 - skipped

SEQ ID NO: 48709 - DNA, 31 bp, Homo sapiens; identical to SEQ ID NO: 27834
  misc_feature 1..31: note = chr2:210636933-210636964
  misc_feature 1..31: note = hyper
  source 1..31: mol_type = genomic DNA

SEQ ID NO: 48710 - DNA, 170 bp, Homo sapiens; identical to SEQ ID NO: 27835
  misc_feature 1..170: note = chr2:211089565-211089735
  misc_feature 1..170: note = hyper
  source 1..170: mol_type = genomic DNA

SEQ ID NO: 48711 - DNA, 30 bp, Homo sapiens; identical to SEQ ID NO: 27836
  misc_feature 1..30: note = chr2:211090029-211090059
  misc_feature 1..30: note = hyper
  source 1..30: mol_type = genomic DNA

SEQ ID NO: 48712 - DNA, 226 bp, Homo sapiens
  misc_feature 1..226: note = chr2:213401339-213401565
  misc_feature 1..226: note = hyper
  source 1..226: mol_type = genomic DNA
gtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtc

SEQ ID NO: 48713 - DNA, 47 bp, Homo sapiens
  misc_feature 1..47: note = chr2:213401566-213401613
  misc_feature 1..47: note = hyper
  source 1..47: mol_type = genomic DNA
ccaatgcctttgaatgggtcaatgtgcataatcaacccattgaggga

SEQ ID NO: 48714 - DNA, 423 bp, Homo sapiens; identical to SEQ ID NO: 17853
  misc_feature 1..423: note = chr2:213402687-213403110
  misc_feature 1..423: note = hyper
  source 1..423: mol_type = genomic DNA

SEQ ID NO: 48715 - DNA, 237 bp, Homo sapiens
  misc_feature 1..237: note = chr2:213403337-213403574
  misc_feature 1..237: note = hyper
  source 1..237: mol_type = genomic DNA
agccgggcgcgcgtgggggtgcgaggggggcgggcgcggcgcgcgcggtgtggcgactcccagggcgggcgaccgagtccgcgcccgcgggtccagggccggggcccgaggagggggcgagtgtgagcgcgtgtgtgcgcgtgtgggagtgtgctcggtgtgtgcgcttggcgctctgggccggactgtgcagctatttccccgcgtgagccttcgcttgctcgctccctcctcact

SEQ ID NO: 48716 - DNA, 88 bp, Homo sapiens; identical to SEQ ID NO: 6628
  misc_feature 1..88: note = chr2:213403913-213404001
  misc_feature 1..88: note = hyper
  source 1..88: mol_type = genomic DNA

SEQ ID NO: 48717 - DNA, 81 bp, Homo sapiens; identical to SEQ ID NO: 27841
  misc_feature 1..81: note = chr2:216300213-216300294
  misc_feature 1..81: note = hyper
  source 1..81: mol_type = genomic DNA

SEQ ID NO: 48718 - DNA, 261 bp, Homo sapiens; identical to SEQ ID NO: 27842
  misc_feature 1..261: note = chr2:216301526-216301787
  misc_feature 1..261: note = hyper
  source 1..261: mol_type = genomic DNA

SEQ ID NO: 48719 - DNA, 55 bp, Homo sapiens; identical to SEQ ID NO: 27843
  misc_feature 1..55: note = chr2:217236010-217236065
  misc_feature 1..55: note = hyper
  source 1..55: mol_type = genomic DNA

SEQ ID NO: 48720 - DNA, 69 bp, Homo sapiens; identical to SEQ ID NO: 27844
  misc_feature 1..69: note = chr2:217237047-217237116
  misc_feature 1..69: note = hyper
  source 1..69: mol_type = genomic DNA

SEQ ID NO: 48721 - DNA, 182 bp, Homo sapiens; identical to SEQ ID NO: 27845
  misc_feature 1..182: note = chr2:217497788-217497970
  misc_feature 1..182: note = hyper
  source 1..182: mol_type = genomic DNA

SEQ ID NO: 48722 - DNA, 71 bp, Homo sapiens; identical to SEQ ID NO: 27846
  misc_feature 1..71: note = chr2:217557250-217557321
  misc_feature 1..71: note = hyper
  source 1..71: mol_type = genomic DNA

SEQ ID NO: 48723 - DNA, 392 bp, Homo sapiens
  misc_feature 1..392: note = chr2:217558904-217559296
  misc_feature 1..392: note = hyper
  source 1..392: mol_type = genomic DNA
agtagggggagggggcgggcaacgtgtgggtaggaggaaggagaaagagcgaaagctgggatagactcggctagacagttcccccgggtagcaggatcctccagggctccaattccggggtgcaaggaccctccccgactactcccgagctgcaccccagctcgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgc

SEQ ID NO: 48724 - DNA, 198 bp, Homo sapiens
  misc_feature 1..198: note = chr2:217559326-217559524
  misc_feature 1..198: note = hyper
  source 1..198: mol_type = genomic DNA
tcatgcagcagccgcagcccggctccttgaccagctcgcagcccagggggctgggggggcacatggagagggctttctcgtcgcagggctcgcagtgcacgaaggagcccaggctctgggccggccccgcataggcggccagcagcaggaggaccgcggtgagcaacaccatcttctcttagtcgccccctttacctc

SEQ ID NO: 48725 - DNA, 30 bp, Homo sapiens; identical to SEQ ID NO: 27849
  misc_feature 1..30: note = chr2:219232829-219232859
  misc_feature 1..30: note = hyper
  source 1..30: mol_type = genomic DNA

SEQ ID NO: 48726 - DNA, 30 bp, Homo sapiens; identical to SEQ ID NO: 27850
  misc_feature 1..30: note = chr2:219723919-219723949
  misc_feature 1..30: note = hyper
  source 1..30: mol_type = genomic DNA

SEQ ID NO: 48727 - DNA, 301 bp, Homo sapiens; identical to SEQ ID NO: 27851
  misc_feature 1..301: note = chr2:219724722-219725023
  misc_feature 1..301: note = hyper
  source 1..301: mol_type = genomic DNA

SEQ ID NO: 48728 - DNA, 73 bp, Homo sapiens; identical to SEQ ID NO: 27852
  misc_feature 1..73: note = chr2:219735785-219735858
  misc_feature 1..73: note = hyper
  source 1..73: mol_type = genomic DNA

SEQ ID NO: 48729 - DNA, 34 bp, Homo sapiens
  misc_feature 1..34: note = chr2:219736117-219736151
  misc_feature 1..34: note = hyper
  source 1..34: mol_type = genomic DNA
ctggggcagccctcccgccgcaggtttcaggtcc

SEQ ID NO: 48730 - DNA, 142 bp, Homo sapiens; identical to SEQ ID NO: 27854
  misc_feature 1..142: note = chr2:219773737-219773879
  misc_feature 1..142: note = hyper
  source 1..142: mol_type = genomic DNA

SEQ ID NO: 48731 - DNA, 56 bp, Homo sapiens; identical to SEQ ID NO: 27855
  misc_feature 1..56: note = chr2:219823921-219823977
  misc_feature 1..56: note = hyper
  source 1..56: mol_type = genomic DNA

SEQ ID NO: 48732 - DNA, 69 bp, Homo sapiens; identical to SEQ ID NO: 27856
  misc_feature 1..69: note = chr2:219824277-219824346
  misc_feature 1..69: note = hyper
  source 1..69: mol_type = genomic DNA

SEQ ID NO: 48733 - DNA, 307 bp, Homo sapiens; identical to SEQ ID NO: 27857
  misc_feature 1..307: note = chr2:219824786-219825093
  misc_feature 1..307: note = hyper
  source 1..307: mol_type = genomic DNA

SEQ ID NO: 48734 - DNA, 419 bp, Homo sapiens; identical to SEQ ID NO: 27858
  misc_feature 1..419: note = chr2:219825130-219825549
  misc_feature 1..419: note = hyper
  source 1..419: mol_type = genomic DNA

SEQ ID NO: 48735 - DNA, 30 bp, Homo sapiens; identical to SEQ ID NO: 27859
  misc_feature 1..30: note = chr2:219826854-219826884
  misc_feature 1..30: note = hyper
  source 1..30: mol_type = genomic DNA

SEQ ID NO: 48736 - DNA, 466 bp, Homo sapiens; identical to SEQ ID NO: 27860
  misc_feature 1..466: note = chr2:219846405-219846871
  misc_feature 1..466: note = hyper
  source 1..466: mol_type = genomic DNA

SEQ ID NO: 48737 - DNA, 295 bp, Homo sapiens; identical to SEQ ID NO: 27861
  misc_feature 1..295: note = chr2:219846894-219847189
  misc_feature 1..295: note = hyper
  source 1..295: mol_type = genomic DNA

SEQ ID NO: 48738 - DNA, 476 bp, Homo sapiens; identical to SEQ ID NO: 17866
  misc_feature 1..476: note = chr2:219849001-219849477
  misc_feature 1..476: note = hyper
  source 1..476: mol_type = genomic DNA

SEQ ID NO: 48739 - DNA, 276 bp, Homo sapiens; identical to SEQ ID NO: 27864
  misc_feature 1..276: note = chr2:219849996-219850272
  misc_feature 1..276: note = hyper
  source 1..276: mol_type = genomic DNA

SEQ ID NO: 48740 - DNA, 30 bp, Homo sapiens; identical to SEQ ID NO: 27865
  misc_feature 1..30: note = chr2:219850482-219850512
  misc_feature 1..30: note = hyper
  source 1..30: mol_type = genomic DNA

SEQ ID NO: 48741 - DNA, 343 bp, Homo sapiens; identical to SEQ ID NO: 27866
  misc_feature 1..343: note = chr2:219857780-219858123
  misc_feature 1..343: note = hyper
  source 1..343: mol_type = genomic DNA

SEQ ID NO: 48742 - DNA, 76 bp, Homo sapiens; identical to SEQ ID NO: 27867
  misc_feature 1..76: note = chr2:219866496-219866572
  misc_feature 1..76: note = hyper
  source 1..76: mol_type = genomic DNA

SEQ ID NO: 48743 - DNA, 224 bp, Homo sapiens; identical to SEQ ID NO: 27868
  misc_feature 1..224: note = chr2:219867715-219867939
  misc_feature 1..224: note = hyper
  source 1..224: mol_type = genomic DNA

SEQ ID NO: 48744 - DNA, 30 bp, Homo sapiens; identical to SEQ ID NO: 27869
  misc_feature 1..30: note = chr2:219924566-219924596
  misc_feature 1..30: note = hyper
  source 1..30: mol_type = genomic DNA

SEQ ID NO: 48745 - DNA, 59 bp, Homo sapiens; identical to SEQ ID NO: 27870
  misc_feature 1..59: note = chr2:219925148-219925207
  misc_feature 1..59: note = hyper
  source 1..59: mol_type = genomic DNA

SEQ ID NO: 48746 - DNA, 69 bp, Homo sapiens; identical to SEQ ID NO: 27871
  misc_feature 1..69: note = chr2:219925544-219925613
  misc_feature 1..69: note = hyper
  source 1..69: mol_type = genomic DNA

SEQ ID NO: 48747 - DNA, 97 bp, Homo sapiens; identical to SEQ ID NO: 27872
  misc_feature 1..97: note = chr2:219926046-219926143
  misc_feature 1..97: note = hyper
  source 1..97: mol_type = genomic DNA

SEQ ID NO: 48748 - DNA, 48 bp, Homo sapiens
  misc_feature 1..48: note = chr2:220174296-220174344
  misc_feature 1..48: note = hyper
  source 1..48: mol_type = genomic DNA
gcccatccctcctccatcaaatagtaggcgcctcgctagaattcccac

SEQ ID NO: 48749 - DNA, 67 bp, Homo sapiens; identical to SEQ ID NO: 17870
  misc_feature 1..67: note = chr2:220196567-220196634
  misc_feature 1..67: note = hyper
  source 1..67: mol_type = genomic DNA

SEQ ID NO: 48750 - DNA, 344 bp, Homo sapiens; identical to SEQ ID NO: 27876
  misc_feature 1..344: note = chr2:220197187-220197531
  misc_feature 1..344: note = hyper
  source 1..344: mol_type = genomic DNA

SEQ ID NO: 48751 - DNA, 151 bp, Homo sapiens; identical to SEQ ID NO: 17872
  misc_feature 1..151: note = chr2:220222947-220223098
  misc_feature 1..151: note = hyper
  source 1..151: mol_type = genomic DNA

SEQ ID NO: 48752 - DNA, 520 bp, Homo sapiens
  misc_feature 1..520: note = chr2:220223128-220223648
  misc_feature 1..520: note = hyper
  source 1..520: mol_type = genomic DNA
ggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagag

SEQ ID NO: 48753 - skipped

SEQ ID NO: 48754 - DNA, 118 bp, Homo sapiens; identical to SEQ ID NO: 27879
  misc_feature 1..118: note = chr2:220283172-220283290
  misc_feature 1..118: note = hyper
  source 1..118: mol_type = genomic DNA

SEQ ID NO: 48755 - DNA, 107 bp, Homo sapiens
  misc_feature 1..107: note = chr2:220283519-220283626
  misc_feature 1..107: note = hyper
  source 1..107: mol_type = genomic DNA
gcaggagctcaatgaccgcttcgccaactacatcgagaaggtgcgcttcctggagcagcagaacgcggcgctcgccgccgaagtgaaccggctcaagggccgcgagc

SEQ ID NO: 48756 - DNA, 27 bp, Homo sapiens
  misc_feature 1..27: note = chr2:220283711-220283738
  misc_feature 1..27: note = hyper
  source 1..27: mol_type = genomic DNA
cgacgtcgagcgcgacaacctgctcga

SEQ ID NO: 48757 - DNA, 111 bp, Homo sapiens
  misc_feature 1..111: note = chr2:220299477-220299588
  misc_feature 1..111: note = hyper
  source 1..111: mol_type = genomic DNA
cctccacggctccctcgcaacccgagccggggggcctaaaaatagcccccaggcgcaatcgccggccgccccggtgaccttctgggtagcacaggccgaaggcgggcgggc

SEQ ID NO: 48758 - DNA, 38 bp, Homo sapiens
  misc_feature 1..38: note = chr2:220300059-220300097
  misc_feature 1..38: note = hyper
  source 1..38: mol_type = genomic DNA
gcggtgctcacagtgctggaggtcggaggtaaagggca

SEQ ID NO: 48759 - DNA, 91 bp, Homo sapiens
  misc_feature 1..91: note = chr2:220349706-220349797
  misc_feature 1..91: note = hyper
  source 1..91: mol_type = genomic DNA
cacaaccagttggccgcccaggccggcgccaccacgccttccgccgagtccctgggctccgaggccagcgccacgtcgggctcctcaggtg

SEQ ID NO: 48760 - DNA, 28 bp, Homo sapiens
  misc_feature 1..28: note = chr2:220361419-220361447
  misc_feature 1..28: note = hyper
  source 1..28: mol_type = genomic DNA
gtttaggggtctggccggtccagggggc

SEQ ID NO: 48761 - DNA, 76 bp, Homo sapiens; identical to SEQ ID NO: 27886
  misc_feature 1..76: note = chr2:220361826-220361902
  misc_feature 1..76: note = hyper
  source 1..76: mol_type = genomic DNA

SEQ ID NO: 48762 - DNA, 105 bp, Homo sapiens; identical to SEQ ID NO: 27887
  misc_feature 1..105: note = chr2:220361983-220362088
  misc_feature 1..105: note = hyper
  source 1..105: mol_type = genomic DNA

SEQ ID NO: 48763 - DNA, 53 bp, Homo sapiens; identical to SEQ ID NO: 27888
  misc_feature 1..53: note = chr2:220379221-220379274
  misc_feature 1..53: note = hyper
  source 1..53: mol_type = genomic DNA

SEQ ID NO: 48764 - DNA, 39 bp, Homo sapiens
  misc_feature 1..39: note = chr2:220416340-220416379
  misc_feature 1..39: note = hyper
  source 1..39: mol_type = genomic DNA
ggctgtgggtggggccgtggctgcgcatctcatacttat

SEQ ID NO: 48765 - DNA, 335 bp, Homo sapiens; identical to SEQ ID NO: 17880
  misc_feature 1..335: note = chr2:220416513-220416848
  misc_feature 1..335: note = hyper
  source 1..335: mol_type = genomic DNA

SEQ ID NO: 48766 - DNA, 38 bp, Homo sapiens; identical to SEQ ID NO: 17881
  misc_feature 1..38: note = chr2:220417649-220417687
  misc_feature 1..38: note = hyper
  source 1..38: mol_type = genomic DNA

SEQ ID NO: 48767 - DNA, 492 bp, Homo sapiens; identical to SEQ ID NO: 27890
  misc_feature 1..492: note = chr2:220435486-220435978
  misc_feature 1..492: note = hyper
  source 1..492: mol_type = genomic DNA

SEQ ID NO: 48768 - DNA, 13 bp, Homo sapiens
  misc_feature 1..13: note = chr2:222435863-222435876
  misc_feature 1..13: note = hyper
  source 1..13: mol_type = genomic DNA
gcgcacacacaca

SEQ ID NO: 48769 - DNA, 462 bp, Homo sapiens; identical to SEQ ID NO: 27892
  misc_feature 1..462: note = chr2:222435996-222436458
  misc_feature 1..462: note = hyper
  source 1..462: mol_type = genomic DNA

SEQ ID NO: 48770 - DNA, 41 bp, Homo sapiens; identical to SEQ ID NO: 27893
  misc_feature 1..41: note = chr2:222436920-222436961
  misc_feature 1..41: note = hyper
  source 1..41: mol_type = genomic DNA

SEQ ID NO: 48771 - DNA, 36 bp, Homo sapiens; identical to SEQ ID NO: 27894
  misc_feature 1..36: note = chr2:223104874-223104910
  misc_feature 1..36: note = hyper
  source 1..36: mol_type = genomic DNA

SEQ ID NO: 48772 - DNA, 353 bp, Homo sapiens
  misc_feature 1..353: note = chr2:223159453-223159806
  misc_feature 1..353: note = hyper
  source 1..353: mol_type = genomic DNA
agaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggac

SEQ ID NO: 48773 - DNA, 51 bp, Homo sapiens; identical to SEQ ID NO: 17884
  misc_feature 1..51: note = chr2:223160065-223160116
  misc_feature 1..51: note = hyper
  source 1..51: mol_type = genomic DNA

SEQ ID NO: 48774 - DNA, 214 bp, Homo sapiens
  misc_feature 1..214: note = chr2:223162565-223162779
  misc_feature 1..214: note = hyper
  source 1..214: mol_type = genomic DNA
gaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaa

SEQ ID NO: 48775 - DNA, 233 bp, Homo sapiens; identical to SEQ ID NO: 17885
  misc_feature 1..233: note = chr2:223163535-223163768
  misc_feature 1..233: note = hyper
  source 1..233: mol_type = genomic DNA

SEQ ID NO: 48776 - DNA, 49 bp, Homo sapiens; identical to SEQ ID NO: 17886
  misc_feature 1..49: note = chr2:223163954-223164003
  misc_feature 1..49: note = hyper
  source 1..49: mol_type = genomic DNA

SEQ ID NO: 48777 - DNA, 127 bp, Homo sapiens
  misc_feature 1..127: note = chr2:223164407-223164534
  misc_feature 1..127: note = hyper
  source 1..127: mol_type = genomic DNA
ttcttttgtcttctccgtccgcaagcggggctaatgtgaagcacaggcagccgtcgctaggcccaagcactcgttagttgaaggctgggggtatgggggagggtgcagaaaaaaacctggctcctct

SEQ ID NO: 48778 - DNA, 223 bp, Homo sapiens; identical to SEQ ID NO: 27908
  misc_feature 1..223: note = chr2:223166003-223166226
  misc_feature 1..223: note = hyper
  source 1..223: mol_type = genomic DNA

SEQ ID NO: 48779 - DNA, 41 bp, Homo sapiens
  misc_feature 1..41: note = chr2:223166408-223166449
  misc_feature 1..41: note = hyper
  source 1..41: mol_type = genomic DNA
ccctttatttctttctgaagtctctccggagcccaagccac

SEQ ID NO: 48780 - DNA, 129 bp, Homo sapiens
  misc_feature 1..129: note = chr2:223166721-223166850
  misc_feature 1..129: note = hyper
  source 1..129: mol_type = genomic DNA
ctcacgctctgtgcacgttcgaaatgaaacgggagccttgaagacgatatttggataatttgacaaaaaaaaaaaaaaggtgggcgggggagatagcttctattgtcccctctgcgcctctgcccccag

SEQ ID NO: 48781 - DNA, 163 bp, Homo sapiens
  misc_feature 1..163: note = chr2:223167226-223167389
  misc_feature 1..163: note = hyper
  source 1..163: mol_type = genomic DNA
gcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgat

SEQ ID NO: 48782 - DNA, 724 bp, Homo sapiens
  misc_feature 1..724: note = chr2:223168916-223169640
  misc_feature 1..724: note = hyper
  source 1..724: mol_type = genomic DNA
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgagggg

SEQ ID NO: 48783 - DNA, 24 bp, Homo sapiens
  misc_feature 1..24: note = chr2:223169864-223169888
  misc_feature 1..24: note = hyper
  source 1..24: mol_type = genomic DNA
gataaagatcgatatctacatgat

SEQ ID NO: 48784 - DNA, 21 bp, Homo sapiens
  misc_feature 1..21: note = chr2:223170354-223170375
  misc_feature 1..21: note = hyper
  source 1..21: mol_type = genomic DNA
cttctttccatccctcggccc

SEQ ID NO: 48785 - DNA, 675 bp, Homo sapiens
  misc_feature 1..675: note = chr2:223170434-223171109
  misc_feature 1..675: note = hyper
  source 1..675: mol_type = genomic DNA
ctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttccaaatgcaaatcaaacacccttggcgccccgcttcttcattaattaagaggaacgtttcgacaaaaccggcgtaatctttattaattacgcagcccttagcgcgccgttcgcatcaatcacgcccaaagcgaaagtgcagggggcgcctaatcccttcccagagcgcgtttggagaaggagccgcgtggccggcgtttccaccgtgacttccacctttctgggctcgcctggcactggctgctcagccggcgcgcagggaggcctttccggaaacaccggctggctgcgcgctagcaggaccgctctagatcccctgacaggccggaaaataacccccactcactatttgggcacgcgc

SEQ ID NO: 48786 - DNA, 184 bp, Homo sapiens
  misc_feature 1..184: note = chr2:223171180-223171364
  misc_feature 1..184: note = hyper
  source 1..184: mol_type = genomic DNA
aggctcagtggggaccacgcggttctcagtcctcctcttccctaggaccctctaaaaaggagcctggggcgaaatgacagagggaggcagaaaacctcctgttgccccaggacgccccgaaaaactgctctgggggatggggcggggaagaccttagaagttgtcagggcgaccaactcctccc

SEQ ID NO: 48787 - DNA, 218 bp, Homo sapiens; identical to SEQ ID NO: 27914
  misc_feature 1..218: note = chr2:223171861-223172079
  misc_feature 1..218: note = hyper
  source 1..218: mol_type = genomic DNA

SEQ ID NO: 48788 - DNA, 57 bp, Homo sapiens
  misc_feature 1..57: note = chr2:223173173-223173230
  misc_feature 1..57: note = hyper
  source 1..57: mol_type = genomic DNA
cagatccccactctacaggacctgtcactcccatttcccatacgagaggaaactccc

SEQ ID NO: 48789 - DNA, 275 bp, Homo sapiens; identical to SEQ ID NO: 17895
  misc_feature 1..275: note = chr2:223176181-223176456
  misc_feature 1..275: note = hyper
  source 1..275: mol_type = genomic DNA

SEQ ID NO: 48790 - DNA, 225 bp, Homo sapiens
  misc_feature 1..225: note = chr2:223176983-223177208
  misc_feature 1..225: note = hyper
  source 1..225: mol_type = genomic DNA
ccgtaatggagctggcaagtgggacgaacgggacagcctaaagcgtcgttggcccggccaagaggggctcaacgcctgtcaccccgggcggccttgggtcctttgcagtcggagaggctgcaggggaggaggaagacccagccagctccagggtgcaggattctgcccttccacccgagagcctcccccggtgtcccagtggcagtggctgccccgggctgcggt

SEQ ID NO: 48791 - DNA, 71 bp, Homo sapiens
  misc_feature 1..71: note = chr2:223177244-223177315
  misc_feature 1..71: note = hyper
  source 1..71: mol_type = genomic DNA
cgccctgccccttgggctcagctgcgagccaccgccggcgtgcgcacccacaaggagagaaatggaggtaa

SEQ ID NO: 48792 - DNA, 44 bp, Homo sapiens
  misc_feature 1..44: note = chr2:223177610-223177654
  misc_feature 1..44: note = hyper
  source 1..44: mol_type = genomic DNA
tatccgcataatccgtcctcaaatcccctcgttgtcactgcatt

SEQ ID NO: 48793 - DNA, 41 bp, Homo sapiens; identical to SEQ ID NO: 27919
  misc_feature 1..41: note = chr2:223185352-223185393
  misc_feature 1..41: note = hyper
  source 1..41: mol_type = genomic DNA

SEQ ID NO: 48794 - DNA, 133 bp, Homo sapiens; identical to SEQ ID NO: 27920
  misc_feature 1..133: note = chr2:223536428-223536561
  misc_feature 1..133: note = hyper
  source 1..133: mol_type = genomic DNA

SEQ ID NO: 48795 - DNA, 45 bp, Homo sapiens; identical to SEQ ID NO: 27921
  misc_feature 1..45: note = chr2:225906010-225906055
  misc_feature 1..45: note = hyper
  source 1..45: mol_type = genomic DNA

SEQ ID NO: 48796 - DNA, 375 bp, Homo sapiens; identical to SEQ ID NO: 6682
  misc_feature 1..375: note = chr2:225906404-225906779
  misc_feature 1..375: note = hyper
  source 1..375: mol_type = genomic DNA

SEQ ID NO: 48797 - DNA, 572 bp, Homo sapiens; identical to SEQ ID NO: 27923
  misc_feature 1..572: note = chr2:225906790-225907362
  misc_feature 1..572: note = hyper
  source 1..572: mol_type = genomic DNA

SEQ ID NO: 48798 - DNA, 128 bp, Homo sapiens; identical to SEQ ID NO: 27924
  misc_feature 1..128: note = chr2:225907439-225907567
  misc_feature 1..128: note = hyper
  source 1..128: mol_type = genomic DNA

SEQ ID NO: 48799 - DNA, 174 bp, Homo sapiens; identical to SEQ ID NO: 27925
  misc_feature 1..174: note = chr2:226896159-226896333
  misc_feature 1..174: note = hyper
  source 1..174: mol_type = genomic DNA

SEQ ID NO: 48800 - DNA, 85 bp, Homo sapiens; identical to SEQ ID NO: 27926
  misc_feature 1..85: note = chr2:227663424-227663509
  misc_feature 1..85: note = hyper
  source 1..85: mol_type = genomic DNA

SEQ ID NO: 48801-48802 - skipped (2 entries)

SEQ ID NO: 48803 - DNA, 15 bp, Homo sapiens
  misc_feature 1..15: note = chr2:228582819-228582834
  misc_feature 1..15: note = hyper
  source 1..15: mol_type = genomic DNA
cgtccagacctttca

SEQ ID NO: 48804 - DNA, 61 bp, Homo sapiens
  misc_feature 1..61: note = chr2:228736154-228736215
  misc_feature 1..61: note = hyper
  source 1..61: mol_type = genomic DNA
tagctcctctgaggtcgcccttagtgaggacacgaggtgccctcacctctttcactctaga

SEQ ID NO: 48805 - DNA, 15 bp, Homo sapiens
  misc_feature 1..15: note = chr2:229046730-229046745
  misc_feature 1..15: note = hyper
  source 1..15: mol_type = genomic DNA
ccctgaagttgttca

SEQ ID NO: 48806 - DNA, 593 bp, Homo sapiens; identical to SEQ ID NO: 27933
  misc_feature 1..593: note = chr2:230578129-230578722
  misc_feature 1..593: note = hyper
  source 1..593: mol_type = genomic DNA

SEQ ID NO: 48807 - DNA, 34 bp, Homo sapiens; identical to SEQ ID NO: 27934
  misc_feature 1..34: note = chr2:231191860-231191894
  misc_feature 1..34: note = hyper
  source 1..34: mol_type = genomic DNA

SEQ ID NO: 48808 - DNA, 87 bp, Homo sapiens; identical to SEQ ID NO: 27935
  misc_feature 1..87: note = chr2:231693406-231693493
  misc_feature 1..87: note = hyper
  source 1..87: mol_type = genomic DNA

SEQ ID NO: 48809 - DNA, 46 bp, Homo sapiens; identical to SEQ ID NO: 27936
  misc_feature 1..46: note = chr2:231714930-231714976
  misc_feature 1..46: note = hyper
  source 1..46: mol_type = genomic DNA

SEQ ID NO: 48810 - DNA, 132 bp, Homo sapiens; identical to SEQ ID NO: 27937
  misc_feature 1..132: note = chr2:231903040-231903172
  misc_feature 1..132: note = hyper
  source 1..132: mol_type = genomic DNA

SEQ ID NO: 48811 - DNA, 30 bp, Homo sapiens
  misc_feature 1..30: note = chr2:232394940-232394970
  misc_feature 1..30: note = hyper
  source 1..30: mol_type = genomic DNA
ccccggtggcggggacggggggcaccccga

SEQ ID NO: 48812 - DNA, 358 bp, Homo sapiens
  misc_feature 1..358: note = chr2:232395061-232395419
  misc_feature 1..358: note = hyper
  source 1..358: mol_type = genomic DNA
gcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggc

SEQ ID NO: 48813 - DNA, 41 bp, Homo sapiens; identical to SEQ ID NO: 27940
  misc_feature 1..41: note = chr2:232526765-232526806
  misc_feature 1..41: note = hyper
  source 1..41: mol_type = genomic DNA

SEQ ID NO: 48814 - DNA, 32 bp, Homo sapiens; identical to SEQ ID NO: 27941
  misc_feature 1..32: note = chr2:232527207-232527239
  misc_feature 1..32: note = hyper
  source 1..32: mol_type = genomic DNA

SEQ ID NO: 48815 - DNA, 174 bp, Homo sapiens
  misc_feature 1..174: note = chr2:232791530-232791704
  misc_feature 1..174: note = hyper
  source 1..174: mol_type = genomic DNA
cgcagccctgcttgtcgccaaactcttccctgggcacctgacagccgcgggatggcattgcagctccgcctttcacctgccggtcagggcgggagcgcagaccacagcgacgtcgttaggttggggaggcagaggatggggttggaggactggggtgggaggcgcagggagagc

SEQ ID NO: 48816 - DNA, 17 bp, Homo sapiens
  misc_feature 1..17: note = chr2:232792012-232792029
  misc_feature 1..17: note = hyper
  source 1..17: mol_type = genomic DNA
cccgctccagtatcctg

SEQ ID NO: 48817 - DNA, 30 bp, Homo sapiens; identical to SEQ ID NO: 6692
  misc_feature 1..30: note = chr2:233283450-233283480
  misc_feature 1..30: note = hyper
  source 1..30: mol_type = genomic DNA

SEQ ID NO: 48818 - DNA, 63 bp, Homo sapiens; identical to SEQ ID NO: 27944
  misc_feature 1..63: note = chr2:233283709-233283772
  misc_feature 1..63: note = hyper
  source 1..63: mol_type = genomic DNA

SEQ ID NO: 48819 - DNA, 30 bp, Homo sapiens; identical to SEQ ID NO: 27945
  misc_feature 1..30: note = chr2:233285064-233285094
  misc_feature 1..30: note = hyper
  source 1..30: mol_type = genomic DNA

SEQ ID NO: 48820 - DNA, 66 bp, Homo sapiens; identical to SEQ ID NO: 6694
  misc_feature 1..66: note = chr2:233285777-233285843
  misc_feature 1..66: note = hyper
  source 1..66: mol_type = genomic DNA

SEQ ID NO: 48821 - DNA, 319 bp, Homo sapiens; identical to SEQ ID NO: 27949
  misc_feature 1..319: note = chr2:233351415-233351734
  misc_feature 1..319: note = hyper
  source 1..319: mol_type = genomic DNA

SEQ ID NO: 48822 - DNA, 218 bp, Homo sapiens; identical to SEQ ID NO: 27950
  misc_feature 1..218: note = chr2:233351789-233352007
  misc_feature 1..218: note = hyper
  source 1..218: mol_type = genomic DNA

SEQ ID NO: 48823 - DNA, 72 bp, Homo sapiens
  misc_feature 1..72: note = chr2:233352853-233352925
  misc_feature 1..72: note = hyper
  source 1..72: mol_type = genomic DNA
tggaaaggggctggagctggagatgaggagccgaggactcctccgaagggctgggggcggtgtcagtagtgc

SEQ ID NO: 48824 - DNA, 38 bp, Homo sapiens; identical to SEQ ID NO: 27954
  misc_feature 1..38: note = chr2:233367784-233367822
  misc_feature 1..38: note = hyper
  source 1..38: mol_type = genomic DNA

SEQ ID NO: 48825 - DNA, 152 bp, Homo sapiens; identical to SEQ ID NO: 27955
  misc_feature 1..152: note = chr2:233368141-233368293
  misc_feature 1..152: note = hyper
  source 1..152: mol_type = genomic DNA

SEQ ID NO: 48826 - DNA, 451 bp, Homo sapiens; identical to SEQ ID NO: 27956
  misc_feature 1..451: note = chr2:233388723-233389174
  misc_feature 1..451: note = hyper
  source 1..451: mol_type = genomic DNA

SEQ ID NO: 48827 - DNA, 182 bp, Homo sapiens; identical to SEQ ID NO: 27957
  misc_feature 1..182: note = chr2:233498345-233498527
  misc_feature 1..182: note = hyper
  source 1..182: mol_type = genomic DNA

SEQ ID NO: 48828 - DNA, 139 bp, Homo sapiens
  misc_feature 1..139: note = chr2:233498571-233498710
  misc_feature 1..139: note = hyper
  source 1..139: mol_type = genomic DNA
cggagctgagcgcccagctgagccggcggctggacatcaacgagggcgctgcgcggccccggcgctgcagggtcttcaacccctacacggagttcccggagttcagccgccgcctcatcaaggacctggagagcatgtt

SEQ ID NO: 48829 - DNA, 621 bp, Homo sapiens; identical to SEQ ID NO: 27960
  misc_feature 1..621: note = chr2:233740929-233741550
  misc_feature 1..621: note = hyper
  source 1..621: mol_type = genomic DNA

SEQ ID NO: 48830 - DNA, 67 bp, Homo sapiens; identical to SEQ ID NO: 27961
  misc_feature 1..67: note = chr2:234475179-234475246
  misc_feature 1..67: note = hyper
  source 1..67: mol_type = genomic DNA

SEQ ID NO: 48831 - DNA, 30 bp, Homo sapiens; identical to SEQ ID NO: 27962
  misc_feature 1..30: note = chr2:234475473-234475503
  misc_feature 1..30: note = hyper
  source 1..30: mol_type = genomic DNA

SEQ ID NO: 48832 - DNA, 117 bp, Homo sapiens; identical to SEQ ID NO: 6710
  misc_feature 1..117: note = chr2:235404416-235404533
  misc_feature 1..117: note = hyper
  source 1..117: mol_type = genomic DNA

SEQ ID NO: 48833 - DNA, 273 bp, Homo sapiens; identical to SEQ ID NO: 27965
  misc_feature 1..273: note = chr2:235404629-235404902
  misc_feature 1..273: note = hyper
  source 1..273: mol_type = genomic DNA

SEQ ID NO: 48834 - DNA, 30 bp, Homo sapiens; identical to SEQ ID NO: 27966
  misc_feature 1..30: note = chr2:235860068-235860098
  misc_feature 1..30: note = hyper
  source 1..30: mol_type = genomic DNA

SEQ ID NO: 48835 - DNA, 22 bp, Homo sapiens
  misc_feature 1..22: note = chr2:236402749-236402771
  misc_feature 1..22: note = hyper
  source 1..22: mol_type = genomic DNA
ccgcggcttgcaaggcgcctgc

SEQ ID NO: 48836 - DNA, 119 bp, Homo sapiens
  misc_feature 1..119: note = chr2:236403151-236403270
  misc_feature 1..119: note = hyper
  source 1..119: mol_type = genomic DNA
cccgcgggccagccccgcgcctgctccgcccgcgcctttcttctcgcgcctcctccgcccgccgccggcgggcccggctccccgggggctgcggcgccccgggctcggcggcccgcggg

SEQ ID NO: 48837 - DNA, 30 bp, Homo sapiens; identical to SEQ ID NO: 27969
  misc_feature 1..30: note = chr2:236403854-236403884
  misc_feature 1..30: note = hyper
  source 1..30: mol_type = genomic DNA

SEQ ID NO: 48838 - DNA, 89 bp, Homo sapiens; identical to SEQ ID NO: 27970
  misc_feature 1..89: note = chr2:236577966-236578055
  misc_feature 1..89: note = hyper
  source 1..89: mol_type = genomic DNA

SEQ ID NO: 48839 - DNA, 44 bp, Homo sapiens; identical to SEQ ID NO: 27971
  misc_feature 1..44: note = chr2:236579046-236579090
  misc_feature 1..44: note = hyper
  source 1..44: mol_type = genomic DNA

SEQ ID NO: 48840 - DNA, 163 bp, Homo sapiens; identical to SEQ ID NO: 27972
  misc_feature 1..163: note = chr2:237068390-237068553
  misc_feature 1..163: note = hyper
  source 1..163: mol_type = genomic DNA

SEQ ID NO: 48841 - DNA, 21 bp, Homo sapiens
  misc_feature 1..21: note = chr2:237068626-237068647
  misc_feature 1..21: note = hyper
  source 1..21: mol_type = genomic DNA
cgcagccgggcctcctgcctc

SEQ ID NO: 48842 - DNA, 16 bp, Homo sapiens
  misc_feature 1..16: note = chr2:237068925-237068941
  misc_feature 1..16: note = hyper
  source 1..16: mol_type = genomic DNA
gcggtggaggctaggg

SEQ ID NO: 48843 - DNA, 298 bp, Homo sapiens; identical to SEQ ID NO: 17922
  misc_feature 1..298: note = chr2:237073056-237073354
  misc_feature 1..298: note = hyper
  source 1..298: mol_type = genomic DNA

SEQ ID NO: 48844 - DNA, 82 bp, Homo sapiens; identical to SEQ ID NO: 17923
  misc_feature 1..82: note = chr2:237073414-237073496
  misc_feature 1..82: note = hyper
  source 1..82: mol_type = genomic DNA

SEQ ID NO: 48845 - DNA, 28 bp, Homo sapiens
  misc_feature 1..28: note = chr2:237073564-237073592
  misc_feature 1..28: note = hyper
  source 1..28: mol_type = genomic DNA
cgcttgcctcctccgggcacccacctcc

SEQ ID NO: 48846 - DNA, 55 bp, Homo sapiens; identical to SEQ ID NO: 27979
  misc_feature 1..55: note = chr2:237075130-237075185
  misc_feature 1..55: note = hyper
  source 1..55: mol_type = genomic DNA

SEQ ID NO: 48847 - DNA, 47 bp, Homo sapiens; identical to SEQ ID NO: 27980
  misc_feature 1..47: note = chr2:237076012-237076059
  misc_feature 1..47: note = hyper
  source 1..47: mol_type = genomic DNA

SEQ ID NO: 48848 - DNA, 34 bp, Homo sapiens; identical to SEQ ID NO: 6720
  misc_feature 1..34: note = chr2:237076602-237076636
  misc_feature 1..34: note = hyper
  source 1..34: mol_type = genomic DNA

SEQ ID NO: 48849 - DNA, 69 bp, Homo sapiens; identical to SEQ ID NO: 6721
  misc_feature 1..69: note = chr2:237076656-237076725
  misc_feature 1..69: note = hyper
  source 1..69: mol_type = genomic DNA

SEQ ID NO: 48850 - DNA, 171 bp, Homo sapiens; identical to SEQ ID NO: 27983
  misc_feature 1..171: note = chr2:237077033-237077204
  misc_feature 1..171: note = hyper
  source 1..171: mol_type = genomic DNA

SEQ ID NO: 48851 - DNA, 167 bp, Homo sapiens
  misc_feature 1..167: note = chr2:237078348-237078515
  misc_feature 1..167: note = hyper
  source 1..167: mol_type = genomic DNA
tggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccggggga

SEQ ID NO: 48852 - DNA, 30 bp, Homo sapiens; identical to SEQ ID NO: 27985
  misc_feature 1..30: note = chr2:237079095-237079125
  misc_feature 1..30: note = hyper
  source 1..30: mol_type = genomic DNA

SEQ ID NO: 48853 - DNA, 91 bp, Homo sapiens
  misc_feature 1..91: note = chr2:237080173-237080264
  misc_feature 1..91: note = hyper
  source 1..91: mol_type = genomic DNA
cagcccagcccaatccggaggaggaagcaccgcgaatggcgcgcttcgctgccgccgccagagtcgaggtaacgggtggtcgtggagaggg

SEQ ID NO: 48854 - DNA, 159 bp, Homo sapiens
  misc_feature 1..159: note = chr2:237081182-237081341
  misc_feature 1..159: note = hyper
  source 1..159: mol_type = genomic DNA
cagaaacaaaacaaccgcaaaatagaaatgtgaaggggaggggcttttcttcttcttcatttcctcctgggagttgaaaaatgttatccgcaggcctgaaggctgggaaacgtgacccttcacacctgcgccgccctctccactccagcgacgaggaac

SEQ ID NO: 48855 - DNA, 38 bp, Homo sapiens
  misc_feature 1..38: note = chr2:237086468-237086506
  misc_feature 1..38: note = hyper
  source 1..38: mol_type = genomic DNA
gccctggagagtcctccctctgtcgtctgctctcagca

SEQ ID NO: 48856 - DNA, 340 bp, Homo sapiens; identical to SEQ ID NO: 27992
  misc_feature 1..340: note = chr2:237086712-237087052
  misc_feature 1..340: note = hyper
  source 1..340: mol_type = genomic DNA

SEQ ID NO: 48857 - DNA, 30 bp, Homo sapiens; identical to SEQ ID NO: 27993
  misc_feature 1..30: note = chr2:237087461-237087491
  misc_feature 1..30: note = hyper
  source 1..30: mol_type = genomic DNA

SEQ ID NO: 48858 - DNA, 200 bp, Homo sapiens; identical to SEQ ID NO: 27994
  misc_feature 1..200: note = chr2:237088039-237088239
  misc_feature 1..200: note = hyper
  source 1..200: mol_type = genomic DNA

SEQ ID NO: 48859 - DNA, 286 bp, Homo sapiens
  misc_feature 1..286: note = chr2:237145136-237145422
  misc_feature 1..286: note = hyper
  source 1..286: mol_type = genomic DNA
tgtacgccttaaacacgtgccgcttgctgaatgtcaatcacacctcggtaaagctgcttttaaagagcattgctagaaccttgtttccttcctctttctcaagactggcgggggtccacgtggccccctgatcccccctctgaactcaaatgacctttcttaggtgggtcccctgcctgagtccctgaatgcccagcagtcccgcctgcctgcgttgctgcccctgctgggcaggacatccaggcaactttgacagtcggtggagaagcagcaagggcgatgcggt

SEQ ID NO: 48860 - DNA, 26 bp, Homo sapiens
  misc_feature 1..26: note = chr2:237145723-237145749
  misc_feature 1..26: note = hyper
  source 1..26: mol_type = genomic DNA
ggcctccctagaggccggcacagctc

SEQ ID NO: 48861 - DNA, 38 bp, Homo sapiens; identical to SEQ ID NO: 27998
  misc_feature 1..38: note = chr2:237145963-237146001
  misc_feature 1..38: note = hyper
  source 1..38: mol_type = genomic DNA

SEQ ID NO: 48862 - DNA, 291 bp, Homo sapiens; identical to SEQ ID NO: 27999
  misc_feature 1..291: note = chr2:237146260-237146551
  misc_feature 1..291: note = hyper
  source 1..291: mol_type = genomic DNA

SEQ ID NO: 48863 - DNA, 146 bp, Homo sapiens
  misc_feature 1..146: note = chr2:237416070-237416216
  misc_feature 1..146: note = hyper
  source 1..146: mol_type = genomic DNA
cgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacg

SEQ ID NO: 48864 - DNA, 157 bp, Homo sapiens
  misc_feature 1..157: note = chr2:238395134-238395291
  misc_feature 1..157: note = hyper
  source 1..157: mol_type = genomic DNA
tgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttct

SEQ ID NO: 48865 - DNA, 99 bp, Homo sapiens
  misc_feature 1..99: note = chr2:238395356-238395455
  misc_feature 1..99: note = hyper
  source 1..99: mol_type = genomic DNA
cctgatgcctggcagaatcgaaggggtgagggtacgctctctgcagcagaaagccctgggcttaaagtcctatttattatttggcgttgccacttactg

SEQ ID NO: 48866 - DNA, 41 bp, Homo sapiens; identical to SEQ ID NO: 28002
  misc_feature 1..41: note = chr2:238395845-238395886
  misc_feature 1..41: note = hyper
  source 1..41: mol_type = genomic DNA

SEQ ID NO: 48867 - DNA, 505 bp, Homo sapiens; identical to SEQ ID NO: 28004
  misc_feature 1..505: note = chr2:238536208-238536713
  misc_feature 1..505: note = hyper
  source 1..505: mol_type = genomic DNA

SEQ ID NO: 48868 - DNA, 43 bp, Homo sapiens; identical to SEQ ID NO: 2193
  misc_feature 1..43: note = chr2:238864588-238864631
  misc_feature 1..43: note = hyper
  source 1..43: mol_type = genomic DNA

SEQ ID NO: 48869 - DNA, 386 bp, Homo sapiens
  misc_feature 1..386: note = chr2:238864913-238865299
  misc_feature 1..386: note = hyper
  source 1..386: mol_type = genomic DNA
aagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactcagccctcggagggacgcccacctcccgcggagctgggggactgtggcttcctcctgcgcggggaggtcggtgggcgccgtggacccgtcccgcccctgtctgaggagccgagtcggccacagaggggcagcagactagggagggctgatgggccgtgcacttagctccctccgggctgctggccggggcccttgaacggacagatgccaactggcagatgagggggctgcgtccacccccaccc

SEQ ID NO: 48870 - DNA, 106 bp, Homo sapiens; identical to SEQ ID NO: 28007
  misc_feature 1..106: note = chr2:239072183-239072289
  misc_feature 1..106: note = hyper
  source 1..106: mol_type = genomic DNA

SEQ ID NO: 48871 - DNA, 156 bp, Homo sapiens
  misc_feature 1..156: note = chr2:239140249-239140405
  misc_feature 1..156: note = hyper
  source 1..156: mol_type = genomic DNA
ccgttggaggccgttgctcaccgttgggcaagtgctttaagaagcacgaggatgtcgagtgtcaaatgcggcaaagggctcagagctcgccgccaaggggcgtggcctccgggccgcggcggcctctgggagttgtagtcccgcctcaacttgtgg

SEQ ID NO: 48872 - DNA, 43 bp, Homo sapiens
  misc_feature 1..43: note = chr2:239755121-239755164
  misc_feature 1..43: note = hyper
  source 1..43: mol_type = genomic DNA
ggagggcggtcaggccgggtggggctgggtgcggtggctctgc

SEQ ID NO: 48873 - DNA, 30 bp, Homo sapiens; identical to SEQ ID NO: 28010
  misc_feature 1..30: note = chr2:239757311-239757341
  misc_feature 1..30: note = hyper
  source 1..30: mol_type = genomic DNA

SEQ ID NO: 48874 - DNA, 32 bp, Homo sapiens
  misc_feature 1..32: note = chr2:239757604-239757636
  misc_feature 1..32: note = hyper
  source 1..32: mol_type = genomic DNA
gaccggtgactcccccggcgggttctgaagat

SEQ ID NO: 48875 - DNA, 163 bp, Homo sapiens; identical to SEQ ID NO: 28012
  misc_feature 1..163: note = chr2:239757898-239758061
  misc_feature 1..163: note = hyper
  source 1..163: mol_type = genomic DNA

SEQ ID NO: 48876 - DNA, 201 bp, Homo sapiens
  misc_feature 1..201: note = chr2:239758144-239758345
  misc_feature 1..201: note = hyper
  source 1..201: mol_type = genomic DNA
ctgacctaggaactgggagccctgagtcccaaccttgaccctggagtacccgggaggggccccgcccatccagccccgcagggatgggcgaggggtccaggctgggaaacgggtctgggggacagggaggctgtgcgcgccgggccctgcgcgaggagaaggctcgggggacacagctgccaggagcactccaagttctgg

SEQ ID NO: 48877 - DNA, 61 bp, Homo sapiens
  misc_feature 1..61: note = chr2:239758394-239758455
  misc_feature 1..61: note = hyper
  source 1..61: mol_type = genomic DNA
agacaccttccaagtccctttagacaagctcgagccacggaggcgccgtccttaggctctg

SEQ ID NO: 48878 - DNA, 138 bp, Homo sapiens; identical to SEQ ID NO: 28014
  misc_feature 1..138: note = chr2:240874074-240874212
  misc_feature 1..138: note = hyper
  source 1..138: mol_type = genomic DNA

SEQ ID NO: 48879 - DNA, 26 bp, Homo sapiens
  misc_feature 1..26: note = chr2:241393141-241393167
  misc_feature 1..26: note = hyper
  source 1..26: mol_type = genomic DNA
agacccctgcgcacccgctccggctg

SEQ ID NO: 48880 - skipped

SEQ ID NO: 48881 - DNA, 53 bp, Homo sapiens
  misc_feature 1..53: note = chr2:241758324-241758377
  misc_feature 1..53: note = hyper
  source 1..53: mol_type = genomic DNA
cttggaaagggctgacgcttggggaaggggtcctccagtctctgggggaaagt

SEQ ID NO: 48882 - DNA, 189 bp, Homo sapiens
  misc_feature 1..189: note = chr2:241758819-241759008
  misc_feature 1..189: note = hyper
  source 1..189: mol_type = genomic DNA
ccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcc

SEQ ID NO: 48883 - DNA, 555 bp, Homo sapiens
  misc_feature 1..555: note = chr2:241759042-241759597
  misc_feature 1..555: note = hyper
  source 1..555: mol_type = genomic DNA
cgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcga

SEQ ID NO: 48884 - DNA, 169 bp, Homo sapiens
  misc_feature 1..169: note = chr2:241759694-241759863
  misc_feature 1..169: note = hyper
  source 1..169: mol_type = genomic DNA
ccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagg

SEQ ID NO: 48885 - DNA, 270 bp, Homo sapiens
  misc_feature 1..270: note = chr2:241760224-241760494
  misc_feature 1..270: note = hyper
  source 1..270: mol_type = genomic DNA
ccggatgatgcaacccgcccgcggacccgccgcctcgcctctaccgcggctcgtggggaccccccgccctcctctcgccccacctctccaggcccccattgtcctcaccccagcctgtccagtttaacttccttggacccccaagtcacacgccgctcgggggccaccccggcaaaccccagcctgcgtcacccgcccccagccgccttcctagttccaggggctgactggtatctctgtgcgcgccaccgtcctccctccaccgtccca

SEQ ID NO: 48886 - DNA, 273 bp, Homo sapiens
  misc_feature 1..273: note = chr2:241760523-241760796
  misc_feature 1..273: note = hyper
  source 1..273: mol_type = genomic DNA
gcagctcgcccatgggaacctccccgcactgcggtgcgggggtgcacggatttcgggccaccctgaaccccggggctgggtcccctccagcccagcccctgccatcgagcccctgccatgggcatcctggcgtcgcctggctaagcctccctggcgcccagcaggggcctgcgctgccctagcggcctcgccgttaaccatttcatccacactcctgggagagccggcttcacctcagtcccgacagctgcgtgcgagcgccttgcaggtggc

SEQ ID NO: 48887 - DNA, 42 bp, Homo sapiens
  misc_feature 1..42: note = chr2:241771123-241771165
  misc_feature 1..42: note = hyper
  source 1..42: mol_type = genomic DNA
gggatgcgcggatggcgggggtgccgaggtgggcaaagggat

SEQ ID NO: 48888 - DNA, 100 bp, Homo sapiens
  misc_feature 1..100: note = chr2:241771257-241771357
  misc_feature 1..100: note = hyper
  source 1..100: mol_type = genomic DNA
tggaaggtcagggcctggaggggagctgggtccaggcagggaactcacagcagagacgccccgagggtggggtcgggccaagagccgcagccaggggatg

SEQ ID NO: 48889 - DNA, 137 bp, Homo sapiens; identical to SEQ ID NO: 28021
  misc_feature 1..137: note = chr2:241771622-241771759
  misc_feature 1..137: note = hyper
  source 1..137: mol_type = genomic DNA

SEQ ID NO: 48890 - DNA, 53 bp, Homo sapiens; identical to SEQ ID NO: 28022
  misc_feature 1..53: note = chr2:241772052-241772105
  misc_feature 1..53: note = hyper
  source 1..53: mol_type = genomic DNA

SEQ ID NO: 48891 - DNA, 43 bp, Homo sapiens; identical to SEQ ID NO: 28023
  misc_feature 1..43: note = chr2:242550007-242550050
  misc_feature 1..43: note = hyper
  source 1..43: mol_type = genomic DNA

SEQ ID NO: 48892 - DNA, 310 bp, Homo sapiens
  misc_feature 1..310: note = chr3:238226-238536
  misc_feature 1..310: note = hyper
  source 1..310: mol_type = genomic DNA
ggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccg

SEQ ID NO: 48893 - DNA, 32 bp, Homo sapiens
  misc_feature 1..32: note = chr3:239094-239126
  misc_feature 1..32: note = hyper
  source 1..32: mol_type = genomic DNA
cgctgctctctgaggaggattccagacccccc

SEQ ID NO: 48894 - DNA, 464 bp, Homo sapiens
  misc_feature 1..464: note = chr3:239158-239622
  misc_feature 1..464: note = hyper
  source 1..464: mol_type = genomic DNA
cgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttgggg

SEQ ID NO: 48895 - DNA, 39 bp, Homo sapiens
  misc_feature 1..39: note = chr3:240223-240262
  misc_feature 1..39: note = hyper
  source 1..39: mol_type = genomic DNA
ctttctcaataatacggagattatcgataccctctatac

SEQ ID NO: 48896 - DNA, 32 bp, Homo sapiens; identical to SEQ ID NO: 6753
  misc_feature 1..32: note = chr3:2139944-2139976
  misc_feature 1..32: note = hyper
  source 1..32: mol_type = genomic DNA

SEQ ID NO: 48897 - DNA, 37 bp, Homo sapiens; identical to SEQ ID NO: 17956
  misc_feature 1..37: note = chr3:2140398-2140435
  misc_feature 1..37: note = hyper
  source 1..37: mol_type = genomic DNA

SEQ ID NO: 48898 - DNA, 169 bp, Homo sapiens; identical to SEQ ID NO: 28030
  misc_feature 1..169: note = chr3:2140827-2140996
  misc_feature 1..169: note = hyper
  source 1..169: mol_type = genomic DNA

SEQ ID NO: 48899 - DNA, 288 bp, Homo sapiens
  misc_feature 1..288: note = chr3:3840758-3841046
  misc_feature 1..288: note = hyper
  source 1..288: mol_type = genomic DNA
cgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcgga

SEQ ID NO: 48900 - DNA, 430 bp, Homo sapiens; identical to SEQ ID NO: 28032
  misc_feature 1..430: note = chr3:3841494-3841924
  misc_feature 1..430: note = hyper
  source 1..430: mol_type = genomic DNA

SEQ ID NO: 48901 - DNA, 422 bp, Homo sapiens; identical to SEQ ID NO: 6759
  misc_feature 1..422: note = chr3:3842186-3842608
  misc_feature 1..422: note = hyper
  source 1..422: mol_type = genomic DNA

SEQ ID NO: 48902 - DNA, 262 bp, Homo sapiens; identical to SEQ ID NO: 28034
  misc_feature 1..262: note = chr3:4910288-4910550
  misc_feature 1..262: note = hyper
  source 1..262: mol_type = genomic DNA

SEQ ID NO: 48903 - DNA, 104 bp, Homo sapiens; identical to SEQ ID NO: 28035
  misc_feature 1..104: note = chr3:5018985-5019089
  misc_feature 1..104: note = hyper
  source 1..104: mol_type = genomic DNA

SEQ ID NO: 48904 - DNA, 161 bp, Homo sapiens
  misc_feature 1..161: note = chr3:5137799-5137960
  misc_feature 1..161: note = hyper
  source 1..161: mol_type = genomic DNA
gaagcccctgcagtgcgccccgcgaccaccagctggaaccaaaaggcggcgcgcaggcgcggagcccacggggagcccaggctggggcgcgtgtcagctccgcctgacctgccaccttccctaggcagcggggggcgggggtggggggtggtgcggggagt

SEQ ID NO: 48905 - DNA, 273 bp, Homo sapiens
  misc_feature 1..273: note = chr3:6902353-6902626
  misc_feature 1..273: note = hyper
  source 1..273: mol_type = genomic DNA
ggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctccccccattccccagccgcccacccgtttcc

SEQ ID NO: 48906 - DNA, 130 bp, Homo sapiens; identical to SEQ ID NO: 28038
  misc_feature 1..130: note = chr3:6902969-6903099
  misc_feature 1..130: note = hyper
  source 1..130: mol_type = genomic DNA

SEQ ID NO: 48907 - DNA, 86 bp, Homo sapiens; identical to SEQ ID NO: 28039
  misc_feature 1..86: note = chr3:6903624-6903710
  misc_feature 1..86: note = hyper
  source 1..86: mol_type = genomic DNA

SEQ ID NO: 48908 - DNA, 65 bp, Homo sapiens; identical to SEQ ID NO: 28040
  misc_feature 1..65: note = chr3:6904142-6904207
  misc_feature 1..65: note = hyper
  source 1..65: mol_type = genomic DNA

SEQ ID NO: 48909 - DNA, 318 bp, Homo sapiens; identical to SEQ ID NO: 28041
  misc_feature 1..318: note = chr3:8809397-8809715
  misc_feature 1..318: note = hyper
  source 1..318: mol_type = genomic DNA

SEQ ID NO: 48910 - DNA, 63 bp, Homo sapiens
  misc_feature 1..63: note = chr3:8810220-8810283
  misc_feature 1..63: note = hyper
  source 1..63: mol_type = genomic DNA
ggccacaagcccagagcccccagcgtgccagttcctcgggatgttcagcggcttccactgggg

SEQ ID NO: 48911 - DNA, 97 bp, Homo sapiens; identical to SEQ ID NO: 28043
  misc_feature 1..97: note = chr3:8810791-8810888
  misc_feature 1..97: note = hyper
  source 1..97: mol_type = genomic DNA

SEQ ID NO: 48912 - DNA, 302 bp, Homo sapiens; identical to SEQ ID NO: 28044
  misc_feature 1..302: note = chr3:8811111-8811413
  misc_feature 1..302: note = hyper
  source 1..302: mol_type = genomic DNA

SEQ ID NO: 48913 - DNA, 135 bp, Homo sapiens; identical to SEQ ID NO: 28045
  misc_feature 1..135: note = chr3:9177995-9178130
  misc_feature 1..135: note = hyper
  source 1..135: mol_type = genomic DNA

SEQ ID NO: 48914 - DNA, 360 bp, Homo sapiens; identical to SEQ ID NO: 28046
  misc_feature 1..360: note = chr3:9541700-9542060
  misc_feature 1..360: note = hyper
  source 1..360: mol_type = genomic DNA

SEQ ID NO: 48915 - DNA, 33 bp, Homo sapiens; identical to SEQ ID NO: 28047
  misc_feature 1..33: note = chr3:9542307-9542340
  misc_feature 1..33: note = hyper
  source 1..33: mol_type = genomic DNA

SEQ ID NO: 48916 - DNA, 21 bp, Homo sapiens
  misc_feature 1..21: note = chr3:9594015-9594036
  misc_feature 1..21: note = hyper
  source 1..21: mol_type = genomic DNA
gaaaagcgaaaagcaggtgat

SEQ ID NO: 48917 - DNA, 26 bp, Homo sapiens
  misc_feature 1..26: note = chr3:9594382-9594408
  misc_feature 1..26: note = hyper
  source 1..26: mol_type = genomic DNA
ggcggcggcggcggctggcgggggcc

SEQ ID NO: 48918 - DNA, 83 bp, Homo sapiens; identical to SEQ ID NO: 28051
  misc_feature 1..83: note = chr3:9595598-9595681
  misc_feature 1..83: note = hyper
  source 1..83: mol_type = genomic DNA

SEQ ID NO: 48919 - DNA, 125 bp, Homo sapiens; identical to SEQ ID NO: 28052
  misc_feature 1..125: note = chr3:9745353-9745478
  misc_feature 1..125: note = hyper
  source 1..125: mol_type = genomic DNA

SEQ ID NO: 48920 - DNA, 30 bp, Homo sapiens; identical to SEQ ID NO: 28053
  misc_feature 1..30: note = chr3:9745793-9745823
  misc_feature 1..30: note = hyper
  source 1..30: mol_type = genomic DNA

SEQ ID NO: 48921 - DNA, 107 bp, Homo sapiens
  misc_feature 1..107: note = chr3:9904554-9904661
  misc_feature 1..107: note = hyper
  source 1..107: mol_type = genomic DNA
gccgatggccattaaagccccgccccccgcggctcaccgccgcctggccccgtccccgaggccagaaaagaggagacccgaggccgtcagaccgcctgtcaagggct

SEQ ID NO: 48922 - DNA, 237 bp, Homo sapiens
  misc_feature 1..237: note = chr3:9956827-9957064
  misc_feature 1..237: note = hyper
  source 1..237: mol_type = genomic DNA
gcgggggcggagaggcgagcaccctacggtatcccgagagggtggggagaagagggctgagcagtccctcagccgcccagccttcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacct

SEQ ID NO: 48923 - DNA, 309 bp, Homo sapiens; identical to SEQ ID NO: 17975
  misc_feature 1..309: note = chr3:9957142-9957451
  misc_feature 1..309: note = hyper
  source 1..309: mol_type = genomic DNA

SEQ ID NO: 48924 - DNA, 25 bp, Homo sapiens
  misc_feature 1..25: note = chr3:9993908-9993933
  misc_feature 1..25: note = hyper
  source 1..25: mol_type = genomic DNA
ccgtgcaggcctggtcgcctgcgcc

SEQ ID NO: 48925 - DNA, 64 bp, Homo sapiens; identical to SEQ ID NO: 28057
  misc_feature 1..64: note = chr3:9993964-9994028
  misc_feature 1..64: note = hyper
  source 1..64: mol_type = genomic DNA

SEQ ID NO: 48926 - DNA, 280 bp, Homo sapiens; identical to SEQ ID NO: 28058
  misc_feature 1..280: note = chr3:10206828-10207108
  misc_feature 1..280: note = hyper
  source 1..280: mol_type = genomic DNA

SEQ ID NO: 48927 - DNA, 32 bp, Homo sapiens; identical to SEQ ID NO: 28059
  misc_feature 1..32: note = chr3:10547210-10547242
  misc_feature 1..32: note = hyper
  source 1..32: mol_type = genomic DNA

SEQ ID NO: 48928 - DNA, 694 bp, Homo sapiens; identical to SEQ ID NO: 28060
  misc_feature 1..694: note = chr3:10749237-10749931
  misc_feature 1..694: note = hyper
  source 1..694: mol_type = genomic DNA

SEQ ID NO: 48929 - DNA, 92 bp, Homo sapiens; identical to SEQ ID NO: 28061
  misc_feature 1..92: note = chr3:10857625-10857717
  misc_feature 1..92: note = hyper
  source 1..92: mol_type = genomic DNA

SEQ ID NO: 48930 - DNA, 40 bp, Homo sapiens; identical to SEQ ID NO: 28062
  misc_feature 1..40: note = chr3:10858369-10858409
  misc_feature 1..40: note = hyper
  source 1..40: mol_type = genomic DNA

SEQ ID NO: 48931 - DNA, 62 bp, Homo sapiens; identical to SEQ ID NO: 28063
  misc_feature 1..62: note = chr3:11034439-11034501
  misc_feature 1..62: note = hyper
  source 1..62: mol_type = genomic DNA

SEQ ID NO: 48932 - skipped

SEQ ID NO: 48933 - DNA, 354 bp, Homo sapiens
  misc_feature 1..354: note = chr3:11034716-11035070
  misc_feature 1..354: note = hyper
  source 1..354: mol_type = genomic DNA
ggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcattt

SEQ ID NO: 48934 - DNA, 23 bp, Homo sapiens
  misc_feature 1..23: note = chr3:11035330-11035353
  misc_feature 1..23: note = hyper
  source 1..23: mol_type = genomic DNA
ttttggtctctgcgtgtactccc

SEQ ID NO: 48935 - DNA, 52 bp, Homo sapiens; identical to SEQ ID NO: 28066
  misc_feature 1..52: note = chr3:11035382-11035434
  misc_feature 1..52: note = hyper
  source 1..52: mol_type = genomic DNA

SEQ ID NO: 48936 - DNA, 84 bp, Homo sapiens; identical to SEQ ID NO: 28067
  misc_feature 1..84: note = chr3:11196531-11196615
  misc_feature 1..84: note = hyper
  source 1..84: mol_type = genomic DNA

SEQ ID NO: 48937 - DNA, 365 bp, Homo sapiens; identical to SEQ ID NO: 28068
  misc_feature 1..365: note = chr3:12045988-12046353
  misc_feature 1..365: note = hyper
  source 1..365: mol_type = genomic DNA

SEQ ID NO: 48938 - DNA, 28 bp, Homo sapiens
  misc_feature 1..28: note = chr3:12046377-12046405
  misc_feature 1..28: note = hyper
  source 1..28: mol_type = genomic DNA
cgccaggaaggccaaggtgctgctggtg

SEQ ID NO: 48939 - DNA, 301 bp, Homo sapiens; identical to SEQ ID NO: 28070
  misc_feature 1..301: note = chr3:12329724-12330025
  misc_feature 1..301: note = hyper
  source 1..301: mol_type = genomic DNA

SEQ ID NO: 48940 - DNA, 79 bp, Homo sapiens; identical to SEQ ID NO: 28071
  misc_feature 1..79: note = chr3:12838044-12838123
  misc_feature 1..79: note = hyper
  source 1..79: mol_type = genomic DNA

SEQ ID NO: 48941 - skipped

SEQ ID NO: 48942 - DNA, 38 bp, Homo sapiens
  misc_feature 1..38: note = chr3:12917655-12917693
  misc_feature 1..38: note = hyper
  source 1..38: mol_type = genomic DNA
gtctggagggaggtggccccggccgccctcagaaatca

SEQ ID NO: 48943 - DNA, 55 bp, Homo sapiens
  misc_feature 1..55: note = chr3:13323439-13323494
  misc_feature 1..55: note = hyper
  source 1..55: mol_type = genomic DNA
gcccgaaggtccacacggtgaggctgctccgggtttcgacaccgacactcatggg

SEQ ID NO: 48944 - DNA, 56 bp, Homo sapiens; identical to SEQ ID NO: 17987
  misc_feature 1..56: note = chr3:13323973-13324029
  misc_feature 1..56: note = hyper
  source 1..56: mol_type = genomic DNA

SEQ ID NO: 48945 - DNA, 114 bp, Homo sapiens; identical to SEQ ID NO: 2205
  misc_feature 1..114: note = chr3:13324234-13324348
  misc_feature 1..114: note = hyper
  source 1..114: mol_type = genomic DNA

SEQ ID NO: 48946 - DNA, 241 bp, Homo sapiens
  misc_feature 1..241: note = chr3:13324433-13324674
  misc_feature 1..241: note = hyper
  source 1..241: mol_type = genomic DNA
cctgcaggtactcggccgcctggccggggggctcggcggcgctggccatggccccccgcccggaggccggccgcgcctcaggcgagcgggcggcggggcggcggcggcgcggccatggctgcgcggcggggacggcggctcggcgcggcgcggggctgccgcggccccgcctcggctcccgcctccgccggcgccgcccccggggcccccgcgcctcctgctccccgcgccgccgcgctcc

SEQ ID NO: 48947 - DNA, 107 bp, Homo sapiens; identical to SEQ ID NO: 17991
  misc_feature 1..107: note = chr3:13324740-13324847
  misc_feature 1..107: note = hyper
  source 1..107: mol_type = genomic DNA

SEQ ID NO: 48948 - DNA, 78 bp, Homo sapiens; identical to SEQ ID NO: 28078
  misc_feature 1..78: note = chr3:13590973-13591051
  misc_feature 1..78: note = hyper
  source 1..78: mol_type = genomic DNA

SEQ ID NO: 48949 - DNA, 125 bp, Homo sapiens; identical to SEQ ID NO: 28079
  misc_feature 1..125: note = chr3:13696641-13696766
  misc_feature 1..125: note = hyper
  source 1..125: mol_type = genomic DNA

SEQ ID NO: 48950 - DNA, 1064 bp, Homo sapiens; identical to SEQ ID NO: 28080
  misc_feature 1..1064: note = chr3:13919665-13920729
  misc_feature 1..1064: note = hyper
  source 1..1064: mol_type = genomic DNA

SEQ ID NO: 48951 - DNA, 427 bp, Homo sapiens
  misc_feature 1..427: note = chr3:13920980-13921407
  misc_feature 1..427: note = hyper
  source 1..427: mol_type = genomic DNA
ctggagcgtccctaccggctgtctctggtcctgggggattccagactcagacgtcctcaggatggccagtccccctgcctatatctcctggggtgtcctgcggggggcctttgtgcgtccaccgctcccacaccgcacccacccggcctctcagagaagctgtggaagttggccggcagaggctcgcaggcggcacacctccctccccgggccgtgccaactttgtcgaaacacgcgcggaaagggcgcaggcagcccttacccgatccggaggtagaccatgcccaggctgagaaagaggtggcccaggcagcgccgcgctttccggttcatagtcccgattggccgccggggccgcgggccgggctgtgctgatcccgcgggccggccccggcggggcaatcaacatagcccgcccgggaggcgc

SEQ ID NO: 48952 - DNA, 321 bp, Homo sapiens
  misc_feature 1..321: note = chr3:13921463-13921784
  misc_feature 1..321: note = hyper
  source 1..321: mol_type = genomic DNA
tgagcctcgccaggagcacgggagccacggagcgggaggagggagggaggagcgagcgcggcgtggggcgacgccgggctgcgcgcgagcgaccggtgcaagtgtgcgagacgcggggagtgcgggggcgctgctgcctccagcccccgcccctccctcctttcccccgtccctcccccgccccctcccccgcccgcctccccggagcgcccgcccagcgcccctgcgcccgcgggacagggccgcctgcacaaggcgcgcgctcgcgcctttccatgcgcgctcccgggggccccctccctgctccggggtgcaggtggc

SEQ ID NO: 48953 - DNA, 757 bp, Homo sapiens; identical to SEQ ID NO: 28082
  misc_feature 1..757: note = chr3:14643752-14644509
  misc_feature 1..757: note = hyper
  source 1..757: mol_type = genomic DNA

SEQ ID NO: 48954 - DNA, 25 bp, Homo sapiens
  misc_feature 1..25: note = chr3:14851825-14851850
  misc_feature 1..25: note = hyper
  source 1..25: mol_type = genomic DNA
aactcgctgagttctcgtccttcga

SEQ ID NO: 48955 - DNA, 30 bp, Homo sapiens; identical to SEQ ID NO: 17998
  misc_feature 1..30: note = chr3:14851897-14851927
  misc_feature 1..30: note = hyper
  source 1..30: mol_type = genomic DNA

SEQ ID NO: 48956 - DNA, 35 bp, Homo sapiens; identical to SEQ ID NO: 28084
  misc_feature 1..35: note = chr3:14852170-14852205
  misc_feature 1..35: note = hyper
  source 1..35: mol_type = genomic DNA

SEQ ID NO: 48957 - DNA, 113 bp, Homo sapiens
  misc_feature 1..113: note = chr3:14852212-14852325
  misc_feature 1..113: note = hyper
  source 1..113: mol_type = genomic DNA
cggagtccgaggcgcgccggggccgggcgggcgccagggggtgcgggccccgcggggcggccgcggagggaggcggtgtgcggagtcgcactgggacccgcggacggactgaa

SEQ ID NO: 48958 - DNA, 236 bp, Homo sapiens
  misc_feature 1..236: note = chr3:16554111-16554347
  misc_feature 1..236: note = hyper
  source 1..236: mol_type = genomic DNA
caaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgc

SEQ ID NO: 48959 - DNA, 277 bp, Homo sapiens
  misc_feature 1..277: note = chr3:16554633-16554910
  misc_feature 1..277: note = hyper
  source 1..277: mol_type = genomic DNA
agagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtc

SEQ ID NO: 48960 - DNA, 450 bp, Homo sapiens; identical to SEQ ID NO: 28089
  misc_feature 1..450: note = chr3:16554911-16555361
  misc_feature 1..450: note = hyper
  source 1..450: mol_type = genomic DNA

SEQ ID NO: 48961 - DNA, 30 bp, Homo sapiens; identical to SEQ ID NO: 28090
  misc_feature 1..30: note = chr3:16925675-16925705
  misc_feature 1..30: note = hyper
  source 1..30: mol_type = genomic DNA

SEQ ID NO: 48962 - DNA, 475 bp, Homo sapiens; identical to SEQ ID NO: 28091
  misc_feature 1..475: note = chr3:18485177-18485652
  misc_feature 1..475: note = hyper
  source 1..475: mol_type = genomic DNA

SEQ ID NO: 48963 - DNA, 231 bp, Homo sapiens; identical to SEQ ID NO: 28092
  misc_feature 1..231: note = chr3:18486970-18487201
  misc_feature 1..231: note = hyper
  source 1..231: mol_type = genomic DNA

SEQ ID NO: 48964 - DNA, 68 bp, Homo sapiens
  misc_feature 1..68: note = chr3:19189373-19189441
  misc_feature 1..68: note = hyper
  source 1..68: mol_type = genomic DNA
tcggggccagtttcccggactaaaagaccctggtgactggggatgggcctcacaactaactcgggctg

SEQ ID NO: 48965 - DNA, 36 bp, Homo sapiens
  misc_feature 1..36: note = chr3:19189470-19189506
  misc_feature 1..36: note = hyper
  source 1..36: mol_type = genomic DNA
gcaagtgctccggaagggggccgcctccccgtgggg

SEQ ID NO: 48966 - DNA, 365 bp, Homo sapiens
  misc_feature 1..365: note = chr3:19189778-19190143
  misc_feature 1..365: note = hyper
  source 1..365: mol_type = genomic DNA
cccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttct

SEQ ID NO: 48967 - skipped

SEQ ID NO: 48968 - DNA, 217 bp, Homo sapiens
  misc_feature 1..217: note = chr3:22413694-22413911
  misc_feature 1..217: note = hyper
  source 1..217: mol_type = genomic DNA
ggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaac

SEQ ID NO: 48969 - DNA, 104 bp, Homo sapiens; identical to SEQ ID NO: 18005
  misc_feature 1..104: note = chr3:22413974-22414078
  misc_feature 1..104: note = hyper
  source 1..104: mol_type = genomic DNA

SEQ ID NO: 48970 - DNA, 116 bp, Homo sapiens; identical to SEQ ID NO: 28097
  misc_feature 1..116: note = chr3:24535479-24535595
  misc_feature 1..116: note = hyper
  source 1..116: mol_type = genomic DNA

SEQ ID NO: 48971 - DNA, 203 bp, Homo sapiens; identical to SEQ ID NO: 28098
  misc_feature 1..203: note = chr3:24870641-24870844
  misc_feature 1..203: note = hyper
  source 1..203: mol_type = genomic DNA

SEQ ID NO: 48972 - DNA, 97 bp, Homo sapiens; identical to SEQ ID NO: 28100
  misc_feature 1..97: note = chr3:24871789-24871886
  misc_feature 1..97: note = hyper
  source 1..97: mol_type = genomic DNA

SEQ ID NO: 48973 - DNA, 156 bp, Homo sapiens; identical to SEQ ID NO: 28101
  misc_feature 1..156: note = chr3:24871946-24872102
  misc_feature 1..156: note = hyper
  source 1..156: mol_type = genomic DNA

SEQ ID NO: 48974 - DNA, 19 bp, Homo sapiens
  misc_feature 1..19: note = chr3:25469358-25469377
  misc_feature 1..19: note = hyper
  source 1..19: mol_type = genomic DNA
ggctggggggcgaggcggt

SEQ ID NO: 48975 - DNA, 52 bp, Homo sapiens
  misc_feature 1..52: note = chr3:25469406-25469458
  misc_feature 1..52: note = hyper
  source 1..52: mol_type = genomic DNA
caccgttttccaagctaagccgccgcaaataaaaaggcgtaaagggagagaa

SEQ ID NO: 48976 - DNA, 21 bp, Homo sapiens
  misc_feature 1..21: note = chr3:26664119-26664140
  misc_feature 1..21: note = hyper
  source 1..21: mol_type = genomic DNA
agcccccgcctcctctctcca

SEQ ID NO: 48977 - DNA, 877 bp, Homo sapiens
  misc_feature 1..877: note = chr3:26664755-26665632
  misc_feature 1..877: note = hyper
  source 1..877: mol_type = genomic DNA
gcagagcgcgggatcatccctctgcccgggtacctaggccgtccctccaaggaacaagtagaggagaactattacaccagttctaagccgtgcctgtctaagcctccctgatcccttttgcgcagaccctgggagagacctcctcctggagagagagagtcgaccctcttcgctcctgttcagccggctgctatacaatagtctgcaaacttttgtgaccccttccctgcgcggtgctcaccccgtgctgtgcaacttgcaggtttagttcttgcccttcccccagcccctcttgccatatgcatctgcccatttctctctgtgtgttcttgccagtcgacttttcactccccgcagctctggctcctgaggcgagggtttgggacccagcagtgctcgtcctgcctctaggagctgggtagggacagagaaggtgaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgggtgaagtaagtggctcagggagggaaaggctgctcgtgcggtggaggaggaagctgagggtcgggtagatctgcccacggttgagggaaatgaaaaggtactgctaatgtgggcgagcggccagccctgagaggccatctgacgaagaggaaaagggatttgagtccggagggcgctggcctgggtatgtaaatacagatgggggaggggctgggtacctgggggcgcgtggagacaaggaatggagccccggaatgccgggcccttgggtac

SEQ ID NO: 48978 - DNA, 170 bp, Homo sapiens; identical to SEQ ID NO: 28106
  misc_feature 1..170: note = chr3:27410909-27411079
  misc_feature 1..170: note = hyper
  source 1..170: mol_type = genomic DNA

SEQ ID NO: 48979 - DNA, 357 bp, Homo sapiens
  misc_feature 1..357: note = chr3:27754121-27754478
  misc_feature 1..357: note = hyper
  source 1..357: mol_type = genomic DNA
ctccatacgtgccctcggcgacacacagaggactcccagagttgaagaagggggtggatgtgtgtgtgcgcactcgcccacgtctcgtgttttacttttcatttaagtcgtaataaggagaaattcgatgaccagcaaggctggagtcccatcgtcttgttgggggagaggggggagaagaaaaaggtgcctgtaacttcagactgtccaagatatcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaaga

SEQ ID NO: 48980 - DNA, 24 bp, Homo sapiens
  misc_feature 1..24: note = chr3:27754508-27754532
  misc_feature 1..24: note = hyper
  source 1..24: mol_type = genomic DNA
gcttactcccgggctggaccttgg

SEQ ID NO: 48981 - DNA, 114 bp, Homo sapiens; identical to SEQ ID NO: 6813
  misc_feature 1..114: note = chr3:27754814-27754928
  misc_feature 1..114: note = hyper
  source 1..114: mol_type = genomic DNA

SEQ ID NO: 48982 - DNA, 120 bp, Homo sapiens; identical to SEQ ID NO: 28109
  misc_feature 1..120: note = chr3:27756087-27756207
  misc_feature 1..120: note = hyper
  source 1..120: mol_type = genomic DNA

SEQ ID NO: 48983 - DNA, 30 bp, Homo sapiens; identical to SEQ ID NO: 28110
  misc_feature 1..30: note = chr3:27756685-27756715
  misc_feature 1..30: note = hyper
  source 1..30: mol_type = genomic DNA

SEQ ID NO: 48984 - DNA, 156 bp, Homo sapiens
  misc_feature 1..156: note = chr3:27762701-27762857
  misc_feature 1..156: note = hyper
  source 1..156: mol_type = genomic DNA
gcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacac

SEQ ID NO: 48985 - DNA, 679 bp, Homo sapiens; identical to SEQ ID NO: 18015
  misc_feature 1..679: note = chr3:27762887-27763566
  misc_feature 1..679: note = hyper
  source 1..679: mol_type = genomic DNA

SEQ ID NO: 48986 - DNA, 567 bp, Homo sapiens
  misc_feature 1..567: note = chr3:27763595-27764162
  misc_feature 1..567: note = hyper
  source 1..567: mol_type = genomic DNA
ccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccgtgagttggaaagcaggaggtggaaactaacccagaagccctctccttttccttcctcgtacctcttgctcctcaggacccccaccctcctcccaggctcacacgctggaagaaggtgacttagatctttgtccccatccacccactagcccgcgcctttctgccctt

SEQ ID NO: 48987 - DNA, 34 bp, Homo sapiens
  misc_feature 1..34: note = chr3:27764423-27764457
  misc_feature 1..34: note = hyper
  source 1..34: mol_type = genomic DNA
tctgtaatttcgccggaatttagggggacaaagt

SEQ ID NO: 48988 - DNA, 76 bp, Homo sapiens
  misc_feature 1..76: note = chr3:27765105-27765181
  misc_feature 1..76: note = hyper
  source 1..76: mol_type = genomic DNA
tgcgcctctgctctgcggcaaatacagaaggtagaataattagtgaaataatcagtttgatattgaattaaactcc

SEQ ID NO: 48989 - DNA, 15 bp, Homo sapiens
  misc_feature 1..15: note = chr3:27765347-27765362
  misc_feature 1..15: note = hyper
  source 1..15: mol_type = genomic DNA
cgggagcgcattttc

SEQ ID NO: 48990 - DNA, 101 bp, Homo sapiens
  misc_feature 1..101: note = chr3:28616731-28616832
  misc_feature 1..101: note = hyper
  source 1..101: mol_type = genomic DNA
ttcctcctaccccatcgaccctctgttgccgacctttacgccaaactccggcgcgccgcgagactcgcgtcctcgctgtccccgaggggccccaccccttc

SEQ ID NO: 48991 - DNA, 269 bp, Homo sapiens
  misc_feature 1..269: note = chr3:28617675-28617944
  misc_feature 1..269: note = hyper
  source 1..269: mol_type = genomic DNA
cctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcga

SEQ ID NO: 48992 - DNA, 30 bp, Homo sapiens; identical to SEQ ID NO: 28117
  misc_feature 1..30: note = chr3:29322482-29322512
  misc_feature 1..30: note = hyper
  source 1..30: mol_type = genomic DNA

SEQ ID NO: 48993 - DNA, 168 bp, Homo sapiens; identical to SEQ ID NO: 28118
  misc_feature 1..168: note = chr3:32433865-32434033
  misc_feature 1..168: note = hyper
  source 1..168: mol_type = genomic DNA

SEQ ID NO: 48994 - DNA, 294 bp, Homo sapiens; identical to SEQ ID NO: 28119
  misc_feature 1..294: note = chr3:32443174-32443468
  misc_feature 1..294: note = hyper
  source 1..294: mol_type = genomic DNA

SEQ ID NO: 48995 - DNA, 635 bp, Homo sapiens
  misc_feature 1..635: note = chr3:32857718-32858353
  misc_feature 1..635: note = hyper
  source 1..635: mol_type = genomic DNA
gagttctttaaaaaacgtaaaaagaaaaaaagaaaaggtgggtaaaaaccgagatctcccgggcagtggatatgtctcggttgagccagggattcagaatgaaatcttttcttttcttttttaaataaacggaagagtcgttctctgctcctcgctcagaaggtttcaaaggtcgtcacactgaagcccgggggcgttcatctccccagcggccgggagaagggaggaggttggagggcggagggagggagcacacaaaagcgggccgtgctgagagggctaatgtttcctgtttgcctggagccccctcccctgcctcccctcccccagccccctcccagcactcgggcggaagtgagtttgctcctttggagattaaaaggattccgaattccgatcagtcccaataaccggcgtactgaagagaagaggaggaggaggaggaggcagaggcggcaaagcagagaaagagggggcgcgcgcgcgcgcacgcaacccgaactgggggagttgtgcaaagccccaggaggccggggcacggcgggagcaaagctcggtaggcgcagcgcggccgaggccacccgcgtccggatcggcgactcctttcagaaagaagatgacgcgggcgcgagccg

SEQ ID NO: 48996 - DNA, 375 bp, Homo sapiens; identical to SEQ ID NO: 18023
  misc_feature 1..375: note = chr3:32859693-32860068
  misc_feature 1..375: note = hyper
  source 1..375: mol_type = genomic DNA

SEQ ID NO: 48997 - DNA, 185 bp, Homo sapiens
  misc_feature 1..185: note = chr3:33259719-33259904
  misc_feature 1..185: note = hyper
  source 1..185: mol_type = genomic DNA
cccactcatctttcacgtcttcccggaccaagccaaaatatccgagggagttttctaaccatcggcggtgtcctcaggggcacattaatagacgttgagaaactgagggacggcggaaaatcaccccttagcagaggaggttctagggcaccttagaggtgatttcattcgagctttcttggaga

SEQ ID NO: 48998 - DNA, 20 bp, Homo sapiens
  misc_feature 1..20: note = chr3:33260776-33260796
  misc_feature 1..20: note = hyper
  source 1..20: mol_type = genomic DNA
gtcctcggcctctacttttc

SEQ ID NO: 48999 - DNA, 48 bp, Homo sapiens; identical to SEQ ID NO: 28124
  misc_feature 1..48: note = chr3:33318917-33318965
  misc_feature 1..48: note = hyper
  source 1..48: mol_type = genomic DNA

SEQ ID NO: 49000 - DNA, 28 bp, Homo sapiens
  misc_feature 1..28: note = chr3:35680814-35680842
  misc_feature 1..28: note = hyper
  source 1..28: mol_type = genomic DNA
cgtccggctgccgccacctcccgggtgt

SEQ ID NO: 49001 - DNA, 709 bp, Homo sapiens
  misc_feature 1..709: note = chr3:35680872-35681581
  misc_feature 1..709: note = hyper
  source 1..709: mol_type = genomic DNA
gagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccag

SEQ ID NO: 49002 - DNA, 30 bp, Homo sapiens; identical to SEQ ID NO: 28126
  misc_feature 1..30: note = chr3:36421872-36421902
  misc_feature 1..30: note = hyper
  source 1..30: mol_type = genomic DNA

SEQ ID NO: 49003 - DNA, 214 bp, Homo sapiens
  misc_feature 1..214: note = chr3:36805601-36805815
  misc_feature 1..214: note = hyper
  source 1..214: mol_type = genomic DNA
gcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcg

SEQ ID NO: 49004 - DNA, 267 bp, Homo sapiens
  misc_feature 1..267: note = chr3:36805863-36806130
  misc_feature 1..267: note = hyper
  source 1..267: mol_type = genomic DNA
ccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccc

SEQ ID NO: 49005 - DNA, 44 bp, Homo sapiens; identical to SEQ ID NO: 28129
  misc_feature 1..44: note = chr3:36986351-36986395
  misc_feature 1..44: note = hyper
  source 1..44: mol_type = genomic DNA

SEQ ID NO: 49006 - DNA, 57 bp, Homo sapiens; identical to SEQ ID NO: 28130
  misc_feature 1..57: note = chr3:36986663-36986720
  misc_feature 1..57: note = hyper
  source 1..57: mol_type = genomic DNA

SEQ ID NO: 49007 - DNA, 438 bp, Homo sapiens; identical to SEQ ID NO: 28131
  misc_feature 1..438: note = chr3:37493692-37494130
  misc_feature 1..438: note = hyper
  source 1..438: mol_type = genomic DNA

SEQ ID NO: 49008 - DNA, 85 bp, Homo sapiens
  misc_feature 1..85: note = chr3:38035989-38036074
  misc_feature 1..85: note = hyper
  source 1..85: mol_type = genomic DNA
ccgtggaggcggtgccttggctggggcagtcttgggatggccatcgtccacatccctgaatggggcaagccgggaggggttgggt

SEQ ID NO: 49009 - DNA, 83 bp, Homo sapiens; identical to SEQ ID NO: 28133
  misc_feature 1..83: note = chr3:38070745-38070828
  misc_feature 1..83: note = hyper
  source 1..83: mol_type = genomic DNA

SEQ ID NO: 49010 - DNA, 474 bp, Homo sapiens; identical to SEQ ID NO: 28134
  misc_feature 1..474: note = chr3:38071100-38071574
  misc_feature 1..474: note = hyper
  source 1..474: mol_type = genomic DNA

SEQ ID NO: 49011 - DNA, 59 bp, Homo sapiens
  misc_feature 1..59: note = chr3:38080626-38080685
  misc_feature 1..59: note = hyper
  source 1..59: mol_type = genomic DNA
agcgatgacgggatccgagagaaaggcaaggcggaaggggtgaggccggaagccgaagt

SEQ ID NO: 49012 - DNA, 84 bp, Homo sapiens; identical to SEQ ID NO: 18031
  misc_feature 1..84: note = chr3:38080925-38081009
  misc_feature 1..84: note = hyper
  source 1..84: mol_type = genomic DNA

SEQ ID NO: 49013 - DNA, 15 bp, Homo sapiens
  misc_feature 1..15: note = chr3:38081271-38081286
  misc_feature 1..15: note = hyper
  source 1..15: mol_type = genomic DNA
attctagtggaagga

SEQ ID NO: 49014 - DNA, 108 bp, Homo sapiens
  misc_feature 1..108: note = chr3:38690516-38690624
  misc_feature 1..108: note = hyper
  source 1..108: mol_type = genomic DNA
cagagaaagggggtgcgtggcttcctcccccatatccagccctgctcggtcagcccccgcaaaccccgctctctggaaccacattcatggcgcgcctagtcgccgctc

SEQ ID NO: 49015 - DNA, 59 bp, Homo sapiens
  misc_feature 1..59: note = chr3:38690668-38690727
  misc_feature 1..59: note = hyper
  source 1..59: mol_type = genomic DNA
gaccctccccgagcctgcgccagggatggccgggaagctggggccgcagctccccctcc

SEQ ID NO: 49016 - DNA, 26 bp, Homo sapiens
  misc_feature 1..26: note = chr3:38691468-38691494
  misc_feature 1..26: note = hyper
  source 1..26: mol_type = genomic DNA
cgacccggcgacgcttcaccacagat

SEQ ID NO: 49017 - DNA, 120 bp, Homo sapiens; identical to SEQ ID NO: 28139
  misc_feature 1..120: note = chr3:39851235-39851355
  misc_feature 1..120: note = hyper
  source 1..120: mol_type = genomic DNA

SEQ ID NO: 49018 - DNA, 57 bp, Homo sapiens; identical to SEQ ID NO: 28140
  misc_feature 1..57: note = chr3:39851638-39851695
  misc_feature 1..57: note = hyper
  source 1..57: mol_type = genomic DNA

SEQ ID NO: 49019 - DNA, 30 bp, Homo sapiens; identical to SEQ ID NO: 28141
  misc_feature 1..30: note = chr3:42305003-42305033
  misc_feature 1..30: note = hyper
  source 1..30: mol_type = genomic DNA

SEQ ID NO: 49020 - DNA, 30 bp, Homo sapiens; identical to SEQ ID NO: 28142
  misc_feature 1..30: note = chr3:42305329-42305359
  misc_feature 1..30: note = hyper
  source 1..30: mol_type = genomic DNA

SEQ ID NO: 49021 - DNA, 534 bp, Homo sapiens; identical to SEQ ID NO: 28143
  misc_feature 1..534: note = chr3:42543046-42543580
  misc_feature 1..534: note = hyper
  source 1..534: mol_type = genomic DNA

SEQ ID NO: 49022 - DNA, 311 bp, Homo sapiens
  misc_feature 1..311: note = chr3:42814258-42814569
  misc_feature 1..311: note = hyper
  source 1..311: mol_type = genomic DNA
gggaactgggagatgcggaagtgcacgccgtcgggtcgcatctttcagtgcggtgcgagagggcccagtggcagaggcccagcaaacagcgcttgtcaggcggacctgagttcgagttctgactgtgccatctacgctatgactttggggcaggcgacccaccctctgcgcctcattaacccatgtactgcatggaaaataagcgtctgcctgggttagaagagggctgtgtgtgaagattcaaaggacgaaggggaagagtcctcgctgggcgcccagcacgcggtgagcgcccggccagtggcagcgcg

SEQ ID NO: 49023 - DNA, 515 bp, Homo sapiens; identical to SEQ ID NO: 18036
  misc_feature 1..515: note = chr3:42814603-42815118
  misc_feature 1..515: note = hyper
  source 1..515: mol_type = genomic DNA

SEQ ID NO: 49024 - DNA, 42 bp, Homo sapiens
  misc_feature 1..42: note = chr3:42947369-42947411
  misc_feature 1..42: note = hyper
  source 1..42: mol_type = genomic DNA
gtctagtgaagtacccgctacctcctatcagcaaatatctgt

SEQ ID NO: 49025 - DNA, 120 bp, Homo sapiens
  misc_feature 1..120: note = chr3:42947552-42947672
  misc_feature 1..120: note = hyper
  source 1..120: mol_type = genomic DNA
tccctccccgagcgagaaaggaggaccacagagatgcggcgccctccgccgtcctagagcaaccggagcggcccgagccccggcctcccggatgctggggcctggcgggtgtggagcacg

SEQ ID NO: 49026 - DNA, 36 bp, Homo sapiens; identical to SEQ ID NO: 28146
  misc_feature 1..36: note = chr3:42947925-42947961
  misc_feature 1..36: note = hyper
  source 1..36: mol_type = genomic DNA

SEQ ID NO: 49027 - DNA, 498 bp, Homo sapiens; identical to SEQ ID NO: 28147
  misc_feature 1..498: note = chr3:43020926-43021424
  misc_feature 1..498: note = hyper
  source 1..498: mol_type = genomic DNA

SEQ ID NO: 49028 - DNA, 330 bp, Homo sapiens; identical to SEQ ID NO: 28148
  misc_feature 1..330: note = chr3:43935852-43936182
  misc_feature 1..330: note = hyper
  source 1..330: mol_type = genomic DNA

SEQ ID NO: 49029 - DNA, 27 bp, Homo sapiens
  misc_feature 1..27: note = chr3:44036233-44036260
  misc_feature 1..27: note = hyper
  source 1..27: mol_type = genomic DNA
ccggtcctggcctctcggtgttcaggt

SEQ ID NO: 49030 - DNA, 240 bp, Homo sapiens; identical to SEQ ID NO: 18040
  misc_feature 1..240: note = chr3:44036330-44036570
  misc_feature 1..240: note = hyper
  source 1..240: mol_type = genomic DNA

SEQ ID NO: 49031 - DNA, 220 bp, Homo sapiens; identical to SEQ ID NO: 18041
  misc_feature 1..220: note = chr3:44036600-44036820
  misc_feature 1..220: note = hyper
  source 1..220: mol_type = genomic DNA

SEQ ID NO: 49032 - DNA, 422 bp, Homo sapiens; identical to SEQ ID NO: 18042
  misc_feature 1..422: note = chr3:44037203-44037625
  misc_feature 1..422: note = hyper
  source 1..422: mol_type = genomic DNA

SEQ ID NO: 49033 - DNA, 212 bp, Homo sapiens; identical to SEQ ID NO: 18043
  misc_feature 1..212: note = chr3:44037662-44037874
  misc_feature 1..212: note = hyper
  source 1..212: mol_type = genomic DNA

SEQ ID NO: 49034 - DNA, 248 bp, Homo sapiens; identical to SEQ ID NO: 18044
  misc_feature 1..248: note = chr3:44038646-44038894
  misc_feature 1..248: note = hyper
  source 1..248: mol_type = genomic DNA

SEQ ID NO: 49035 - DNA, 20 bp, Homo sapiens
  misc_feature 1..20: note = chr3:44040006-44040026
  misc_feature 1..20: note = hyper
  source 1..20: mol_type = genomic DNA
tgcgagttggattcgcacca

SEQ ID NO: 49036 - DNA, 455 bp, Homo sapiens; identical to SEQ ID NO: 18046
  misc_feature 1..455: note = chr3:44040056-44040511
  misc_feature 1..455: note = hyper
  source 1..455: mol_type = genomic DNA

SEQ ID NO: 49037 - DNA, 243 bp, Homo sapiens; identical to SEQ ID NO: 18047
  misc_feature 1..243: note = chr3:44040553-44040796
  misc_feature 1..243: note = hyper
  source 1..243: mol_type = genomic DNA

SEQ ID NO: 49038 - DNA, 111 bp, Homo sapiens
  misc_feature 1..111: note = chr3:44041039-44041150
  misc_feature 1..111: note = hyper
  source 1..111: mol_type = genomic DNA
tgggatgctgtggggacagtgcgggggacgtgtggggtcttcggatgcgaacgcgagtccgtgcgatgcccaggtcaagtttgcagagagagtctgcggtgtctgtctcct

SEQ ID NO: 49039 - DNA, 94 bp, Homo sapiens
  misc_feature 1..94: note = chr3:44063340-44063434
  misc_feature 1..94: note = hyper
  source 1..94: mol_type = genomic DNA
ttgatttttggcccccgctgcagcaagttgggggctggtgaggagtgtagcggtgactgggggcggagtgcggactcgcatccgctgtaccagg

SEQ ID NO: 49040 - DNA, 19 bp, Homo sapiens
  misc_feature 1..19: note = chr3:44063872-44063891
  misc_feature 1..19: note = hyper
  source 1..19: mol_type = genomic DNA
ggtccggcacagaggctct

SEQ ID NO: 49041 - DNA, 207 bp, Homo sapiens; identical to SEQ ID NO: 28154
  misc_feature 1..207: note = chr3:44481337-44481544
  misc_feature 1..207: note = hyper
  source 1..207: mol_type = genomic DNA

SEQ ID NO: 49042 - DNA, 15 bp, Homo sapiens
  misc_feature 1..15: note = chr3:44596464-44596479
  misc_feature 1..15: note = hyper
  source 1..15: mol_type = genomic DNA
ggtgtagagctggga

SEQ ID NO: 49043 - DNA, 207 bp, Homo sapiens; identical to SEQ ID NO: 18050
  misc_feature 1..207: note = chr3:44596509-44596716
  misc_feature 1..207: note = hyper
  source 1..207: mol_type = genomic DNA

SEQ ID NO: 49044 - DNA, 222 bp, Homo sapiens
  misc_feature 1..222: note = chr3:44596809-44597031
  misc_feature 1..222: note = hyper
  source 1..222: mol_type = genomic DNA
ggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgctgttttcccagc

SEQ ID NO: 49045 - skipped

SEQ ID NO: 49046 - DNA, 10 bp, Homo sapiens
  misc_feature 1..10: note = chr3:44626711-44626721
  misc_feature 1..10: note = hyper
  source 1..10: mol_type = genomic DNA
ggaccaggct

SEQ ID NO: 49047 - DNA, 31 bp, Homo sapiens
  misc_feature 1..31: note = chr3:44726844-44726875
  misc_feature 1..31: note = hyper
  source 1..31: mol_type = genomic DNA
tgggtataaatatgaccgcaaaactgccctt

SEQ ID NO: 49048 - DNA, 54 bp, Homo sapiens
  misc_feature 1..54: note = chr3:44727193-44727247
  misc_feature 1..54: note = hyper
  source 1..54: mol_type = genomic DNA
tcgccgaccgctctaggaatctcggaggtcttttgacctcgacgcctccttacc

SEQ ID NO: 49049 - DNA, 40 bp, Homo sapiens; identical to SEQ ID NO: 28160
  misc_feature 1..40: note = chr3:44754372-44754412
  misc_feature 1..40: note = hyper
  source 1..40: mol_type = genomic DNA

SEQ ID NO: 49050 - DNA, 110 bp, Homo sapiens; identical to SEQ ID NO: 28161
  misc_feature 1..110: note = chr3:44770966-44771076
  misc_feature 1..110: note = hyper
  source 1..110: mol_type = genomic DNA

SEQ ID NO: 49051 - DNA, 632 bp, Homo sapiens; identical to SEQ ID NO: 28162
  misc_feature 1..632: note = chr3:45837540-45838172
  misc_feature 1..632: note = hyper
  source 1..632: mol_type = genomic DNA

SEQ ID NO: 49052 - DNA, 30 bp, Homo sapiens; identical to SEQ ID NO: 28163
  misc_feature 1..30: note = chr3:46607744-46607774
  misc_feature 1..30: note = hyper
  source 1..30: mol_type = genomic DNA

SEQ ID NO: 49053 - DNA, 229 bp, Homo sapiens; identical to SEQ ID NO: 28164
  misc_feature 1..229: note = chr3:46923250-46923479
  misc_feature 1..229: note = hyper
  source 1..229: mol_type = genomic DNA

SEQ ID NO: 49054 - DNA, 325 bp, Homo sapiens; identical to SEQ ID NO: 28165
  misc_feature 1..325: note = chr3:46923931-46924256
  misc_feature 1..325: note = hyper
  source 1..325: mol_type = genomic DNA

SEQ ID NO: 49055 - DNA, 39 bp, Homo sapiens; identical to SEQ ID NO: 28166
  misc_feature 1..39: note = chr3:46924989-46925028
  misc_feature 1..39: note = hyper
  source 1..39: mol_type = genomic DNA

SEQ ID NO: 49056 - DNA, 30 bp, Homo sapiens
  misc_feature 1..30: note = chr3:48693274-48693304
  misc_feature 1..30: note = hyper
  source 1..30: mol_type = genomic DNA
tgtcgcgaacctgggcggggtgggaggggg

SEQ ID NO: 49057 - DNA, 206 bp, Homo sapiens
  misc_feature 1..206: note = chr3:48699767-48699973
  misc_feature 1..206: note = hyper
  source 1..206: mol_type = genomic DNA
ccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcct

SEQ ID NO: 49058 - DNA, 154 bp, Homo sapiens; identical to SEQ ID NO: 28172
  misc_feature 1..154: note = chr3:48700273-48700427
  misc_feature 1..154: note = hyper
  source 1..154: mol_type = genomic DNA

SEQ ID NO: 49059 - DNA, 41 bp, Homo sapiens; identical to SEQ ID NO: 6865
  misc_feature 1..41: note = chr3:49851326-49851367
  misc_feature 1..41: note = hyper
  source 1..41: mol_type = genomic DNA

SEQ ID NO: 49060 - DNA, 61 bp, Homo sapiens
  misc_feature 1..61: note = chr3:49907032-49907093
  misc_feature 1..61: note = hyper
  source 1..61: mol_type = genomic DNA
caaatctgcaaagcccgcgcgctctgaccccgccaggacctcgagccctcgctgcgccccc

SEQ ID NO: 49061 - DNA, 223 bp, Homo sapiens
  misc_feature 1..223: note = chr3:49907130-49907353
  misc_feature 1..223: note = hyper
  source 1..223: mol_type = genomic DNA
atcccccaaggccccacaacctgcgttcgggaagcgcccccagcccggcccgccccgcacctgcagcgccggttggtcacagggaggaagtgatcgcgggctcagcggggcgccgagggctccggggacggcgggcagaatccgctccgagcacgcggggcagacgcggcgccagatgcagccgcttcggctagcgaacctccagcatcgccagccgcttgcc

SEQ ID NO: 49062 - DNA, 108 bp, Homo sapiens; identical to SEQ ID NO: 28175
  misc_feature 1..108: note = chr3:49941331-49941439
  misc_feature 1..108: note = hyper
  source 1..108: mol_type = genomic DNA

SEQ ID NO: 49063 - DNA, 41 bp, Homo sapiens; identical to SEQ ID NO: 28176
  misc_feature 1..41: note = chr3:50232113-50232154
  misc_feature 1..41: note = hyper
  source 1..41: mol_type = genomic DNA

SEQ ID NO: 49064 - DNA, 429 bp, Homo sapiens
  misc_feature 1..429: note = chr3:50242954-50243383
  misc_feature 1..429: note = hyper
  source 1..429: mol_type = genomic DNA
tggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgccttgttgggggctcgggcggcacaccacaggcttcctgaggcagggcccatggggcaggctggagagggcccgaggggaggacccaagaggggcctggagcagtccctggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagagg

SEQ ID NO: 49065 - DNA, 40 bp, Homo sapiens; identical to SEQ ID NO: 18062
  misc_feature 1..40: note = chr3:50243480-50243520
  misc_feature 1..40: note = hyper
  source 1..40: mol_type = genomic DNA

SEQ ID NO: 49066 - DNA, 76 bp, Homo sapiens
  misc_feature 1..76: note = chr3:50402944-50403020
  misc_feature 1..76: note = hyper
  source 1..76: mol_type = genomic DNA
cacagaccctggcaaggtctccggcctccctcagtcgtagaccccaccctccccatggagtcgtcttagctcagat

SEQ ID NO: 49067 - DNA, 147 bp, Homo sapiens; identical to SEQ ID NO: 28180
  misc_feature 1..147: note = chr3:50540350-50540497
  misc_feature 1..147: note = hyper
  source 1..147: mol_type = genomic DNA

SEQ ID NO: 49068 - DNA, 30 bp, Homo sapiens; identical to SEQ ID NO: 28181
  misc_feature 1..30: note = chr3:50567928-50567958
  misc_feature 1..30: note = hyper
  source 1..30: mol_type = genomic DNA

SEQ ID NO: 49069 - DNA, 124 bp, Homo sapiens; identical to SEQ ID NO: 28182
  misc_feature 1..124: note = chr3:50605238-50605362
  misc_feature 1..124: note = hyper
  source 1..124: mol_type = genomic DNA

SEQ ID NO: 49070 - DNA, 274 bp, Homo sapiens; identical to SEQ ID NO: 28183
  misc_feature 1..274: note = chr3:50712086-50712360
  misc_feature 1..274: note = hyper
  source 1..274: mol_type = genomic DNA

SEQ ID NO: 49071 - DNA, 105 bp, Homo sapiens; identical to SEQ ID NO: 28184
  misc_feature 1..105: note = chr3:51990011-51990116
  misc_feature 1..105: note = hyper
  source 1..105: mol_type = genomic DNA

SEQ ID NO: 49072 - DNA, 52 bp, Homo sapiens; identical to SEQ ID NO: 28185
  misc_feature 1..52: note = chr3:51990429-51990481
  misc_feature 1..52: note = hyper
  source 1..52: mol_type = genomic DNA

SEQ ID NO: 49073 - DNA, 42 bp, Homo sapiens; identical to SEQ ID NO: 28186
  misc_feature 1..42: note = chr3:54154759-54154801
  misc_feature 1..42: note = hyper
  source 1..42: mol_type = genomic DNA

SEQ ID NO: 49074 - DNA, 269 bp, Homo sapiens; identical to SEQ ID NO: 6870
  misc_feature 1..269: note = chr3:54155224-54155493
  misc_feature 1..269: note = hyper
  source 1..269: mol_type = genomic DNA

SEQ ID NO: 49075 - DNA, 87 bp, Homo sapiens
  misc_feature 1..87: note = chr3:54155524-54155611
  misc_feature 1..87: note = hyper
  source 1..87: mol_type = genomic DNA
cgagaaggcgcctcctccggcgctcactgcctcctgcccagtgcggtgggcgccggagtggggagcaggcaatcccccaggctcgga

SEQ ID NO: 49076 - DNA, 401 bp, Homo sapiens
  misc_feature 1..401: note = chr3:54155677-54156078
  misc_feature 1..401: note = hyper
  source 1..401: mol_type = genomic DNA
ctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcg

SEQ ID NO: 49077 - DNA, 273 bp, Homo sapiens; identical to SEQ ID NO: 28189
  misc_feature 1..273: note = chr3:54156356-54156629
  misc_feature 1..273: note = hyper
  source 1..273: mol_type = genomic DNA

SEQ ID NO: 49078 - DNA, 420 bp, Homo sapiens; identical to SEQ ID NO: 28190
  misc_feature 1..420: note = chr3:54156654-54157074
  misc_feature 1..420: note = hyper
  source 1..420: mol_type = genomic DNA

SEQ ID NO: 49079 - DNA, 66 bp, Homo sapiens; identical to SEQ ID NO: 18068
  misc_feature 1..66: note = chr3:54157315-54157381
  misc_feature 1..66: note = hyper
  source 1..66: mol_type = genomic DNA

SEQ ID NO: 49080 - DNA, 353 bp, Homo sapiens
  misc_feature 1..353: note = chr3:54157450-54157803
  misc_feature 1..353: note = hyper
  source 1..353: mol_type = genomic DNA
gccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatggaggcagatttagttttccaaacaaacgtgagccccgagcagcatcagttatcggaggactctctgatccccgggtttcttggcattgtactatgcagtgacttcttcctaccaaccggttatttttagat

SEQ ID NO: 49081 - DNA, 209 bp, Homo sapiens; identical to SEQ ID NO: 28192
  misc_feature 1..209: note = chr3:55520384-55520593
  misc_feature 1..209: note = hyper
  source 1..209: mol_type = genomic DNA

SEQ ID NO: 49082 - DNA, 355 bp, Homo sapiens; identical to SEQ ID NO: 28193
  misc_feature 1..355: note = chr3:55521035-55521390
  misc_feature 1..355: note = hyper
  source 1..355: mol_type = genomic DNA

SEQ ID NO: 49083 - DNA, 204 bp, Homo sapiens; identical to SEQ ID NO: 28194
  misc_feature 1..204: note = chr3:55521754-55521958
  misc_feature 1..204: note = hyper
  source 1..204: mol_type = genomic DNA

SEQ ID NO: 49084 - DNA, 511 bp, Homo sapiens
  misc_feature 1..511: note = chr3:55522595-55523106
  misc_feature 1..511: note = hyper
  source 1..511: mol_type = genomic DNA
gcaggattttaaagccgtactacgggctggggtgccgggaggcggggtacactctccttgtctccccttctctaagttccccatcccccgcggcatctgctgaaagagagaggtccactccgcagccgctgcctgcctgccgcctggttgtctgcgctccttccagagccaccgaccggcgggaggctgaaccccaacttccccgcctggaccccttggctcgcccgcgtatcccagaccgctcccactggggctccacggagactgctgccttgacatggaacctcatgggggacctcctcattcttacctctgggggaggatacttaagcactggggctgatggatagggttaggcgctcacctcctgcaaagtccccagagtagtagggacttgggtagtgggatgcatgattgctcatctggctccggcccagagcatgaggcgcgatgcgtggtcctgccacggagatcttggcgggtgccctcaggtgaggagattgcgaagttt

SEQ ID NO: 49085 - DNA, 179 bp, Homo sapiens; identical to SEQ ID NO: 28196
  misc_feature 1..179: note = chr3:56502587-56502766
  misc_feature 1..179: note = hyper
  source 1..179: mol_type = genomic DNA

SEQ ID NO: 49086 - DNA, 28 bp, Homo sapiens
  misc_feature 1..28: note = chr3:56502800-56502828
  misc_feature 1..28: note = hyper
  source 1..28: mol_type = genomic DNA
cgacgccccttcccgggtacccccctcc

SEQ ID NO: 49087 - DNA, 30 bp, Homo sapiens; identical to SEQ ID NO: 28198
  misc_feature 1..30: note = chr3:57204154-57204184
  misc_feature 1..30: note = hyper
  source 1..30: mol_type = genomic DNA

SEQ ID NO: 49088 - DNA, 30 bp, Homo sapiens; identical to SEQ ID NO: 28199
  misc_feature 1..30: note = chr3:58571373-58571403
  misc_feature 1..30: note = hyper
  source 1..30: mol_type = genomic DNA

SEQ ID NO: 49089 - DNA, 91 bp, Homo sapiens; identical to SEQ ID NO: 28200
  misc_feature 1..91: note = chr3:61548917-61549008
  misc_feature 1..91: note = hyper
  source 1..91: mol_type = genomic DNA

SEQ ID NO: 49090 - DNA, 30 bp, Homo sapiens; identical to SEQ ID NO: 28201
  misc_feature 1..30: note = chr3:61550498-61550528
  misc_feature 1..30: note = hyper
  source 1..30: mol_type = genomic DNA

SEQ ID NO: 49091 - DNA, 74 bp, Homo sapiens; identical to SEQ ID NO: 28202
  misc_feature 1..74: note = chr3:62305019-62305093
  misc_feature 1..74: note = hyper
  source 1..74: mol_type = genomic DNA

SEQ ID NO: 49092 - DNA, 34 bp, Homo sapiens
  misc_feature 1..34: note = chr3:62354249-62354283
  misc_feature 1..34: note = hyper
  source 1..34: mol_type = genomic DNA
agggggtgccctttgcgttaagcatctttccctt

SEQ ID NO: 49093 - DNA, 57 bp, Homo sapiens
  misc_feature 1..57: note = chr3:62354328-62354385
  misc_feature 1..57: note = hyper
  source 1..57: mol_type = genomic DNA
cagccacactcgccccctcaatggggaggttgcgtggaagcgcactcccgggccccg

SEQ ID NO: 49094 - DNA, 180 bp, Homo sapiens
  misc_feature 1..180: note = chr3:62354445-62354625
  misc_feature 1..180: note = hyper
  source 1..180: mol_type = genomic DNA
cgcggatattaaaagtgtgtgtggggggaggcccggagcgacgcgccagtaatccgagctcttgattatccagattcggatcaaacggggcggcggcggccggccccctcctgggaatgattagatgattaatgtaatgctgtttgaagggtctctgttttctctcttaatttgggtcat

SEQ ID NO: 49095 - DNA, 142 bp, Homo sapiens
  misc_feature 1..142: note = chr3:62354914-62355056
  misc_feature 1..142: note = hyper
  source 1..142: mol_type = genomic DNA
ttaggtctcccggagaaggggacgcgcccagaagctctccggtggggtagggcgtagatcgcttaccctcgcggggcgtggcgctttgctcaaggacgctcccaaaagctgctccccaacacccagtcgcttttaacccttt

SEQ ID NO: 49096 - DNA, 124 bp, Homo sapiens
  misc_feature 1..124: note = chr3:62355300-62355424
  misc_feature 1..124: note = hyper
  source 1..124: mol_type = genomic DNA
ttgctgagctgacctcgccgcgaggggagagggggaaaaaaacgcgcactaatgattctgtttattgagttatatatgtatatattccgtgttcgcttgtacaggaggatttacatggctgtat

SEQ ID NO: 49097 - DNA, 296 bp, Homo sapiens
  misc_feature 1..296: note = chr3:62355478-62355774
  misc_feature 1..296: note = hyper
  source 1..296: mol_type = genomic DNA
gttaaaactggctgccccaggagaagcggaggcctggaattaaatacgtttcggcgcactggatttaaataagtttcctgaatatacaaaggtgggggccacgagtttgctgccagtcatcgaggaaacatttagctttccaaaaatatgctggtttcgataaatagattttagcctctctgctatagtttttttttcttttaattttagaaataagtttatatgtgtgatctgttttcaggtggtacagggagggaaggaagggcaaggcagtagctctcagctctgcactgtcc

SEQ ID NO: 49098 - DNA, 129 bp, Homo sapiens; identical to SEQ ID NO: 18076
  misc_feature 1..129: note = chr3:62357495-62357624
  misc_feature 1..129: note = hyper
  source 1..129: mol_type = genomic DNA

SEQ ID NO: 49099 - skipped

SEQ ID NO: 49100 - DNA, 382 bp, Homo sapiens; identical to SEQ ID NO: 28211
  misc_feature 1..382: note = chr3:62357735-62358117
  misc_feature 1..382: note = hyper
  source 1..382: mol_type = genomic DNA

SEQ ID NO: 49101 - DNA, 194 bp, Homo sapiens; identical to SEQ ID NO: 18079
  misc_feature 1..194: note = chr3:62358336-62358530
  misc_feature 1..194: note = hyper
  source 1..194: mol_type = genomic DNA

SEQ ID NO: 49102 - DNA, 365 bp, Homo sapiens
  misc_feature 1..365: note = chr3:62359011-62359376
  misc_feature 1..365: note = hyper
  source 1..365: mol_type = genomic DNA
acattttgatggcaaacatcttcccctccgcgtgagatcactgtcttttacattcagctgacatcacatgaagtcacttgaagtggaatgacatgggcggcggcgcggctcccgtagcggcccctgtgttcccccgcgcctgccggccgccgccaccaccgcccctcaaactttaaaaggaggcaactggcgcccgcgctcctctcgggaaagtgcgagcggtttgcgaatagggaaagagggaagagacgggagggggagggggaggaatcgtgatggttttgccggtggaaggaaagggggggggggacccaaacccaaacctaggcagagttccgtgcgtgattcacaactttggaggcctg

SEQ ID NO: 49103 - DNA, 409 bp, Homo sapiens; identical to SEQ ID NO: 18080
  misc_feature 1..409: note = chr3:62359893-62360302
  misc_feature 1..409: note = hyper
  source 1..409: mol_type = genomic DNA

SEQ ID NO: 49104 - DNA, 25 bp, Homo sapiens
  misc_feature 1..25: note = chr3:62362712-62362737
  misc_feature 1..25: note = hyper
  source 1..25: mol_type = genomic DNA
ccgggcgcccaggcccgtggccttc

SEQ ID NO: 49105 - DNA, 86 bp, Homo sapiens
  misc_feature 1..86: note = chr3:62362816-62362902
  misc_feature 1..86: note = hyper
  source 1..86: mol_type = genomic DNA
cgaggcctcagccccaggcctatttcacttggagcgcctcagcctagagccggacgctttggcttcttcgccatctggccctaggt

SEQ ID NO: 49106 - DNA, 30 bp, Homo sapiens; identical to SEQ ID NO: 18082
  misc_feature 1..30: note = chr3:62363596-62363626
  misc_feature 1..30: note = hyper
  source 1..30: mol_type = genomic DNA

SEQ ID NO: 49107 - DNA, 213 bp, Homo sapiens; identical to SEQ ID NO: 18083
  misc_feature 1..213: note = chr3:62363693-62363906
  misc_feature 1..213: note = hyper
  source 1..213: mol_type = genomic DNA

SEQ ID NO: 49108 - DNA, 407 bp, Homo sapiens; identical to SEQ ID NO: 28220
  misc_feature 1..407: note = chr3:62860194-62860601
  misc_feature 1..407: note = hyper
  source 1..407: mol_type = genomic DNA

SEQ ID NO: 49109 - DNA, 32 bp, Homo sapiens; identical to SEQ ID NO: 28221
  misc_feature 1..32: note = chr3:62861293-62861325
  misc_feature 1..32: note = hyper
  source 1..32: mol_type = genomic DNA

SEQ ID NO: 49110 - DNA, 54 bp, Homo sapiens; identical to SEQ ID NO: 6897
  misc_feature 1..54: note = chr3:62861840-62861894
  misc_feature 1..54: note = hyper
  source 1..54: mol_type = genomic DNA

SEQ ID NO: 49111 - DNA, 46 bp, Homo sapiens; identical to SEQ ID NO: 28223
  misc_feature 1..46: note = chr3:63263792-63263838
  misc_feature 1..46: note = hyper
  source 1..46: mol_type = genomic DNA

SEQ ID NO: 49112 - DNA, 586 bp, Homo sapiens; identical to SEQ ID NO: 28224
  misc_feature 1..586: note = chr3:63264254-63264840
  misc_feature 1..586: note = hyper
  source 1..586: mol_type = genomic DNA

SEQ ID NO: 49113 - DNA, 335 bp, Homo sapiens; identical to SEQ ID NO: 28225
  misc_feature 1..335: note = chr3:64430570-64430905
  misc_feature 1..335: note = hyper
  source 1..335: mol_type = genomic DNA

SEQ ID NO: 49114 - DNA, 232 bp, Homo sapiens; identical to SEQ ID NO: 28226
  misc_feature 1..232: note = chr3:64672181-64672413
  misc_feature 1..232: note = hyper
  source 1..232: mol_type = genomic DNA

SEQ ID NO: 49115 - DNA, 26 bp, Homo sapiens
  misc_feature 1..26: note = chr3:65535077-65535103
  misc_feature 1..26: note = hyper
  source 1..26: mol_type = genomic DNA
gttacctgcgggccccggagcggccc

SEQ ID NO: 49116 - DNA, 35 bp, Homo sapiens; identical to SEQ ID NO: 18087
  misc_feature 1..35: note = chr3:68057145-68057180
  misc_feature 1..35: note = hyper
  source 1..35: mol_type = genomic DNA

SEQ ID NO: 49117 - DNA, 151 bp, Homo sapiens
  misc_feature 1..151: note = chr3:68980780-68980931
  misc_feature 1..151: note = hyper
  source 1..151: mol_type = genomic DNA
tcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtggggg

SEQ ID NO: 49118 - DNA, 190 bp, Homo sapiens
  misc_feature 1..190: note = chr3:68981113-68981303
  misc_feature 1..190: note = hyper
  source 1..190: mol_type = genomic DNA
acatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggct

SEQ ID NO: 49119 - DNA, 189 bp, Homo sapiens; identical to SEQ ID NO: 28231
  misc_feature 1..189: note = chr3:68981626-68981815
  misc_feature 1..189: note = hyper
  source 1..189: mol_type = genomic DNA

SEQ ID NO: 49120 - DNA, 15 bp, Homo sapiens
  misc_feature 1..15: note = chr3:68981851-68981866
  misc_feature 1..15: note = hyper
  source 1..15: mol_type = genomic DNA
cgcgcccccactgcc

SEQ ID NO: 49121 - DNA, 181 bp, Homo sapiens; identical to SEQ ID NO: 28233
  misc_feature 1..181: note = chr3:68981867-68982048
  misc_feature 1..181: note = hyper
  source 1..181: mol_type = genomic DNA

SEQ ID NO: 49122 - DNA, 507 bp, Homo sapiens; identical to SEQ ID NO: 28234
  misc_feature 1..507: note = chr3:69435151-69435658
  misc_feature 1..507: note = hyper
  source 1..507: mol_type = genomic DNA

SEQ ID NO: 49123 - DNA, 51 bp, Homo sapiens
  misc_feature 1..51: note = chr3:69590888-69590939
  misc_feature 1..51: note = hyper
  source 1..51: mol_type = genomic DNA
aaaagggcagccaaacgaaacccttagtgtcctctgctaactccagggatt

SEQ ID NO: 49124 - DNA, 158 bp, Homo sapiens
  misc_feature 1..158: note = chr3:69590969-69591127
  misc_feature 1..158: note = hyper
  source 1..158: mol_type = genomic DNA
gtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaag

SEQ ID NO: 49125 - DNA, 53 bp, Homo sapiens
  misc_feature 1..53: note = chr3:69591310-69591363
  misc_feature 1..53: note = hyper
  source 1..53: mol_type = genomic DNA
cgccctggcagcacgcttggggagcccggggcggtcgcccacctacctgctcc

SEQ ID NO: 49126 - DNA, 102 bp, Homo sapiens; identical to SEQ ID NO: 28238
  misc_feature 1..102: note = chr3:71179297-71179399
  misc_feature 1..102: note = hyper
  source 1..102: mol_type = genomic DNA

SEQ ID NO: 49127 - DNA, 174 bp, Homo sapiens
  misc_feature 1..174: note = chr3:71802622-71802796
  misc_feature 1..174: note = hyper
  source 1..174: mol_type = genomic DNA
aacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggaggggagggggct

SEQ ID NO: 49128 - DNA, 270 bp, Homo sapiens
  misc_feature 1..270: note = chr3:71802856-71803126
  misc_feature 1..270: note = hyper
  source 1..270: mol_type = genomic DNA
gcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctc

SEQ ID NO: 49129 - DNA, 183 bp, Homo sapiens; identical to SEQ ID NO: 28242
  misc_feature 1..183: note = chr3:71803826-71804009
  misc_feature 1..183: note = hyper
  source 1..183: mol_type = genomic DNA

SEQ ID NO: 49130 - DNA, 30 bp, Homo sapiens; identical to SEQ ID NO: 28243
  misc_feature 1..30: note = chr3:71833673-71833703
  misc_feature 1..30: note = hyper
  source 1..30: mol_type = genomic DNA

SEQ ID NO: 49131 - DNA, 494 bp, Homo sapiens; identical to SEQ ID NO: 28244
  misc_feature 1..494: note = chr3:71834231-71834725
  misc_feature 1..494: note = hyper
  source 1..494: mol_type = genomic DNA

SEQ ID NO: 49132 - DNA, 30 bp, Homo sapiens; identical to SEQ ID NO: 28245
  misc_feature 1..30: note = chr3:72788104-72788134
  misc_feature 1..30: note = hyper
  source 1..30: mol_type = genomic DNA

SEQ ID NO: 49133 - DNA, 41 bp, Homo sapiens; identical to SEQ ID NO: 28246
  misc_feature 1..41: note = chr3:73674183-73674224
  misc_feature 1..41: note = hyper
  source 1..41: mol_type = genomic DNA

SEQ ID NO: 49134 - DNA, 30 bp, Homo sapiens; identical to SEQ ID NO: 28247
  misc_feature 1..30: note = chr3:74664104-74664134
  misc_feature 1..30: note = hyper
  source 1..30: mol_type = genomic DNA

SEQ ID NO: 49135 - DNA, 125 bp, Homo sapiens; identical to SEQ ID NO: 28248
  misc_feature 1..125: note = chr3:75955872-75955997
  misc_feature 1..125: note = hyper
  source 1..125: mol_type = genomic DNA

SEQ ID NO: 49136 - DNA, 50 bp, Homo sapiens; identical to SEQ ID NO: 28250
  misc_feature 1..50: note = chr3:77089150-77089200
  misc_feature 1..50: note = hyper
  source 1..50: mol_type = genomic DNA

SEQ ID NO: 49137 - DNA, 60 bp, Homo sapiens; identical to SEQ ID NO: 28251
  misc_feature 1..60: note = chr3:77089428-77089488
  misc_feature 1..60: note = hyper
  source 1..60: mol_type = genomic DNA

SEQ ID NO: 49138 - DNA, 38 bp, Homo sapiens; identical to SEQ ID NO: 28252
  misc_feature 1..38: note = chr3:79068137-79068175
  misc_feature 1..38: note = hyper
  source 1..38: mol_type = genomic DNA

SEQ ID NO: 49139 - DNA, 356 bp, Homo sapiens
  misc_feature 1..356: note = chr3:79815557-79815913
  misc_feature 1..356: note = hyper
  source 1..356: mol_type = genomic DNA
atgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaaccgaaggctcatggaagcggggctggcaagat

SEQ ID NO: 49140 - DNA, 40 bp, Homo sapiens
  misc_feature 1..40: note = chr3:79817318-79817358
  misc_feature 1..40: note = hyper
  source 1..40: mol_type = genomic DNA
tgtaatgcctgctgcgatgtttaaccgaggggggaggaaa

SEQ ID NO: 49141 - DNA, 570 bp, Homo sapiens; identical to SEQ ID NO: 28256
  misc_feature 1..570: note = chr3:85007729-85008299
  misc_feature 1..570: note = hyper
  source 1..570: mol_type = genomic DNA

SEQ ID NO: 49142 - DNA, 18 bp, Homo sapiens
  misc_feature 1..18: note = chr3:85008708-85008726
  misc_feature 1..18: note = hyper
  source 1..18: mol_type = genomic DNA
agcatctacttgccccct

SEQ ID NO: 49143 - DNA, 69 bp, Homo sapiens; identical to SEQ ID NO: 28258
  misc_feature 1..69: note = chr3:85009234-85009303
  misc_feature 1..69: note = hyper
  source 1..69: mol_type = genomic DNA

SEQ ID NO: 49144 - DNA, 96 bp, Homo sapiens; identical to SEQ ID NO: 28259
  misc_feature 1..96: note = chr3:85009769-85009865
  misc_feature 1..96: note = hyper
  source 1..96: mol_type = genomic DNA

SEQ ID NO: 49145 - DNA, 40 bp, Homo sapiens; identical to SEQ ID NO: 28260
  misc_feature 1..40: note = chr3:85010590-85010630
  misc_feature 1..40: note = hyper
  source 1..40: mol_type = genomic DNA

SEQ ID NO: 49146 - DNA, 56 bp, Homo sapiens; identical to SEQ ID NO: 28261
  misc_feature 1..56: note = chr3:87040188-87040244
  misc_feature 1..56: note = hyper
  source 1..56: mol_type = genomic DNA

SEQ ID NO: 49147 - DNA, 57 bp, Homo sapiens; identical to SEQ ID NO: 28262
  misc_feature 1..57: note = chr3:87040446-87040503
  misc_feature 1..57: note = hyper
  source 1..57: mol_type = genomic DNA

SEQ ID NO: 49148 - DNA, 161 bp, Homo sapiens; identical to SEQ ID NO: 28263
  misc_feature 1..161: note = chr3:87841521-87841682
  misc_feature 1..161: note = hyper
  source 1..161: mol_type = genomic DNA

SEQ ID NO: 49149 - DNA, 188 bp, Homo sapiens; identical to SEQ ID NO: 28264
  misc_feature 1..188: note = chr3:87842058-87842246
  misc_feature 1..188: note = hyper
  source 1..188: mol_type = genomic DNA

SEQ ID NO: 49150 - DNA, 78 bp, Homo sapiens; identical to SEQ ID NO: 28265
  misc_feature 1..78: note = chr3:87842247-87842325
  misc_feature 1..78: note = hyper
  source 1..78: mol_type = genomic DNA

SEQ ID NO: 49151 - DNA, 73 bp, Homo sapiens; identical to SEQ ID NO: 28266
  misc_feature 1..73: note = chr3:89156550-89156623
  misc_feature 1..73: note = hyper
  source 1..73: mol_type = genomic DNA

SEQ ID NO: 49152 - DNA, 186 bp, Homo sapiens; identical to SEQ ID NO: 28267
  misc_feature 1..186: note = chr3:96532078-96532264
  misc_feature 1..186: note = hyper
  source 1..186: mol_type = genomic DNA

SEQ ID NO: 49153 - DNA, 33 bp, Homo sapiens; identical to SEQ ID NO: 28268
  misc_feature 1..33: note = chr3:96532523-96532556
  misc_feature 1..33: note = hyper
  source 1..33: mol_type = genomic DNA

SEQ ID NO: 49154 - DNA, 33 bp, Homo sapiens
  misc_feature 1..33: note = chr3:96532784-96532817
  misc_feature 1..33: note = hyper
  source 1..33: mol_type = genomic DNA
ctggtcaagtttgggcgacccgcgcggaggagg

SEQ ID NO: 49155 - DNA, 114 bp, Homo sapiens
  misc_feature 1..114: note = chr3:96532873-96532987
  misc_feature 1..114: note = hyper
  source 1..114: mol_type = genomic DNA
ctcaccccctccagcggtggaaatgtggagaagtaagtgggaggcggtgtcgggaactgactcctcttaaaacggtcggcgccgctgctctgaaatgggcggctaagtgcttgt

SEQ ID NO: 49156 - DNA, 141 bp, Homo sapiens; identical to SEQ ID NO: 18110
  misc_feature 1..141: note = chr3:96533242-96533383
  misc_feature 1..141: note = hyper
  source 1..141: mol_type = genomic DNA

SEQ ID NO: 49157 - DNA, 324 bp, Homo sapiens
  misc_feature 1..324: note = chr3:96533458-96533782
  misc_feature 1..324: note = hyper
  source 1..324: mol_type = genomic DNA
ctgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttg

SEQ ID NO: 49158 - DNA, 56 bp, Homo sapiens; identical to SEQ ID NO: 28272
  misc_feature 1..56: note = chr3:98451370-98451426
  misc_feature 1..56: note = hyper
  source 1..56: mol_type = genomic DNA

SEQ ID NO: 49159 - DNA, 410 bp, Homo sapiens; identical to SEQ ID NO: 28273
  misc_feature 1..410: note = chr3:98451961-98452371
  misc_feature 1..410: note = hyper
  source 1..410: mol_type = genomic DNA

SEQ ID NO: 49160 - DNA, 154 bp, Homo sapiens; identical to SEQ ID NO: 28274
  misc_feature 1..154: note = chr3:98452640-98452794
  misc_feature 1..154: note = hyper
  source 1..154: mol_type = genomic DNA

SEQ ID NO: 49161 - DNA, 527 bp, Homo sapiens; identical to SEQ ID NO: 28275
  misc_feature 1..527: note = chr3:98620068-98620595
  misc_feature 1..527: note = hyper
  source 1..527: mol_type = genomic DNA

SEQ ID NO: 49162 - DNA, 30 bp, Homo sapiens; identical to SEQ ID NO: 28276
  misc_feature 1..30: note = chr3:98621075-98621105
  misc_feature 1..30: note = hyper
  source 1..30: mol_type = genomic DNA

SEQ ID NO: 49163 - DNA, 116 bp, Homo sapiens; identical to SEQ ID NO: 28277
  misc_feature 1..116: note = chr3:99356783-99356899
  misc_feature 1..116: note = hyper
  source 1..116: mol_type = genomic DNA

SEQ ID NO: 49164 - DNA, 13 bp, Homo sapiens
  misc_feature 1..13: note = chr3:99594912-99594925
  misc_feature 1..13: note = hyper
  source 1..13: mol_type = genomic DNA
tacctgaactgcc

SEQ ID NO: 49165 - DNA, 209 bp, Homo sapiens
  misc_feature 1..209: note = chr3:99595105-99595314
  misc_feature 1..209: note = hyper
  source 1..209: mol_type = genomic DNA
gggcgccggtgaccgcgggaccctcggccgcggcggcggcgcagccacacaccccagctcccgcggatgttccggccgtgtgaacggaccgtggttcccggctcccagcggagggaatgagtggtgggccggtgggccggggcgccggcgccctcctgtcgggctaacaaagtcattgggaggcagggtcgatccgcttgtaacttttt

SEQ ID NO: 49166 - DNA, 30 bp, Homo sapiens; identical to SEQ ID NO: 28279
  misc_feature 1..30: note = chr3:107149033-107149063
  misc_feature 1..30: note = hyper
  source 1..30: mol_type = genomic DNA

SEQ ID NO: 49167 - DNA, 42 bp, Homo sapiens; identical to SEQ ID NO: 28280
  misc_feature 1..42: note = chr3:107149805-107149847
  misc_feature 1..42: note = hyper
  source 1..42: mol_type = genomic DNA

SEQ ID NO: 49168 - DNA, 30 bp, Homo sapiens; identical to SEQ ID NO: 6932
  misc_feature 1..30: note = chr3:110789665-110789695
  misc_feature 1..30: note = hyper
  source 1..30: mol_type = genomic DNA

SEQ ID NO: 49169 - DNA, 49 bp, Homo sapiens; identical to SEQ ID NO: 28282
  misc_feature 1..49: note = chr3:110791365-110791414
  misc_feature 1..49: note = hyper
  source 1..49: mol_type = genomic DNA

SEQ ID NO: 49170 - DNA, 64 bp, Homo sapiens; identical to SEQ ID NO: 28283
  misc_feature 1..64: note = chr3:112052498-112052562
  misc_feature 1..64: note = hyper
  source 1..64: mol_type = genomic DNA

SEQ ID NO: 49171 - DNA, 56 bp, Homo sapiens; identical to SEQ ID NO: 28284
  misc_feature 1..56: note = chr3:112930381-112930437
  misc_feature 1..56: note = hyper
  source 1..56: mol_type = genomic DNA

SEQ ID NO: 49172 - DNA, 15 bp, Homo sapiens
  misc_feature 1..15: note = chr3:112930455-112930470
  misc_feature 1..15: note = hyper
  source 1..15: mol_type = genomic DNA
cgtcccctgcgttgt

SEQ ID NO: 49173 - DNA, 228 bp, Homo sapiens; identical to SEQ ID NO: 28286
  misc_feature 1..228: note = chr3:112931046-112931274
  misc_feature 1..228: note = hyper
  source 1..228: mol_type = genomic DNA

SEQ ID NO: 49174 - DNA, 44 bp, Homo sapiens; identical to SEQ ID NO: 28287
  misc_feature 1..44: note = chr3:112931566-112931610
  misc_feature 1..44: note = hyper
  source 1..44: mol_type = genomic DNA

SEQ ID NO: 49175 - DNA, 16 bp, Homo sapiens
  misc_feature 1..16: note = chr3:115231485-115231501
  misc_feature 1..16: note = hyper
  source 1..16: mol_type = genomic DNA
ggggctgcagaagccc

SEQ ID NO: 49176 - DNA, 282 bp, Homo sapiens; identical to SEQ ID NO: 28289
  misc_feature 1..282: note = chr3:115231502-115231784
  misc_feature 1..282: note = hyper
  source 1..282: mol_type = genomic DNA

SEQ ID NO: 49177 - DNA, 111 bp, Homo sapiens; identical to SEQ ID NO: 28290
  misc_feature 1..111: note = chr3:115377728-115377839
  misc_feature 1..111: note = hyper
  source 1..111: mol_type = genomic DNA

SEQ ID NO: 49178 - DNA, 243 bp, Homo sapiens; identical to SEQ ID NO: 28291
  misc_feature 1..243: note = chr3:116163696-116163939
  misc_feature 1..243: note = hyper
  source 1..243: mol_type = genomic DNA

SEQ ID NO: 49179 - DNA, 30 bp, Homo sapiens; identical to SEQ ID NO: 28292
  misc_feature 1..30: note = chr3:116583135-116583165
  misc_feature 1..30: note = hyper
  source 1..30: mol_type = genomic DNA

SEQ ID NO: 49180 - DNA, 234 bp, Homo sapiens
  misc_feature 1..234: note = chr3:117716473-117716707
  misc_feature 1..234: note = hyper
  source 1..234: mol_type = genomic DNA
aagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttggaacatgctagccgcacatcttcatca

SEQ ID NO: 49181 - DNA, 30 bp, Homo sapiens; identical to SEQ ID NO: 28297
  misc_feature 1..30: note = chr3:119298886-119298916
  misc_feature 1..30: note = hyper
  source 1..30: mol_type = genomic DNA

SEQ ID NO: 49182 - DNA, 59 bp, Homo sapiens; identical to SEQ ID NO: 28298
  misc_feature 1..59: note = chr3:119421863-119421922
  misc_feature 1..59: note = hyper
  source 1..59: mol_type = genomic DNA

SEQ ID NO: 49183 - DNA, 206 bp, Homo sapiens; identical to SEQ ID NO: 28299
  misc_feature 1..206: note = chr3:120003742-120003948
  misc_feature 1..206: note = hyper
  source 1..206: mol_type = genomic DNA

SEQ ID NO: 49184 - DNA, 110 bp, Homo sapiens
  misc_feature 1..110: note = chr3:120169658-120169768
  misc_feature 1..110: note = hyper
  source 1..110: mol_type = genomic DNA
cgggtcccgcaggctcgctccggccgcccaagcacccccggccgcccgaagagtccggcctccgcgccgtgcgccctgcgctcaccgtggtctggtccaggtctcctggg

SEQ ID NO: 49185 - DNA, 142 bp, Homo sapiens
  misc_feature 1..142: note = chr3:120169835-120169977
  misc_feature 1..142: note = hyper
  source 1..142: mol_type = genomic DNA
gaggaaatgcgacctcccctcgccgccccttaagacctctccttccccgcctgcctgcccccccagctcctccccattctcctcccccttctgctgcagcggcccccgcggctcccgctccccctccttccgacccctgctc

SEQ ID NO: 49186 - DNA, 144 bp, Homo sapiens; identical to SEQ ID NO: 28302
  misc_feature 1..144: note = chr3:120170066-120170210
  misc_feature 1..144: note = hyper
  source 1..144: mol_type = genomic DNA

SEQ ID NO: 49187 - DNA, 30 bp, Homo sapiens; identical to SEQ ID NO: 28303
  misc_feature 1..30: note = chr3:120627043-120627073
  misc_feature 1..30: note = hyper
  source 1..30: mol_type = genomic DNA

SEQ ID NO: 49188 - DNA, 558 bp, Homo sapiens
  misc_feature 1..558: note = chr3:120627453-120628011
  misc_feature 1..558: note = hyper
  source 1..558: mol_type = genomic DNA
cgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtc

SEQ ID NO: 49189 - DNA, 30 bp, Homo sapiens; identical to SEQ ID NO: 28305
  misc_feature 1..30: note = chr3:120628354-120628384
  misc_feature 1..30: note = hyper
  source 1..30: mol_type = genomic DNA

SEQ ID NO: 49190 - DNA, 223 bp, Homo sapiens; identical to SEQ ID NO: 28306
  misc_feature 1..223: note = chr3:121902727-121902950
  misc_feature 1..223: note = hyper
  source 1..223: mol_type = genomic DNA

SEQ ID NO: 49191 - DNA, 39 bp, Homo sapiens
  misc_feature 1..39: note = chr3:121903619-121903658
  misc_feature 1..39: note = hyper
  source 1..39: mol_type = genomic DNA
aatgaacgggagcgcgcaccaaaacgcctgctgttggta

SEQ ID NO: 49192 - DNA, 45 bp, Homo sapiens; identical to SEQ ID NO: 6949
  misc_feature 1..45: note = chr3:122296693-122296738
  misc_feature 1..45: note = hyper
  source 1..45: mol_type = genomic DNA

SEQ ID NO: 49193 - DNA, 33 bp, Homo sapiens; identical to SEQ ID NO: 28310
  misc_feature 1..33: note = chr3:122745310-122745343
  misc_feature 1..33: note = hyper
  source 1..33: mol_type = genomic DNA

SEQ ID NO: 49194 - DNA, 47 bp, Homo sapiens; identical to SEQ ID NO: 28311
  misc_feature 1..47: note = chr3:122745601-122745648
  misc_feature 1..47: note = hyper
  source 1..47: mol_type = genomic DNA

SEQ ID NO: 49195 - DNA, 224 bp, Homo sapiens; identical to SEQ ID NO: 28312
  misc_feature 1..224: note = chr3:122745957-122746181
  misc_feature 1..224: note = hyper
  source 1..224: mol_type = genomic DNA

SEQ ID NO: 49196 - DNA, 32 bp, Homo sapiens; identical to SEQ ID NO: 28313
  misc_feature 1..32: note = chr3:123166974-123167006
  misc_feature 1..32: note = hyper
  source 1..32: mol_type = genomic DNA

SEQ ID NO: 49197 - DNA, 240 bp, Homo sapiens
  misc_feature 1..240: note = chr3:123167529-123167769
  misc_feature 1..240: note = hyper
  source 1..240: mol_type = genomic DNA
cggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttg

SEQ ID NO: 49198 - DNA, 160 bp, Homo sapiens
  misc_feature 1..160: note = chr3:123167827-123167987
  misc_feature 1..160: note = hyper
  source 1..160: mol_type = genomic DNA
agcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggagg

SEQ ID NO: 49199 - DNA, 27 bp, Homo sapiens
  misc_feature 1..27: note = chr3:123168541-123168568
  misc_feature 1..27: note = hyper
  source 1..27: mol_type = genomic DNA
gcgccatgcacgcttcgggccctgcgc

SEQ ID NO: 49200 - DNA, 241 bp, Homo sapiens; identical to SEQ ID NO: 28316
  misc_feature 1..241: note = chr3:123168581-123168822
  misc_feature 1..241: note = hyper
  source 1..241: mol_type = genomic DNA

SEQ ID NO: 49201 - DNA, 330 bp, Homo sapiens; identical to SEQ ID NO: 28317
  misc_feature 1..330: note = chr3:123602641-123602971
  misc_feature 1..330: note = hyper
  source 1..330: mol_type = genomic DNA

SEQ ID NO: 49202 - DNA, 327 bp, Homo sapiens; identical to SEQ ID NO: 28318
  misc_feature 1..327: note = chr3:123603226-123603553
  misc_feature 1..327: note = hyper
  source 1..327: mol_type = genomic DNA

SEQ ID NO: 49203 - DNA, 69 bp, Homo sapiens; identical to SEQ ID NO: 28319
  misc_feature 1..69: note = chr3:123752431-123752500
  misc_feature 1..69: note = hyper
  source 1..69: mol_type = genomic DNA

SEQ ID NO: 49204 - DNA, 50 bp, Homo sapiens; identical to SEQ ID NO: 28320
  misc_feature 1..50: note = chr3:123752973-123753023
  misc_feature 1..50: note = hyper
  source 1..50: mol_type = genomic DNA

SEQ ID NO: 49205 - DNA, 139 bp, Homo sapiens; identical to SEQ ID NO: 28321
  misc_feature 1..139: note = chr3:124606603-124606742
  misc_feature 1..139: note = hyper
  source 1..139: mol_type = genomic DNA

SEQ ID NO: 49206 - DNA, 51 bp, Homo sapiens; identical to SEQ ID NO: 28322
  misc_feature 1..51: note = chr3:124773881-124773932
  misc_feature 1..51: note = hyper
  source 1..51: mol_type = genomic DNA

SEQ ID NO: 49207 - DNA, 49 bp, Homo sapiens
  misc_feature 1..49: note = chr3:125899207-125899256
  misc_feature 1..49: note = hyper
  source 1..49: mol_type = genomic DNA
ggtgagaaccgagtcctggagcccctggagcccccggagcccccggagc

SEQ ID NO: 49208 - DNA, 27 bp, Homo sapiens
  misc_feature 1..27: note = chr3:125899498-125899525
  misc_feature 1..27: note = hyper
  source 1..27: mol_type = genomic DNA
tcagccgagtgggggcggcgctcaccg

SEQ ID NO: 49209 - DNA, 32 bp, Homo sapiens; identical to SEQ ID NO: 28325
  misc_feature 1..32: note = chr3:125931984-125932016
  misc_feature 1..32: note = hyper
  source 1..32: mol_type = genomic DNA

SEQ ID NO: 49210 - DNA, 48 bp, Homo sapiens
  misc_feature 1..48: note = chr3:125932500-125932548
  misc_feature 1..48: note = hyper
  source 1..48: mol_type = genomic DNA
ctgccgtgttcaggtcactgcgagggtgagccccgctttatctacccc

SEQ ID NO: 49211 - DNA, 178 bp, Homo sapiens; identical to SEQ ID NO: 28327
  misc_feature 1..178: note = chr3:125986552-125986730
  misc_feature 1..178: note = hyper
  source 1..178: mol_type = genomic DNA

SEQ ID NO: 49212 - DNA, 60 bp, Homo sapiens; identical to SEQ ID NO: 28328
  misc_feature 1..60: note = chr3:126075183-126075243
  misc_feature 1..60: note = hyper
  source 1..60: mol_type = genomic DNA

SEQ ID NO: 49213 - DNA, 125 bp, Homo sapiens; identical to SEQ ID NO: 28329
  misc_feature 1..125: note = chr3:126113532-126113657
  misc_feature 1..125: note = hyper
  source 1..125: mol_type = genomic DNA

SEQ ID NO: 49214 - DNA, 116 bp, Homo sapiens; identical to SEQ ID NO: 28330
  misc_feature 1..116: note = chr3:126113794-126113910
  misc_feature 1..116: note = hyper
  source 1..116: mol_type = genomic DNA

SEQ ID NO: 49215 - DNA, 66 bp, Homo sapiens; identical to SEQ ID NO: 28331
  misc_feature 1..66: note = chr3:126242937-126243003
  misc_feature 1..66: note = hyper
  source 1..66: mol_type = genomic DNA

SEQ ID NO: 49216 - DNA, 38 bp, Homo sapiens; identical to SEQ ID NO: 28332
  misc_feature 1..38: note = chr3:126243423-126243461
  misc_feature 1..38: note = hyper
  source 1..38: mol_type = genomic DNA

SEQ ID NO: 49217 - DNA, 33 bp, Homo sapiens
  misc_feature 1..33: note = chr3:126373487-126373520
  misc_feature 1..33: note = hyper
  source 1..33: mol_type = genomic DNA
cccgggacccgcgggcgccccggcccggacccg

SEQ ID NO: 49218 - DNA, 72 bp, Homo sapiens; identical to SEQ ID NO: 28334
  misc_feature 1..72: note = chr3:126373752-126373824
  misc_feature 1..72: note = hyper
  source 1..72: mol_type = genomic DNA

SEQ ID NO: 49219 - DNA, 80 bp, Homo sapiens; identical to SEQ ID NO: 28335
  misc_feature 1..80: note = chr3:126854425-126854505
  misc_feature 1..80: note = hyper
  source 1..80: mol_type = genomic DNA

SEQ ID NO: 49220 - DNA, 163 bp, Homo sapiens
  misc_feature 1..163: note = chr3:126854536-126854699
  misc_feature 1..163: note = hyper
  source 1..163: mol_type = genomic DNA
cgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctcca

SEQ ID NO: 49221 - DNA, 31 bp, Homo sapiens
  misc_feature 1..31: note = chr3:126854796-126854827
  misc_feature 1..31: note = hyper
  source 1..31: mol_type = genomic DNA
atgagaaacagagcgccgggttgcagtgcca

SEQ ID NO: 49222 - DNA, 38 bp, Homo sapiens; identical to SEQ ID NO: 28337
  misc_feature 1..38: note = chr3:127176205-127176243
  misc_feature 1..38: note = hyper
  source 1..38: mol_type = genomic DNA

SEQ ID NO: 49223 - DNA, 251 bp, Homo sapiens; identical to SEQ ID NO: 28338
  misc_feature 1..251: note = chr3:127347860-127348111
  misc_feature 1..251: note = hyper
  source 1..251: mol_type = genomic DNA

SEQ ID NO: 49224 - DNA, 39 bp, Homo sapiens; identical to SEQ ID NO: 28339
  misc_feature 1..39: note = chr3:127633909-127633948
  misc_feature 1..39: note = hyper
  source 1..39: mol_type = genomic DNA

SEQ ID NO: 49225 - DNA, 30 bp, Homo sapiens; identical to SEQ ID NO: 28340
  misc_feature 1..30: note = chr3:127634282-127634312
  misc_feature 1..30: note = hyper
  source 1..30: mol_type = genomic DNA

SEQ ID NO: 49226 - DNA, 114 bp, Homo sapiens
  misc_feature 1..114: note = chr3:127794432-127794546
  misc_feature 1..114: note = hyper
  source 1..114: mol_type = genomic DNA
gaagtcgcgcactttcgtcgcgacttcccaagtcgtgctgggtgtgacttggaatctcggatccctgggctaggcctggccacgcccccatggggggaggggcagcgcggcggg

SEQ ID NO: 49227 - DNA, 15 bp, Homo sapiens
  misc_feature 1..15: note = chr3:127795148-127795163
  misc_feature 1..15: note = hyper
  source 1..15: mol_type = genomic DNA
cccaacagcatgacc

SEQ ID NO: 49228 - DNA, 98 bp, Homo sapiens
  misc_feature 1..98: note = chr3:128202349-128202447
  misc_feature 1..98: note = hyper
  source 1..98: mol_type = genomic DNA
cggggagggctgagccacaaggaaaagtacttcatggccctatttttaaaaaagagctaagcagaggccagaggacaggagtccggcccgtggacact

SEQ ID NO: 49229 - DNA, 283 bp, Homo sapiens; identical to SEQ ID NO: 28344
  misc_feature 1..283: note = chr3:128205402-128205685
  misc_feature 1..283: note = hyper
  source 1..283: mol_type = genomic DNA

SEQ ID NO: 49230 - DNA, 98 bp, Homo sapiens; identical to SEQ ID NO: 28345
  misc_feature 1..98: note = chr3:128206332-128206430
  misc_feature 1..98: note = hyper
  source 1..98: mol_type = genomic DNA

SEQ ID NO: 49231 - DNA, 200 bp, Homo sapiens; identical to SEQ ID NO: 28346
  misc_feature 1..200: note = chr3:128207015-128207215
  misc_feature 1..200: note = hyper
  source 1..200: mol_type = genomic DNA

SEQ ID NO: 49232 - DNA, 120 bp, Homo sapiens; identical to SEQ ID NO: 28347
  misc_feature 1..120: note = chr3:128207713-128207833
  misc_feature 1..120: note = hyper
  source 1..120: mol_type = genomic DNA

SEQ ID NO: 49233 - DNA, 552 bp, Homo sapiens; identical to SEQ ID NO: 28348
  misc_feature 1..552: note = chr3:128208053-128208605
  misc_feature 1..552: note = hyper
  source 1..552: mol_type = genomic DNA

SEQ ID NO: 49234 - DNA, 114 bp, Homo sapiens
  misc_feature 1..114: note = chr3:128209232-128209346
  misc_feature 1..114: note = hyper
  source 1..114: mol_type = genomic DNA
agcctccttgcccgcaatccggtgtagaggaaaaaaaggaaacaggagttctgccaggtcctttcaggccttggggttgccttcctcgacaacgcaggcaggagccggcttgac

SEQ ID NO: 49235 - DNA, 161 bp, Homo sapiens; identical to SEQ ID NO: 18139
  misc_feature 1..161: note = chr3:128273832-128273993
  misc_feature 1..161: note = hyper
  source 1..161: mol_type = genomic DNA

SEQ ID NO: 49236 - DNA, 44 bp, Homo sapiens; identical to SEQ ID NO: 18140
  misc_feature 1..44: note = chr3:128274611-128274655
  misc_feature 1..44: note = hyper
  source 1..44: mol_type = genomic DNA

SEQ ID NO: 49237 - DNA, 41 bp, Homo sapiens; identical to SEQ ID NO: 28352
  misc_feature 1..41: note = chr3:128326970-128327011
  misc_feature 1..41: note = hyper
  source 1..41: mol_type = genomic DNA

SEQ ID NO: 49238 - DNA, 37 bp, Homo sapiens; identical to SEQ ID NO: 28353
  misc_feature 1..37: note = chr3:128327483-128327520
  misc_feature 1..37: note = hyper
  source 1..37: mol_type = genomic DNA

SEQ ID NO: 49239 - DNA, 46 bp, Homo sapiens
  misc_feature 1..46: note = chr3:128417155-128417201
  misc_feature 1..46: note = hyper
  source 1..46: mol_type = genomic DNA
gcactcctgcgtgagcgacttccattcgggacggctcagccgcccg

SEQ ID NO: 49240 - DNA, 390 bp, Homo sapiens
  misc_feature 1..390: note = chr3:128417231-128417621
  misc_feature 1..390: note = hyper
  source 1..390: mol_type = genomic DNA
caggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacccggggttctggccccctcctcccccaggacctcagcgcggcaccccacccaccaccccccgcccccaacccaggccagctgtctctttttcctcaggggtcgggctcccagcctctgccctccacaaccacccgcctgcctcaccagggcccagcctggcccctgggagcggccacagcgccga

SEQ ID NO: 49241 - DNA, 258 bp, Homo sapiens
  misc_feature 1..258: note = chr3:128720611-128720869
  misc_feature 1..258: note = hyper
  source 1..258: mol_type = genomic DNA
gatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgct

SEQ ID NO: 49242 - DNA, 86 bp, Homo sapiens; identical to SEQ ID NO: 18143
  misc_feature 1..86: note = chr3:128721229-128721315
  misc_feature 1..86: note = hyper
  source 1..86: mol_type = genomic DNA

SEQ ID NO: 49243 - skipped

SEQ ID NO: 49244 - DNA, 92 bp, Homo sapiens; identical to SEQ ID NO: 28362
  misc_feature 1..92: note = chr3:129324567-129324659
  misc_feature 1..92: note = hyper
  source 1..92: mol_type = genomic DNA

SEQ ID NO: 49245 - DNA, 30 bp, Homo sapiens; identical to SEQ ID NO: 28363
  misc_feature 1..30: note = chr3:129324893-129324923
  misc_feature 1..30: note = hyper
  source 1..30: mol_type = genomic DNA

SEQ ID NO: 49246 - DNA, 30 bp, Homo sapiens; identical to SEQ ID NO: 28364
  misc_feature 1..30: note = chr3:129346534-129346564
  misc_feature 1..30: note = hyper
  source 1..30: mol_type = genomic DNA

SEQ ID NO: 49247 - DNA, 37 bp, Homo sapiens
  misc_feature 1..37: note = chr3:129693071-129693108
  misc_feature 1..37: note = hyper
  source 1..37: mol_type = genomic DNA
ccccattctctctctctctctctttctctctctctct

SEQ ID NO: 49248 - DNA, 126 bp, Homo sapiens; identical to SEQ ID NO: 18144
  misc_feature 1..126: note = chr3:130064484-130064610
  misc_feature 1..126: note = hyper
  source 1..126: mol_type = genomic DNA

SEQ ID NO: 49249 - DNA, 38 bp, Homo sapiens
  misc_feature 1..38: note = chr3:130064780-130064818
  misc_feature 1..38: note = hyper
  source 1..38: mol_type = genomic DNA
cggtttccagggtccggagtgtcccctgaccccgggaa

SEQ ID NO: 49250 - DNA, 45 bp, Homo sapiens; identical to SEQ ID NO: 28370
  misc_feature 1..45: note = chr3:130235542-130235587
  misc_feature 1..45: note = hyper
  source 1..45: mol_type = genomic DNA

SEQ ID NO: 49251 - DNA, 256 bp, Homo sapiens
  misc_feature 1..256: note = chr3:130235793-130236049
  misc_feature 1..256: note = hyper
  source 1..256: mol_type = genomic DNA
ctttcttttctcccacggtcgggaccttagggtaggagtttcaagaggggagaagccggtggagcagtaacagccttcataatgtctccagtcccgcttccgtcacctccctaaggctgcgcccccctcctgggggacgtgcgctgggcccggggccgccggggcggggaagggtcgggcccggggcggggagaagcgtttatatgtcggcgaggggcgtgggagctgccacccgcttgcctgcgggacaccggag

SEQ ID NO: 49252 - DNA, 180 bp, Homo sapiens; identical to SEQ ID NO: 28373
  misc_feature 1..180: note = chr3:131752606-131752786
  misc_feature 1..180: note = hyper
  source 1..180: mol_type = genomic DNA

SEQ ID NO: 49253 - DNA, 56 bp, Homo sapiens
  misc_feature 1..56: note = chr3:131753975-131754031
  misc_feature 1..56: note = hyper
  source 1..56: mol_type = genomic DNA
cccaggccttggcggcggcgctctccgtggtcctgccgcgcccgcagtctgggctt

SEQ ID NO: 49254 - DNA, 48 bp, Homo sapiens
  misc_feature 1..48: note = chr3:132757017-132757065
  misc_feature 1..48: note = hyper
  source 1..48: mol_type = genomic DNA
aacccccagagacatcggagcgggcgctgccgagggcaatttggtgat

SEQ ID NO: 49255 - DNA, 376 bp, Homo sapiens
  misc_feature 1..376: note = chr3:132757104-132757480
  misc_feature 1..376: note = hyper
  source 1..376: mol_type = genomic DNA
gcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtga

SEQ ID NO: 49256 - DNA, 372 bp, Homo sapiens; identical to SEQ ID NO: 28376
  misc_feature 1..372: note = chr3:132757536-132757908
  misc_feature 1..372: note = hyper
  source 1..372: mol_type = genomic DNA

SEQ ID NO: 49257 - DNA, 51 bp, Homo sapiens; identical to SEQ ID NO: 28377
  misc_feature 1..51: note = chr3:133613719-133613770
  misc_feature 1..51: note = hyper
  source 1..51: mol_type = genomic DNA

SEQ ID NO: 49258 - DNA, 62 bp, Homo sapiens; identical to SEQ ID NO: 28378
  misc_feature 1..62: note = chr3:133615071-133615133
  misc_feature 1..62: note = hyper
  source 1..62: mol_type = genomic DNA

SEQ ID NO: 49259 - DNA, 130 bp, Homo sapiens; identical to SEQ ID NO: 28379
  misc_feature 1..130: note = chr3:133646291-133646421
  misc_feature 1..130: note = hyper
  source 1..130: mol_type = genomic DNA

SEQ ID NO: 49260 - DNA, 34 bp, Homo sapiens; identical to SEQ ID NO: 28380
  misc_feature 1..34: note = chr3:133748071-133748105
  misc_feature 1..34: note = hyper
  source 1..34: mol_type = genomic DNA

SEQ ID NO: 49261 - DNA, 127 bp, Homo sapiens; identical to SEQ ID NO: 28381
  misc_feature 1..127: note = chr3:134032405-134032532
  misc_feature 1..127: note = hyper
  source 1..127: mol_type = genomic DNA

SEQ ID NO: 49262 - DNA, 554 bp, Homo sapiens; identical to SEQ ID NO: 28382
  misc_feature 1..554: note = chr3:134125220-134125774
  misc_feature 1..554: note = hyper
  source 1..554: mol_type = genomic DNA

SEQ ID NO: 49263 - DNA, 44 bp, Homo sapiens; identical to SEQ ID NO: 28383
  misc_feature 1..44: note = chr3:134369475-134369519
  misc_feature 1..44: note = hyper
  source 1..44: mol_type = genomic DNA

SEQ ID NO: 49264 - DNA, 59 bp, Homo sapiens; identical to SEQ ID NO: 28384
  misc_feature 1..59: note = chr3:134369552-134369611
  misc_feature 1..59: note = hyper
  source 1..59: mol_type = genomic DNA

SEQ ID NO: 49265 - DNA, 100 bp, Homo sapiens; identical to SEQ ID NO: 28385
  misc_feature 1..100: note = chr3:134369983-134370083
  misc_feature 1..100: note = hyper
  source 1..100: mol_type = genomic DNA

SEQ ID NO: 49266 - DNA, 524 bp, Homo sapiens; identical to SEQ ID NO: 28386
  misc_feature 1..524: note = chr3:134514264-134514788
  misc_feature 1..524: note = hyper
  source 1..524: mol_type = genomic DNA

SEQ ID NO: 49267 - skipped

SEQ ID NO: 49268 - DNA, 307 bp, Homo sapiens
  misc_feature 1..307: note = chr3:134515369-134515676
  misc_feature 1..307: note = hyper
  source 1..307: mol_type = genomic DNA
gaaagcgcgctccaaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctgggaacacagctccgcgggagagcggagttggagttgtcgggagaaaaccaactctaggggtgatgcgctgccgcagtccggctagcagccccactttccggtgtcctgctccggatggaactcctctgggggactccaagccgggg

SEQ ID NO: 49269 - DNA, 99 bp, Homo sapiens
  misc_feature 1..99: note = chr3:134516222-134516321
  misc_feature 1..99: note = hyper
  source 1..99: mol_type = genomic DNA
gggtgagcgcatttgcaagggcaattccagactggacttgcagcattggggtggcgtcatgcaggtccgaggctcggtccggcccgcggctctttgcgc

SEQ ID NO: 49270 - DNA, 11 bp, Homo sapiens
  misc_feature 1..11: note = chr3:136537631-136537642
  misc_feature 1..11: note = hyper
  source 1..11: mol_type = genomic DNA
gaaggaataga

SEQ ID NO: 49271 - DNA, 449 bp, Homo sapiens
  misc_feature 1..449: note = chr3:136537730-136538179
  misc_feature 1..449: note = hyper
  source 1..449: mol_type = genomic DNA
caggcaattgcttcaaacaagcgccctccaagggcgtaagctagaggggcccgggcgggcgctttcccgtggaccctcccacctcgcgggtagaggaagtccttcagttcaggcacaaccctgagcgtcccccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccaca

SEQ ID NO: 49272 - DNA, 80 bp, Homo sapiens
  misc_feature 1..80: note = chr3:136751561-136751641
  misc_feature 1..80: note = hyper
  source 1..80: mol_type = genomic DNA
gcagggcactttcttcgggaaggactcctgggagctcaggagtttgcatacgaagccgagggagcgaggggcttctgata

SEQ ID NO: 49273 - DNA, 103 bp, Homo sapiens
  misc_feature 1..103: note = chr3:137479130-137479233
  misc_feature 1..103: note = hyper
  source 1..103: mol_type = genomic DNA
cttgggggggtgggccggattaactgtcttgtctctaaacacctgggtgcgctggcgctcactctcagctgcgagctgaagcccacgctgctctcaggcttcc

SEQ ID NO: 49274 - DNA, 91 bp, Homo sapiens
  misc_feature 1..91: note = chr3:137479510-137479601
  misc_feature 1..91: note = hyper
  source 1..91: mol_type = genomic DNA
cagagaggagggggccggagggtggggcggagccttgtggcaaggcaggtgggtgcaggcctctggggccccagactgccgcgtctggctc

SEQ ID NO: 49275 - DNA, 54 bp, Homo sapiens
  misc_feature 1..54: note = chr3:137479687-137479741
  misc_feature 1..54: note = hyper
  source 1..54: mol_type = genomic DNA
gaaactttactgagagtcttctctgagtttggaattatgcggaaattgaaccca

SEQ ID NO: 49276 - DNA, 37 bp, Homo sapiens; identical to SEQ ID NO: 18158
  misc_feature 1..37: note = chr3:137479943-137479980
  misc_feature 1..37: note = hyper
  source 1..37: mol_type = genomic DNA

SEQ ID NO: 49277 - DNA, 32 bp, Homo sapiens
  misc_feature 1..32: note = chr3:137481315-137481347
  misc_feature 1..32: note = hyper
  source 1..32: mol_type = genomic DNA
gactgggctgaaaagtgcgtttgcttcctgag

SEQ ID NO: 49278 - DNA, 84 bp, Homo sapiens
  misc_feature 1..84: note = chr3:137481774-137481858
  misc_feature 1..84: note = hyper
  source 1..84: mol_type = genomic DNA
gggtgagaagttccacgcgtctttctaattttaggaaggggaagcaaagtcttctcctcaaacttgatacactacatgctagag

SEQ ID NO: 49279 - DNA, 30 bp, Homo sapiens; identical to SEQ ID NO: 28397
  misc_feature 1..30: note = chr3:137483214-137483244
  misc_feature 1..30: note = hyper
  source 1..30: mol_type = genomic DNA

SEQ ID NO: 49280 - DNA, 30 bp, Homo sapiens; identical to SEQ ID NO: 28398
  misc_feature 1..30: note = chr3:137483668-137483698
  misc_feature 1..30: note = hyper
  source 1..30: mol_type = genomic DNA

SEQ ID NO: 49281 - DNA, 14 bp, Homo sapiens
  misc_feature 1..14: note = chr3:137484002-137484016
  misc_feature 1..14: note = hyper
  source 1..14: mol_type = genomic DNA
gggccttcttgccg

SEQ ID NO: 49282 - DNA, 180 bp, Homo sapiens
  misc_feature 1..180: note = chr3:137484225-137484405
  misc_feature 1..180: note = hyper
  source 1..180: mol_type = genomic DNA
gccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtc

SEQ ID NO: 49283 - DNA, 157 bp, Homo sapiens; identical to SEQ ID NO: 18159
  misc_feature 1..157: note = chr3:137484531-137484688
  misc_feature 1..157: note = hyper
  source 1..157: mol_type = genomic DNA

SEQ ID NO: 49284 - DNA, 548 bp, Homo sapiens; identical to SEQ ID NO: 28401
  misc_feature 1..548: note = chr3:137485061-137485609
  misc_feature 1..548: note = hyper
  source 1..548: mol_type = genomic DNA

SEQ ID NO: 49285 - DNA, 92 bp, Homo sapiens; identical to SEQ ID NO: 18161
  misc_feature 1..92: note = chr3:137485937-137486029
  misc_feature 1..92: note = hyper
  source 1..92: mol_type = genomic DNA

SEQ ID NO: 49286 - DNA, 270 bp, Homo sapiens
  misc_feature 1..270: note = chr3:137486550-137486820
  misc_feature 1..270: note = hyper
  source 1..270: mol_type = genomic DNA
gacgcctataaataatagatagataaataaatgagcgatcaggcgaaggtaaacaaaggcgggctgagggaggtgtagggggagtccgggctggctgcgccacgcttacttagcattacaaaacccttttacaaatcgagacaattaggaagtgacttgcctctggtggccgtccggtctgggggcctgggcgcttagggaaggcccctcctcccgccccctaggaagcccaggaggcctgggacggagacgccacggttttcctgtctg

SEQ ID NO: 49287 - DNA, 56 bp, Homo sapiens; identical to SEQ ID NO: 28404
  misc_feature 1..56: note = chr3:137487025-137487081
  misc_feature 1..56: note = hyper
  source 1..56: mol_type = genomic DNA

SEQ ID NO: 49288 - DNA, 17 bp, Homo sapiens
  misc_feature 1..17: note = chr3:137487082-137487099
  misc_feature 1..17: note = hyper
  source 1..17: mol_type = genomic DNA
gacggtggctgaagctg

SEQ ID NO: 49289 - DNA, 132 bp, Homo sapiens; identical to SEQ ID NO: 28406
  misc_feature 1..132: note = chr3:137487656-137487788
  misc_feature 1..132: note = hyper
  source 1..132: mol_type = genomic DNA

SEQ ID NO: 49290 - DNA, 114 bp, Homo sapiens
  misc_feature 1..114: note = chr3:137487850-137487964
  misc_feature 1..114: note = hyper
  source 1..114: mol_type = genomic DNA
cgcgtccggtagccagggagccccagacttctctcgcttagcaacctgggcctccttcgagcggggttggcagggagggcccggacctctcgcctgaggctcccattgcttccc

SEQ ID NO: 49291 - DNA, 245 bp, Homo sapiens; identical to SEQ ID NO: 28408
  misc_feature 1..245: note = chr3:137488337-137488582
  misc_feature 1..245: note = hyper
  source 1..245: mol_type = genomic DNA

SEQ ID NO: 49292 - DNA, 143 bp, Homo sapiens; identical to SEQ ID NO: 18165
  misc_feature 1..143: note = chr3:137488807-137488950
  misc_feature 1..143: note = hyper
  source 1..143: mol_type = genomic DNA

SEQ ID NO: 49293 - DNA, 64 bp, Homo sapiens; identical to SEQ ID NO: 28412
  misc_feature 1..64: note = chr3:138066780-138066844
  misc_feature 1..64: note = hyper
  source 1..64: mol_type = genomic DNA

SEQ ID NO: 49294 - DNA, 59 bp, Homo sapiens
  misc_feature 1..59: note = chr3:138153904-138153963
  misc_feature 1..59: note = hyper
  source 1..59: mol_type = genomic DNA
ttccttgacaatgaacgcgagttcatcagccgcgagctgcggggccagcacctgccagc

SEQ ID NO: 49295 - DNA, 284 bp, Homo sapiens
  misc_feature 1..284: note = chr3:138153993-138154277
  misc_feature 1..284: note = hyper
  source 1..284: mol_type = genomic DNA
ggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaaggg

SEQ ID NO: 49296 - DNA, 10 bp, Homo sapiens
  misc_feature 1..10: note = chr3:138659099-138659109
  misc_feature 1..10: note = hyper
  source 1..10: mol_type = genomic DNA
ggtgctcgca

SEQ ID NO: 49297 - DNA, 47 bp, Homo sapiens; identical to SEQ ID NO: 18167
  misc_feature 1..47: note = chr3:138662087-138662134
  misc_feature 1..47: note = hyper
  source 1..47: mol_type = genomic DNA

SEQ ID NO: 49298 - DNA, 16 bp, Homo sapiens
  misc_feature 1..16: note = chr3:138662164-138662180
  misc_feature 1..16: note = hyper
  source 1..16: mol_type = genomic DNA
ctcctggcccaccagc

SEQ ID NO: 49299 - DNA, 86 bp, Homo sapiens; identical to SEQ ID NO: 18169
  misc_feature 1..86: note = chr3:138662296-138662382
  misc_feature 1..86: note = hyper
  source 1..86: mol_type = genomic DNA

SEQ ID NO: 49300 - DNA, 30 bp, Homo sapiens; identical to SEQ ID NO: 28422
  misc_feature 1..30: note = chr3:138663076-138663106
  misc_feature 1..30: note = hyper
  source 1..30: mol_type = genomic DNA

SEQ ID NO: 49301 - DNA, 218 bp, Homo sapiens
  misc_feature 1..218: note = chr3:138664165-138664383
  misc_feature 1..218: note = hyper
  source 1..218: mol_type = genomic DNA
gcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgt

SEQ ID NO: 49302 - DNA, 68 bp, Homo sapiens; identical to SEQ ID NO: 28425
  misc_feature 1..68: note = chr3:138664701-138664769
  misc_feature 1..68: note = hyper
  source 1..68: mol_type = genomic DNA

SEQ ID NO: 49303 - DNA, 126 bp, Homo sapiens
  misc_feature 1..126: note = chr3:138664802-138664928
  misc_feature 1..126: note = hyper
  source 1..126: mol_type = genomic DNA
cgaggcggccgggcccgccagccccttgaccacagcggccgcgccagggctaccggggcccgcggctgcagccgcagctgctgcagccgctgcggctgccgccatctggcaggaggcatagggcat

SEQ ID NO: 49304 - DNA, 13 bp, Homo sapiens
  misc_feature 1..13: note = chr3:138665323-138665336
  misc_feature 1..13: note = hyper
  source 1..13: mol_type = genomic DNA
agatgccggacag

SEQ ID NO: 49305 - DNA, 132 bp, Homo sapiens; identical to SEQ ID NO: 28427
  misc_feature 1..132: note = chr3:138665396-138665528
  misc_feature 1..132: note = hyper
  source 1..132: mol_type = genomic DNA

SEQ ID NO: 49306 - DNA, 23 bp, Homo sapiens
  misc_feature 1..23: note = chr3:138665539-138665562
  misc_feature 1..23: note = hyper
  source 1..23: mol_type = genomic DNA
cgggctcggggtagctggccatc

SEQ ID NO: 49307 - DNA, 126 bp, Homo sapiens
  misc_feature 1..126: note = chr3:138666294-138666420
  misc_feature 1..126: note = hyper
  source 1..126: mol_type = genomic DNA
cgcggctttcaggtgaaagaaaacgactcctttgctctgccgtttgctgccgtcttgaggctgaacttctagctcggggctggggaggggcgagacggcgagggggctggacggggtagggtgggg

SEQ ID NO: 49308 - DNA, 15 bp, Homo sapiens
  misc_feature 1..15: note = chr3:138668670-138668685
  misc_feature 1..15: note = hyper
  source 1..15: mol_type = genomic DNA
ttacttctcaacctt

SEQ ID NO: 49309 - DNA, 105 bp, Homo sapiens; identical to SEQ ID NO: 321
  misc_feature 1..105: note = chr3:138679188-138679293
  misc_feature 1..105: note = hyper
  source 1..105: mol_type = genomic DNA

SEQ ID NO: 49310 - DNA, 87 bp, Homo sapiens
  misc_feature 1..87: note = chr3:139258180-139258267
  misc_feature 1..87: note = hyper
  source 1..87: mol_type = genomic DNA
ccgggggcaccggaccgcggctcgccgggatggaggcaggcaggcagcgtctcgggagggctctagggagcggcccggagctgctcg

SEQ ID NO: 49311 - DNA, 231 bp, Homo sapiens
  misc_feature 1..231: note = chr3:139258316-139258547
  misc_feature 1..231: note = hyper
  source 1..231: mol_type = genomic DNA
actcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctg

SEQ ID NO: 49312 - DNA, 350 bp, Homo sapiens; identical to SEQ ID NO: 28434
  misc_feature 1..350: note = chr3:139396463-139396813
  misc_feature 1..350: note = hyper
  source 1..350: mol_type = genomic DNA

SEQ ID NO: 49313 - DNA, 46 bp, Homo sapiens
  misc_feature 1..46: note = chr3:139653445-139653491
  misc_feature 1..46: note = hyper
  source 1..46: mol_type = genomic DNA
ttctcggagatgacgcggagccctgccattgccatccaggtccaag

SEQ ID NO: 49314 - DNA, 179 bp, Homo sapiens; identical to SEQ ID NO: 18175
  misc_feature 1..179: note = chr3:139653693-139653872
  misc_feature 1..179: note = hyper
  source 1..179: mol_type = genomic DNA

SEQ ID NO: 49315 - DNA, 1228 bp, Homo sapiens; identical to SEQ ID NO: 28437
  misc_feature 1..1228: note = chr3:139653873-139655101
  misc_feature 1..1228: note = hyper
  source 1..1228: mol_type = genomic DNA

SEQ ID NO: 49316 - DNA, 77 bp, Homo sapiens
  misc_feature 1..77: note = chr3:140769436-140769513
  misc_feature 1..77: note = hyper
  source 1..77: mol_type = genomic DNA
gttagcaaatgactgcgtaatggacctaaagtcaattctgggagcacagacgagggccaccaaaccaagaactttca

SEQ ID NO: 49317 - DNA, 203 bp, Homo sapiens; identical to SEQ ID NO: 18178
  misc_feature 1..203: note = chr3:140769705-140769908
  misc_feature 1..203: note = hyper
  source 1..203: mol_type = genomic DNA

SEQ ID NO: 49318 - DNA, 476 bp, Homo sapiens
  misc_feature 1..476: note = chr3:140770829-140771305
  misc_feature 1..476: note = hyper
  source 1..476: mol_type = genomic DNA
ttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagta

SEQ ID NO: 49319 - DNA, 175 bp, Homo sapiens; identical to SEQ ID NO: 28442
  misc_feature 1..175: note = chr3:140771638-140771813
  misc_feature 1..175: note = hyper
  source 1..175: mol_type = genomic DNA

SEQ ID NO: 49320 - DNA, 310 bp, Homo sapiens
  misc_feature 1..310: note = chr3:141516079-141516389
  misc_feature 1..310: note = hyper
  source 1..310: mol_type = genomic DNA
ccgcccaggaagtggcggcagaaagcgagccctgagaagccaggggcaggagcggcctccgcgcgacactgcggcgctcctgattctgcggcctggggccgagcatgcggggcgggcggagcctcgagctaagtcccctggggtcccagggccgcattcctccgaggtctgcaaaggccactgcttaaaggcgcagaggagcagctgggaacgagaacaaagcggccaggcccccctcggaggaaggaaggagagagccccaggaaacagctgatagcgctaagctcagcttgtttttttcctctgctca

SEQ ID NO: 49321 - DNA, 25 bp, Homo sapiens
  misc_feature 1..25: note = chr3:141516719-141516744
  misc_feature 1..25: note = hyper
  source 1..25: mol_type = genomic DNA
gaaggacctgcgcacactcatactt

SEQ ID NO: 49322 - DNA, 264 bp, Homo sapiens; identical to SEQ ID NO: 28444
  misc_feature 1..264: note = chr3:142443587-142443851
  misc_feature 1..264: note = hyper
  source 1..264: mol_type = genomic DNA

SEQ ID NO: 49323 - DNA, 30 bp, Homo sapiens; identical to SEQ ID NO: 28445
  misc_feature 1..30: note = chr3:142607418-142607448
  misc_feature 1..30: note = hyper
  source 1..30: mol_type = genomic DNA

SEQ ID NO: 49324 - DNA, 41 bp, Homo sapiens; identical to SEQ ID NO: 7032
  misc_feature 1..41: note = chr3:142607792-142607833
  misc_feature 1..41: note = hyper
  source 1..41: mol_type = genomic DNA

SEQ ID NO: 49325 - DNA, 140 bp, Homo sapiens; identical to SEQ ID NO: 28447
  misc_feature 1..140: note = chr3:142681855-142681995
  misc_feature 1..140: note = hyper
  source 1..140: mol_type = genomic DNA

SEQ ID NO: 49326 - DNA, 224 bp, Homo sapiens; identical to SEQ ID NO: 18186
  misc_feature 1..224: note = chr3:142682049-142682273
  misc_feature 1..224: note = hyper
  source 1..224: mol_type = genomic DNA

SEQ ID NO: 49327 - DNA, 845 bp, Homo sapiens
  misc_feature 1..845: note = chr3:142682392-142683237
  misc_feature 1..845: note = hyper
  source 1..845: mol_type = genomic DNA
gagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgcc

SEQ ID NO: 49328 - DNA, 110 bp, Homo sapiens
  misc_feature 1..110: note = chr3:142837870-142837980
  misc_feature 1..110: note = hyper
  source 1..110: mol_type = genomic DNA
cccaattccagaggacgtcaatcacagtggacgcagcaccgcgagcggaaatgcggagagcatcggggctccgcatgtggggcacaatgaaacaagagcagccccggcca

SEQ ID NO: 49329 - DNA, 142 bp, Homo sapiens; identical to SEQ ID NO: 18189
  misc_feature 1..142: note = chr3:142838479-142838621
  misc_feature 1..142: note = hyper
  source 1..142: mol_type = genomic DNA

SEQ ID NO: 49330 - DNA, 37 bp, Homo sapiens
  misc_feature 1..37: note = chr3:142839036-142839073
  misc_feature 1..37: note = hyper
  source 1..37: mol_type = genomic DNA
atataagccgcccccagccatcgcccccagccggctt

SEQ ID NO: 49331 - DNA, 322 bp, Homo sapiens; identical to SEQ ID NO: 28452
  misc_feature 1..322: note = chr3:142839204-142839526
  misc_feature 1..322: note = hyper
  source 1..322: mol_type = genomic DNA

SEQ ID NO: 49332 - DNA, 18 bp, Homo sapiens
  misc_feature 1..18: note = chr3:142840236-142840254
  misc_feature 1..18: note = hyper
  source 1..18: mol_type = genomic DNA
ctacgagccagtgtggca

SEQ ID NO: 49333 - DNA, 46 bp, Homo sapiens; identical to SEQ ID NO: 28459
  misc_feature 1..46: note = chr3:143566766-143566812
  misc_feature 1..46: note = hyper
  source 1..46: mol_type = genomic DNA

SEQ ID NO: 49334 - DNA, 33 bp, Homo sapiens; identical to SEQ ID NO: 7046
  misc_feature 1..33: note = chr3:145878520-145878553
  misc_feature 1..33: note = hyper
  source 1..33: mol_type = genomic DNA

SEQ ID NO: 49335 - DNA, 39 bp, Homo sapiens; identical to SEQ ID NO: 28461
  misc_feature 1..39: note = chr3:147072631-147072670
  misc_feature 1..39: note = hyper
  source 1..39: mol_type = genomic DNA

SEQ ID NO: 49336 - DNA, 30 bp, Homo sapiens; identical to SEQ ID NO: 28462
  misc_feature 1..30: note = chr3:147073006-147073036
  misc_feature 1..30: note = hyper
  source 1..30: mol_type = genomic DNA

SEQ ID NO: 49337 - DNA, 30 bp, Homo sapiens; identical to SEQ ID NO: 28463
  misc_feature 1..30: note = chr3:147073973-147074003
  misc_feature 1..30: note = hyper
  source 1..30: mol_type = genomic DNA

SEQ ID NO: 49338 - DNA, 32 bp, Homo sapiens
  misc_feature 1..32: note = chr3:147075006-147075038
  misc_feature 1..32: note = hyper
  source 1..32: mol_type = genomic DNA
gtcttttccgccaggcgcggctccagtttaga

SEQ ID NO: 49339 - DNA, 291 bp, Homo sapiens
  misc_feature 1..291: note = chr3:147076998-147077289
  misc_feature 1..291: note = hyper
  source 1..291: mol_type = genomic DNA
cctttctcctcctcccgccaggtgctggagtttttacaccggtgctttgttacttaaggagaaaaactgcctgcatggtgcaggatgctgaaggggagacagaaagagaaggtctggcggcctgggggcggccatgcgtgtagccctccccggtatgtttttgtgcacagagttggcgccagggcagcgccccagaccccagtcctggctggacaataaatgaccggacagctgcggccgctacaaaggagcccctcgaccgcgtcgctgtttacttagtgtcgggtctga

SEQ ID NO: 49340 - DNA, 58 bp, Homo sapiens
  misc_feature 1..58: note = chr3:147079188-147079246
  misc_feature 1..58: note = hyper
  source 1..58: mol_type = genomic DNA
tctaatggggctagtggcctcaaatgggagatgcatcttgacacgaaaacaatcccta

SEQ ID NO: 49341 - DNA, 309 bp, Homo sapiens
  misc_feature 1..309: note = chr3:147087253-147087562
  misc_feature 1..309: note = hyper
  source 1..309: mol_type = genomic DNA
cttccctacgttcagcgaatacagggcatcactttccagtgaaatatgcctcccccaccaatatatctacaccgtctcccacagataatgccagttatttttccagcccctaaaaaaaaatacaaatgatttcaagtggatgtcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaacccc

SEQ ID NO: 49342 - DNA, 30 bp, Homo sapiens; identical to SEQ ID NO: 28468
  misc_feature 1..30: note = chr3:147087807-147087837
  misc_feature 1..30: note = hyper
  source 1..30: mol_type = genomic DNA

SEQ ID NO: 49343 - DNA, 19 bp, Homo sapiens
  misc_feature 1..19: note = chr3:147088421-147088440
  misc_feature 1..19: note = hyper
  source 1..19: mol_type = genomic DNA
tcgggagactttgctcgtt

SEQ ID NO: 49344 - DNA, 256 bp, Homo sapiens; identical to SEQ ID NO: 28471
  misc_feature 1..256: note = chr3:147090427-147090683
  misc_feature 1..256: note = hyper
  source 1..256: mol_type = genomic DNA

SEQ ID NO: 49345 - DNA, 98 bp, Homo sapiens; identical to SEQ ID NO: 28472
  misc_feature 1..98: note = chr3:147096028-147096126
  misc_feature 1..98: note = hyper
  source 1..98: mol_type = genomic DNA

SEQ ID NO: 49346 - DNA, 52 bp, Homo sapiens
  misc_feature 1..52: note = chr3:147098379-147098431
  misc_feature 1..52: note = hyper
  source 1..52: mol_type = genomic DNA
agccagggcaacaagcgtgtcccccattgacaaggagccctattcagactgc

SEQ ID NO: 49347 - DNA, 217 bp, Homo sapiens
  misc_feature 1..217: note = chr3:147098470-147098687
  misc_feature 1..217: note = hyper
  source 1..217: mol_type = genomic DNA
aaggttgttggagattagtgttcagccctaataactaaagcgcttgatttacattggaaaaaagccccctcagccgtgaaaacaaaatctttgaacgcgtgatcattgcgagggcggctgatatcctaatacgtgcattgttctcggcctggcccaggcgcgccccggcctccttaggaagggcaaggcctgggctgctggccgtggaccaggtccc

SEQ ID NO: 49348 - DNA, 35 bp, Homo sapiens; identical to SEQ ID NO: 28474
  misc_feature 1..35: note = chr3:147102662-147102697
  misc_feature 1..35: note = hyper
  source 1..35: mol_type = genomic DNA

SEQ ID NO: 49349 - DNA, 30 bp, Homo sapiens; identical to SEQ ID NO: 28475
  misc_feature 1..30: note = chr3:147103192-147103222
  misc_feature 1..30: note = hyper
  source 1..30: mol_type = genomic DNA

SEQ ID NO: 49350 - DNA, 15 bp, Homo sapiens
  misc_feature 1..15: note = chr3:147105883-147105898
  misc_feature 1..15: note = hyper
  source 1..15: mol_type = genomic DNA
taaacgtgggcaagt

SEQ ID NO: 49351 - DNA, 54 bp, Homo sapiens
  misc_feature 1..54: note = chr3:147108787-147108841
  misc_feature 1..54: note = hyper
  source 1..54: mol_type = genomic DNA
ccgacgagggcgacacgagggcagacggtgtagccgaatcgtagccagagctgg

SEQ ID NO: 49352 - DNA, 105 bp, Homo sapiens; identical to SEQ ID NO: 28478
  misc_feature 1..105: note = chr3:147110010-147110115
  misc_feature 1..105: note = hyper
  source 1..105: mol_type = genomic DNA

SEQ ID NO: 49353 - DNA, 42 bp, Homo sapiens; identical to SEQ ID NO: 18200
  misc_feature 1..42: note = chr3:147110683-147110725
  misc_feature 1..42: note = hyper
  source 1..42: mol_type = genomic DNA

SEQ ID NO: 49354 - DNA, 60 bp, Homo sapiens
  misc_feature 1..60: note = chr3:147111089-147111149
  misc_feature 1..60: note = hyper
  source 1..60: mol_type = genomic DNA
ggccaggtgaggccgcgccccagcttgctccggagctgcaggaggcgccctggtctctgc

SEQ ID NO: 49355 - DNA, 365 bp, Homo sapiens; identical to SEQ ID NO: 28481
  misc_feature 1..365: note = chr3:147111965-147112330
  misc_feature 1..365: note = hyper
  source 1..365: mol_type = genomic DNA

SEQ ID NO: 49356 - DNA, 39 bp, Homo sapiens; identical to SEQ ID NO: 7062
  misc_feature 1..39: note = chr3:147114179-147114218
  misc_feature 1..39: note = hyper
  source 1..39: mol_type = genomic DNA

SEQ ID NO: 49357 - DNA, 45 bp, Homo sapiens; identical to SEQ ID NO: 18204
  misc_feature 1..45: note = chr3:147126992-147127037
  misc_feature 1..45: note = hyper
  source 1..45: mol_type = genomic DNA

SEQ ID NO: 49358 - DNA, 138 bp, Homo sapiens
  misc_feature 1..138: note = chr3:147127067-147127205
  misc_feature 1..138: note = hyper
  source 1..138: mol_type = genomic DNA
cgcaccaatgggcgccagcgtcggcagcacgtgacacctcccccctgctcccattcatcaagggggggacggtgtcgtcctttcaattcatttatctgcaggaatgattgctgctatcagtctcgcgctcaccgcccg

SEQ ID NO: 49359 - skipped

SEQ ID NO: 49360 - DNA, 11 bp, Homo sapiens
  misc_feature 1..11: note = chr3:147127902-147127913
  misc_feature 1..11: note = hyper
  source 1..11: mol_type = genomic DNA
ctcctggacgc

SEQ ID NO: 49361 - DNA, 68 bp, Homo sapiens
  misc_feature 1..68: note = chr3:147136863-147136931
  misc_feature 1..68: note = hyper
  source 1..68: mol_type = genomic DNA
tagggggtgcaacagcgagacttccccacaacacctccaccgaaggctgggtcgtcagcgtttgaggg

SEQ ID NO: 49362 - DNA, 207 bp, Homo sapiens
  misc_feature 1..207: note = chr3:147137164-147137371
  misc_feature 1..207: note = hyper
  source 1..207: mol_type = genomic DNA
tgtttgttttcaaaccgcgctggtttaagtgagttcacactgcggagccgacagcagagggtagagcaacctggggctgctgccattggaacggcgagttgagcgggcctgtcagggcctctccgccgagggccgggggctgcatggtgctcgagccccagccggccacaccccagtgcatcgggtggctgggcttccagtttacac

SEQ ID NO: 49363 - DNA, 89 bp, Homo sapiens; identical to SEQ ID NO: 28487
  misc_feature 1..89: note = chr3:147137428-147137517
  misc_feature 1..89: note = hyper
  source 1..89: mol_type = genomic DNA

SEQ ID NO: 49364 - DNA, 143 bp, Homo sapiens; identical to SEQ ID NO: 18207
  misc_feature 1..143: note = chr3:147138856-147138999
  misc_feature 1..143: note = hyper
  source 1..143: mol_type = genomic DNA

SEQ ID NO: 49365 - DNA, 124 bp, Homo sapiens
  misc_feature 1..124: note = chr3:147139250-147139374
  misc_feature 1..124: note = hyper
  source 1..124: mol_type = genomic DNA
cgtagacctccccaaattgcccgtctccggtatgactgaatctgtctgctggcctctcagctaccaactctgcccgaaatctagatcccagacctggtaagtcgcgttcctcccctaccccgcc

SEQ ID NO: 49366 - DNA, 43 bp, Homo sapiens
  misc_feature 1..43: note = chr3:147139528-147139571
  misc_feature 1..43: note = hyper
  source 1..43: mol_type = genomic DNA
aggaatgtcgcggggctccccagtgaggcgggagcgaaaagag

SEQ ID NO: 49367 - DNA, 127 bp, Homo sapiens; identical to SEQ ID NO: 28490
  misc_feature 1..127: note = chr3:147141097-147141224
  misc_feature 1..127: note = hyper
  source 1..127: mol_type = genomic DNA

SEQ ID NO: 49368 - DNA, 87 bp, Homo sapiens; identical to SEQ ID NO: 18209
  misc_feature 1..87: note = chr3:148415340-148415427
  misc_feature 1..87: note = hyper
  source 1..87: mol_type = genomic DNA

SEQ ID NO: 49369 - DNA, 196 bp, Homo sapiens
  misc_feature 1..196: note = chr3:148415644-148415840
  misc_feature 1..196: note = hyper
  source 1..196: mol_type = genomic DNA
agcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgc

SEQ ID NO: 49370 - DNA, 194 bp, Homo sapiens; identical to SEQ ID NO: 28492
  misc_feature 1..194: note = chr3:148415861-148416055
  misc_feature 1..194: note = hyper
  source 1..194: mol_type = genomic DNA

SEQ ID NO: 49371 - DNA, 30 bp, Homo sapiens; identical to SEQ ID NO: 28493
  misc_feature 1..30: note = chr3:148943086-148943116
  misc_feature 1..30: note = hyper
  source 1..30: mol_type = genomic DNA

SEQ ID NO: 49372 - DNA, 383 bp, Homo sapiens
  misc_feature 1..383: note = chr3:149375023-149375406
  misc_feature 1..383: note = hyper
  source 1..383: mol_type = genomic DNA
ggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaag

SEQ ID NO: 49373 - DNA, 94 bp, Homo sapiens
  misc_feature 1..94: note = chr3:150802887-150802981
  misc_feature 1..94: note = hyper
  source 1..94: mol_type = genomic DNA
agggtacagtaagaccgtggaaggttgtaaggaccagagattctgactatcaagatcctggcacgtagcgaaggctccataaatggcagccatc

SEQ ID NO: 49374 - DNA, 584 bp, Homo sapiens
  misc_feature 1..584: note = chr3:150803080-150803664
  misc_feature 1..584: note = hyper
  source 1..584: mol_type = genomic DNA
cgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggct

SEQ ID NO: 49375 - DNA, 153 bp, Homo sapiens
  misc_feature 1..153: note = chr3:150803890-150804043
  misc_feature 1..153: note = hyper
  source 1..153: mol_type = genomic DNA
tcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccac

SEQ ID NO: 49376 - skipped

SEQ ID NO: 49377 - DNA, 433 bp, Homo sapiens; identical to SEQ ID NO: 28498
  misc_feature 1..433: note = chr3:150804463-150804896
  misc_feature 1..433: note = hyper
  source 1..433: mol_type = genomic DNA

SEQ ID NO: 49378 - DNA, 31 bp, Homo sapiens; identical to SEQ ID NO: 18217
  misc_feature 1..31: note = chr3:150804936-150804967
  misc_feature 1..31: note = hyper
  source 1..31: mol_type = genomic DNA

SEQ ID NO: 49379 - DNA, 22 bp, Homo sapiens
  misc_feature 1..22: note = chr3:150805030-150805052
  misc_feature 1..22: note = hyper
  source 1..22: mol_type = genomic DNA
tgccggtcgctttcccgttgcc

SEQ ID NO: 49380 - DNA, 489 bp, Homo sapiens; identical to SEQ ID NO: 28500
  misc_feature 1..489: note = chr3:152552388-152552877
  misc_feature 1..489: note = hyper
  source 1..489: mol_type = genomic DNA

SEQ ID NO: 49381 - DNA, 68 bp, Homo sapiens; identical to SEQ ID NO: 18219
  misc_feature 1..68: note = chr3:152553275-152553343
  misc_feature 1..68: note = hyper
  source 1..68: mol_type = genomic DNA

SEQ ID NO: 49382 - DNA, 274 bp, Homo sapiens
  misc_feature 1..274: note = chr3:152553384-152553658
  misc_feature 1..274: note = hyper
  source 1..274: mol_type = genomic DNA
ggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacg

SEQ ID NO: 49383 - DNA, 124 bp, Homo sapiens
  misc_feature 1..124: note = chr3:153838870-153838994
  misc_feature 1..124: note = hyper
  source 1..124: mol_type = genomic DNA
cagggcttcctaagctgcaattcagcagggctcccttgcttgttctcactctgtgcccccggcaacgaccccgcgcgcctacactcccgtgccgcctcagctactagtccgcaacttctagccc

SEQ ID NO: 49384 - DNA, 225 bp, Homo sapiens; identical to SEQ ID NO: 28504
  misc_feature 1..225: note = chr3:154145627-154145852
  misc_feature 1..225: note = hyper
  source 1..225: mol_type = genomic DNA

SEQ ID NO: 49385 - DNA, 112 bp, Homo sapiens
  misc_feature 1..112: note = chr3:154146542-154146654
  misc_feature 1..112: note = hyper
  source 1..112: mol_type = genomic DNA
aggcttcagccccagcggcagcgggcgcacccggtccgaacacggtgtcggagctcggagagcatcccccagagcgccgcagactcgggcctggagcatcctctggggacag

SEQ ID NO: 49386 - DNA, 70 bp, Homo sapiens
  misc_feature 1..70: note = chr3:154146908-154146978
  misc_feature 1..70: note = hyper
  source 1..70: mol_type = genomic DNA
ccgagagcagcagactggctgcccacacggtcagcaccacgccgagcacctggcccgatcttctggaggc

SEQ ID NO: 49387 - DNA, 75 bp, Homo sapiens; identical to SEQ ID NO: 18223
  misc_feature 1..75: note = chr3:154797703-154797778
  misc_feature 1..75: note = hyper
  source 1..75: mol_type = genomic DNA

SEQ ID NO: 49388 - DNA, 184 bp, Homo sapiens; identical to SEQ ID NO: 7082
  misc_feature 1..184: note = chr3:154797835-154798019
  misc_feature 1..184: note = hyper
  source 1..184: mol_type = genomic DNA

SEQ ID NO: 49389 - DNA, 158 bp, Homo sapiens; identical to SEQ ID NO: 18225
  misc_feature 1..158: note = chr3:156009425-156009583
  misc_feature 1..158: note = hyper
  source 1..158: mol_type = genomic DNA

SEQ ID NO: 49390 - DNA, 30 bp, Homo sapiens; identical to SEQ ID NO: 7085
  misc_feature 1..30: note = chr3:156009875-156009905
  misc_feature 1..30: note = hyper
  source 1..30: mol_type = genomic DNA

SEQ ID NO: 49391 - DNA, 30 bp, Homo sapiens; identical to SEQ ID NO: 28513
  misc_feature 1..30: note = chr3:157155701-157155731
  misc_feature 1..30: note = hyper
  source 1..30: mol_type = genomic DNA

SEQ ID NO: 49392 - DNA, 83 bp, Homo sapiens; identical to SEQ ID NO: 28515
  misc_feature 1..83: note = chr3:157261119-157261202
  misc_feature 1..83: note = hyper
  source 1..83: mol_type = genomic DNA

SEQ ID NO: 49393 - DNA, 42 bp, Homo sapiens
  misc_feature 1..42: note = chr3:157812154-157812196
  misc_feature 1..42: note = hyper
  source 1..42: mol_type = genomic DNA
aagaggaggcaagggcgccgcgagctccccggatgcactggt

SEQ ID NO: 49394 - DNA, 140 bp, Homo sapiens; identical to SEQ ID NO: 28519
  misc_feature 1..140: note = chr3:157813465-157813605
  misc_feature 1..140: note = hyper
  source 1..140: mol_type = genomic DNA

SEQ ID NO: 49395 - DNA, 79 bp, Homo sapiens
  misc_feature 1..79: note = chr3:157820497-157820576
  misc_feature 1..79: note = hyper
  source 1..79: mol_type = genomic DNA
tggctcagttcctctcgcatgaaggcgtcgggatagtgggtctcgtcaaaaagcctctccagctcattgagttgttcca

SEQ ID NO: 49396 - DNA, 264 bp, Homo sapiens
  misc_feature 1..264: note = chr3:157820605-157820869
  misc_feature 1..264: note = hyper
  source 1..264: mol_type = genomic DNA
ttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaag

SEQ ID NO: 49397 - DNA, 30 bp, Homo sapiens; identical to SEQ ID NO: 28523
  misc_feature 1..30: note = chr3:157822056-157822086
  misc_feature 1..30: note = hyper
  source 1..30: mol_type = genomic DNA

SEQ ID NO: 49398 - DNA, 15 bp, Homo sapiens
  misc_feature 1..15: note = chr3:157822865-157822880
  misc_feature 1..15: note = hyper
  source 1..15: mol_type = genomic DNA
gcccgggagaagcag

SEQ ID NO: 49399 - DNA, 62 bp, Homo sapiens
  misc_feature 1..62: note = chr3:157823011-157823073
  misc_feature 1..62: note = hyper
  source 1..62: mol_type = genomic DNA
cgaccggagggttaagctttccacctctgccccttctccctcccggcaaactctgcgctaga

SEQ ID NO: 49400 - DNA, 321 bp, Homo sapiens
  misc_feature 1..321: note = chr3:157823143-157823464
  misc_feature 1..321: note = hyper
  source 1..321: mol_type = genomic DNA
gcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgt

SEQ ID NO: 49401 - DNA, 381 bp, Homo sapiens
  misc_feature 1..381: note = chr3:157823493-157823874
  misc_feature 1..381: note = hyper
  source 1..381: mol_type = genomic DNA
tccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttcct

SEQ ID NO: 49402 - DNA, 30 bp, Homo sapiens; identical to SEQ ID NO: 28527
  misc_feature 1..30: note = chr3:157824303-157824333
  misc_feature 1..30: note = hyper
  source 1..30: mol_type = genomic DNA

SEQ ID NO: 49403 - DNA, 38 bp, Homo sapiens; identical to SEQ ID NO: 18232
  misc_feature 1..38: note = chr3:157824871-157824909
  misc_feature 1..38: note = hyper
  source 1..38: mol_type = genomic DNA

SEQ ID NO: 49404 - DNA, 117 bp, Homo sapiens
  misc_feature 1..117: note = chr3:157825059-157825176
  misc_feature 1..117: note = hyper
  source 1..117: mol_type = genomic DNA
cgctctattattcgtgtcctggagcccagctgactcctctatggacagaccccgctaaaagggaccagtcgatttaacaagtttccccagcagctgttagctgacagatctcatttt

SEQ ID NO: 49405 - DNA, 92 bp, Homo sapiens; identical to SEQ ID NO: 7099
  misc_feature 1..92: note = chr3:158288920-158289012
  misc_feature 1..92: note = hyper
  source 1..92: mol_type = genomic DNA

SEQ ID NO: 49406 - DNA, 230 bp, Homo sapiens; identical to SEQ ID NO: 28531
  misc_feature 1..230: note = chr3:158449969-158450199
  misc_feature 1..230: note = hyper
  source 1..230: mol_type = genomic DNA

SEQ ID NO: 49407 - DNA, 37 bp, Homo sapiens
  misc_feature 1..37: note = chr3:159756650-159756687
  misc_feature 1..37: note = hyper
  source 1..37: mol_type = genomic DNA
ccgccctttctcctccgtggctccccagccaggaggc

SEQ ID NO: 49408 - DNA, 41 bp, Homo sapiens
  misc_feature 1..41: note = chr3:159756856-159756897
  misc_feature 1..41: note = hyper
  source 1..41: mol_type = genomic DNA
gaagactcggcgagcttttgtagccgcgggtagggacagcc

SEQ ID NO: 49409 - DNA, 300 bp, Homo sapiens; identical to SEQ ID NO: 28533
  misc_feature 1..300: note = chr3:159943920-159944220
  misc_feature 1..300: note = hyper
  source 1..300: mol_type = genomic DNA

SEQ ID NO: 49410 - DNA, 49 bp, Homo sapiens; identical to SEQ ID NO: 18234
  misc_feature 1..49: note = chr3:159944437-159944486
  misc_feature 1..49: note = hyper
  source 1..49: mol_type = genomic DNA

SEQ ID NO: 49411 - DNA, 57 bp, Homo sapiens
  misc_feature 1..57: note = chr3:159944546-159944603
  misc_feature 1..57: note = hyper
  source 1..57: mol_type = genomic DNA
ctgaggagaaaggaccgcagttccactcctttccctacctgccgcctggacaggtct

SEQ ID NO: 49412 - DNA, 185 bp, Homo sapiens; identical to SEQ ID NO: 28535
  misc_feature 1..185: note = chr3:160167683-160167868
  misc_feature 1..185: note = hyper
  source 1..185: mol_type = genomic DNA

SEQ ID NO: 49413 - DNA, 109 bp, Homo sapiens; identical to SEQ ID NO: 28536
  misc_feature 1..109: note = chr3:160822766-160822875
  misc_feature 1..109: note = hyper
  source 1..109: mol_type = genomic DNA

SEQ ID NO: 49414 - DNA, 217 bp, Homo sapiens; identical to SEQ ID NO: 28537
  misc_feature 1..217: note = chr3:161090326-161090543
  misc_feature 1..217: note = hyper
  source 1..217: mol_type = genomic DNA

SEQ ID NO: 49415 - DNA, 137 bp, Homo sapiens; identical to SEQ ID NO: 28538
  misc_feature 1..137: note = chr3:164911621-164911758
  misc_feature 1..137: note = hyper
  source 1..137: mol_type = genomic DNA

SEQ ID NO: 49416 - DNA, 512 bp, Homo sapiens
  misc_feature 1..512: note = chr3:164913872-164914384
  misc_feature 1..512: note = hyper
  source 1..512: mol_type = genomic DNA
agcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacg

SEQ ID NO: 49417 - DNA, 184 bp, Homo sapiens
  misc_feature 1..184: note = chr3:164914796-164914980
  misc_feature 1..184: note = hyper
  source 1..184: mol_type = genomic DNA
cctctcccccattatcggtcacaacctggcagctcttcaagagacaccctgtgaaattgagtgtcgggaagtcagcattctgtacccgtggattgatttgtaacttttatttgcaaatgagagagatgcctgtttggaaaattacagcccaaaaggtggagggtgatcaaattaagaacatctg

SEQ ID NO: 49418 - DNA, 116 bp, Homo sapiens; identical to SEQ ID NO: 18237
  misc_feature 1..116: note = chr3:164915129-164915245
  misc_feature 1..116: note = hyper
  source 1..116: mol_type = genomic DNA

SEQ ID NO: 49419 - DNA, 30 bp, Homo sapiens; identical to SEQ ID NO: 7107
  misc_feature 1..30: note = chr3:167097947-167097977
  misc_feature 1..30: note = hyper
  source 1..30: mol_type = genomic DNA

SEQ ID NO: 49420 - DNA, 66 bp, Homo sapiens; identical to SEQ ID NO: 28544
  misc_feature 1..66: note = chr3:167967494-167967560
  misc_feature 1..66: note = hyper
  source 1..66: mol_type = genomic DNA

SEQ ID NO: 49421 - DNA, 384 bp, Homo sapiens; identical to SEQ ID NO: 28545
  misc_feature 1..384: note = chr3:167967946-167968330
  misc_feature 1..384: note = hyper
  source 1..384: mol_type = genomic DNA

SEQ ID NO: 49422 - DNA, 47 bp, Homo sapiens; identical to SEQ ID NO: 28546
  misc_feature 1..47: note = chr3:168864015-168864062
  misc_feature 1..47: note = hyper
  source 1..47: mol_type = genomic DNA

SEQ ID NO: 49423 - DNA, 30 bp, Homo sapiens; identical to SEQ ID NO: 28547
  misc_feature 1..30: note = chr3:168960419-168960449
  misc_feature 1..30: note = hyper
  source 1..30: mol_type = genomic DNA

SEQ ID NO: 49424 - DNA, 149 bp, Homo sapiens; identical to SEQ ID NO: 28548
  misc_feature 1..149: note = chr3:169375895-169376044
  misc_feature 1..149: note = hyper
  source 1..149: mol_type = genomic DNA

SEQ ID NO: 49425 - DNA, 30 bp, Homo sapiens; identical to SEQ ID NO: 28549
  misc_feature 1..30: note = chr3:169376305-169376335
  misc_feature 1..30: note = hyper
  source 1..30: mol_type = genomic DNA

SEQ ID NO: 49426 - DNA, 78 bp, Homo sapiens
  misc_feature 1..78: note = chr3:169376602-169376680
  misc_feature 1..78: note = hyper
  source 1..78: mol_type = genomic DNA
ggttctccatctcaccgcccgcttccagcggaggcaacgcgcaggggggtgccgggagagagggggccgagccgggcg

SEQ ID NO: 49427 - DNA, 210 bp, Homo sapiens; identical to SEQ ID NO: 28551
  misc_feature 1..210: note = chr3:169379435-169379645
  misc_feature 1..210: note = hyper
  source 1..210: mol_type = genomic DNA

SEQ ID NO: 49428 - DNA, 42 bp, Homo sapiens; identical to SEQ ID NO: 28552
  misc_feature 1..42: note = chr3:169386544-169386586
  misc_feature 1..42: note = hyper
  source 1..42: mol_type = genomic DNA

SEQ ID NO: 49429 - DNA, 64 bp, Homo sapiens; identical to SEQ ID NO: 28553
  misc_feature 1..64: note = chr3:169483001-169483065
  misc_feature 1..64: note = hyper
  source 1..64: mol_type = genomic DNA

SEQ ID NO: 49430 - DNA, 428 bp, Homo sapiens; identical to SEQ ID NO: 28554
  misc_feature 1..428: note = chr3:169529973-169530401
  misc_feature 1..428: note = hyper
  source 1..428: mol_type = genomic DNA

SEQ ID NO: 49431 - DNA, 107 bp, Homo sapiens; identical to SEQ ID NO: 7111
  misc_feature 1..107: note = chr3:170136940-170137047
  misc_feature 1..107: note = hyper
  source 1..107: mol_type = genomic DNA

SEQ ID NO: 49432 - DNA, 73 bp, Homo sapiens
  misc_feature 1..73: note = chr3:170302544-170302617
  misc_feature 1..73: note = hyper
  source 1..73: mol_type = genomic DNA
ctaccttgcccccagcgctctcctagaccctatacctagggggaggcagggtgacatcctgcggcccttgggc

SEQ ID NO: 49433 - DNA, 58 bp, Homo sapiens
  misc_feature 1..58: note = chr3:170303029-170303087
  misc_feature 1..58: note = hyper
  source 1..58: mol_type = genomic DNA
agcttccctggacaccgctcccgtcacgtcctcttcgccgctcccgggagagtcacca

SEQ ID NO: 49434 - DNA, 14 bp, Homo sapiens
  misc_feature 1..14: note = chr3:170303129-170303143
  misc_feature 1..14: note = hyper
  source 1..14: mol_type = genomic DNA
cggggtgctgggct

SEQ ID NO: 49435 - DNA, 72 bp, Homo sapiens
  misc_feature 1..72: note = chr3:170303423-170303495
  misc_feature 1..72: note = hyper
  source 1..72: mol_type = genomic DNA
gcgagtcagagcccggtgcccccagaccgcgggcagtcggggcctcattccgggccagagcaggaaagagcc

SEQ ID NO: 49436 - DNA, 71 bp, Homo sapiens
  misc_feature 1..71: note = chr3:170303844-170303915
  misc_feature 1..71: note = hyper
  source 1..71: mol_type = genomic DNA
gctcctcaattattcagattgggcccccaccccccgaacccctccccgtgcctgctcgtcctccctccagc

SEQ ID NO: 49437 - DNA, 346 bp, Homo sapiens; identical to SEQ ID NO: 28560
  misc_feature 1..346: note = chr3:170625828-170626174
  misc_feature 1..346: note = hyper
  source 1..346: mol_type = genomic DNA

SEQ ID NO: 49438 - DNA, 63 bp, Homo sapiens; identical to SEQ ID NO: 28561
  misc_feature 1..63: note = chr3:170626617-170626680
  misc_feature 1..63: note = hyper
  source 1..63: mol_type = genomic DNA

SEQ ID NO: 49439 - DNA, 11 bp, Homo sapiens
  misc_feature 1..11: note = chr3:172165432-172165443
  misc_feature 1..11: note = hyper
  source 1..11: mol_type = genomic DNA
gttctggtccc

SEQ ID NO: 49440 - DNA, 33 bp, Homo sapiens; identical to SEQ ID NO: 28565
  misc_feature 1..33: note = chr3:172166672-172166705
  misc_feature 1..33: note = hyper
  source 1..33: mol_type = genomic DNA

SEQ ID NO: 49441 - DNA, 43 bp, Homo sapiens; identical to SEQ ID NO: 28567
  misc_feature 1..43: note = chr3:172167431-172167474
  misc_feature 1..43: note = hyper
  source 1..43: mol_type = genomic DNA

SEQ ID NO: 49442 - DNA, 65 bp, Homo sapiens
  misc_feature 1..65: note = chr3:172167595-172167660
  misc_feature 1..65: note = hyper
  source 1..65: mol_type = genomic DNA
cgaattcacaaatccgaccggcccctcccggcccaccgacctcgggaccgccccaggaacatatt

SEQ ID NO: 49443 - DNA, 32 bp, Homo sapiens; identical to SEQ ID NO: 28569
  misc_feature 1..32: note = chr3:173113479-173113511
  misc_feature 1..32: note = hyper
  source 1..32: mol_type = genomic DNA

SEQ ID NO: 49444 - DNA, 386 bp, Homo sapiens; identical to SEQ ID NO: 28570
  misc_feature 1..386: note = chr3:173114201-173114587
  misc_feature 1..386: note = hyper
  source 1..386: mol_type = genomic DNA

SEQ ID NO: 49445 - DNA, 252 bp, Homo sapiens
  misc_feature 1..252: note = chr3:173114985-173115237
  misc_feature 1..252: note = hyper
  source 1..252: mol_type = genomic DNA
acagtggaggagattcgccttccgtttctgcataaaaccaatacattttacttggagggtaatttgccagagttgagcgagacgaagccgtgtctaaataagtacatgacactaaatttccttttaaatccaccttttacaccatggccagtcgcttgtttaactcccgttcaagggacacggttttcaaacgtgaccttttggggagatgtgggaacttcccctcatttcttcttctgtgccgctaacctc

SEQ ID NO: 49446 - DNA, 144 bp, Homo sapiens
  misc_feature 1..144: note = chr3:173115550-173115694
  misc_feature 1..144: note = hyper
  source 1..144: mol_type = genomic DNA
aggatcaggcggcggcgcggagagcgcgcccgggcggccagcgccgagcgcgcggagctggcgtggggagacacggcaggaaaggcgagtcggagtgggtgatgagaggccgggagagcccgtccgagccggagagaccggaga

SEQ ID NO: 49447 - DNA, 210 bp, Homo sapiens; identical to SEQ ID NO: 7127
  misc_feature 1..210: note = chr3:173115965-173116175
  misc_feature 1..210: note = hyper
  source 1..210: mol_type = genomic DNA

SEQ ID NO: 49448 - DNA, 65 bp, Homo sapiens; identical to SEQ ID NO: 18250
  misc_feature 1..65: note = chr3:173302927-173302992
  misc_feature 1..65: note = hyper
  source 1..65: mol_type = genomic DNA

SEQ ID NO: 49449 - DNA, 374 bp, Homo sapiens; identical to SEQ ID NO: 18251
  misc_feature 1..374: note = chr3:179169266-179169640
  misc_feature 1..374: note = hyper
  source 1..374: mol_type = genomic DNA

SEQ ID NO: 49450 - DNA, 732 bp, Homo sapiens; identical to SEQ ID NO: 28581
  misc_feature 1..732: note = chr3:180397310-180398042
  misc_feature 1..732: note = hyper
  source 1..732: mol_type = genomic DNA

SEQ ID NO: 49451 - DNA, 321 bp, Homo sapiens
  misc_feature 1..321: note = chr3:181413421-181413742
  misc_feature 1..321: note = hyper
  source 1..321: mol_type = genomic DNA
gacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctcta

SEQ ID NO: 49452 - DNA, 73 bp, Homo sapiens
  misc_feature 1..73: note = chr3:181414330-181414403
  misc_feature 1..73: note = hyper
  source 1..73: mol_type = genomic DNA
ctctttcttctttcctcctctccttttcccctttctctttttcttcctcaatctaggtcgtttctgctgaatg

SEQ ID NO: 49453 - DNA, 95 bp, Homo sapiens; identical to SEQ ID NO: 28583
  misc_feature 1..95: note = chr3:181419696-181419791
  misc_feature 1..95: note = hyper
  source 1..95: mol_type = genomic DNA

SEQ ID NO: 49454 - DNA, 154 bp, Homo sapiens
  misc_feature 1..154: note = chr3:181419911-181420065
  misc_feature 1..154: note = hyper
  source 1..154: mol_type = genomic DNA
aaagaatttagcctttaatctctttttatccacgaagactaaagctctgtactcgaccccgcgagcggctctcgccttccggggctggaacccgactcagatgtgaagcggcactgagccgctgcgcaggttcgtgcccagcgccccctgttgg

SEQ ID NO: 49455 - DNA, 200 bp, Homo sapiens; identical to SEQ ID NO: 18258
  misc_feature 1..200: note = chr3:181420116-181420316
  misc_feature 1..200: note = hyper
  source 1..200: mol_type = genomic DNA

SEQ ID NO: 49456 - DNA, 112 bp, Homo sapiens
  misc_feature 1..112: note = chr3:181420374-181420486
  misc_feature 1..112: note = hyper
  source 1..112: mol_type = genomic DNA
ttttctgtagccgtggagaatcaagcaaagtatacttcctccgttttgtccacatttcaaaaaattaaacggaagatgctgctgcttgctgttttgacgttgtcagcagcgt

SEQ ID NO: 49457 - DNA, 162 bp, Homo sapiens
  misc_feature 1..162: note = chr3:181421249-181421411
  misc_feature 1..162: note = hyper
  source 1..162: mol_type = genomic DNA
acctcccaaaattagcgaattcgagataacatttcaaggggaattgctatttagtgcgatgagagatgacttctccatctggttccagaattagatctcggcttaggttttttagtaagtaggttcagatgcaatggaaggagagaagaatcaagccttttg

SEQ ID NO: 49458 - DNA, 103 bp, Homo sapiens
  misc_feature 1..103: note = chr3:181422282-181422385
  misc_feature 1..103: note = hyper
  source 1..103: mol_type = genomic DNA
agcttaggcccactgagaccctgccaactcctcagacccttttccccttcatccctcacacctttcatgatgaacccaggaaagaacccgaactctgaaaaac

SEQ ID NO: 49459 - DNA, 190 bp, Homo sapiens; identical to SEQ ID NO: 18261
  misc_feature 1..190: note = chr3:181422985-181423175
  misc_feature 1..190: note = hyper
  source 1..190: mol_type = genomic DNA

SEQ ID NO: 49460 - DNA, 75 bp, Homo sapiens
  misc_feature 1..75: note = chr3:181428313-181428388
  misc_feature 1..75: note = hyper
  source 1..75: mol_type = genomic DNA
ctattgaaatctttacgtcgggacaatgggagagcggctaaaattaccctcttgggtcctgggcgggcaagattc

SEQ ID NO: 49461 - DNA, 56 bp, Homo sapiens
  misc_feature 1..56: note = chr3:181428772-181428828
  misc_feature 1..56: note = hyper
  source 1..56: mol_type = genomic DNA
ccagcccccatttgaaagccgcacgaccgaaacccttcttacggggaggcatggga

SEQ ID NO: 49462 - DNA, 32 bp, Homo sapiens; identical to SEQ ID NO: 28588
  misc_feature 1..32: note = chr3:181430289-181430321
  misc_feature 1..32: note = hyper
  source 1..32: mol_type = genomic DNA

SEQ ID NO: 49463 - DNA, 551 bp, Homo sapiens
  misc_feature 1..551: note = chr3:181430771-181431322
  misc_feature 1..551: note = hyper
  source 1..551: mol_type = genomic DNA
ctccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaa

SEQ ID NO: 49464 - DNA, 181 bp, Homo sapiens
  misc_feature 1..181: note = chr3:181437349-181437530
  misc_feature 1..181: note = hyper
  source 1..181: mol_type = genomic DNA
atggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagc

SEQ ID NO: 49465 - DNA, 27 bp, Homo sapiens
  misc_feature 1..27: note = chr3:181438167-181438194
  misc_feature 1..27: note = hyper
  source 1..27: mol_type = genomic DNA
gtattaaataaggagcggtgaattctt

SEQ ID NO: 49466 - DNA, 70 bp, Homo sapiens; identical to SEQ ID NO: 18265
  misc_feature 1..70: note = chr3:181438353-181438423
  misc_feature 1..70: note = hyper
  source 1..70: mol_type = genomic DNA

SEQ ID NO: 49467 - DNA, 30 bp, Homo sapiens; identical to SEQ ID NO: 7147
  misc_feature 1..30: note = chr3:181440785-181440815
  misc_feature 1..30: note = hyper
  source 1..30: mol_type = genomic DNA

SEQ ID NO: 49468 - DNA, 218 bp, Homo sapiens
  misc_feature 1..218: note = chr3:181441927-181442145
  misc_feature 1..218: note = hyper
  source 1..218: mol_type = genomic DNA
actcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgc

SEQ ID NO: 49469 - DNA, 16 bp, Homo sapiens
  misc_feature 1..16: note = chr3:181442410-181442426
  misc_feature 1..16: note = hyper
  source 1..16: mol_type = genomic DNA
tttctagacagtgttg

SEQ ID NO: 49470 - DNA, 51 bp, Homo sapiens
  misc_feature 1..51: note = chr3:181442963-181443014
  misc_feature 1..51: note = hyper
  source 1..51: mol_type = genomic DNA
ctggaagagcacatgaaactcagagaactacaatgcagacgacaacgccta

SEQ ID NO: 49471 - DNA, 58 bp, Homo sapiens
  misc_feature 1..58: note = chr3:181444050-181444108
  misc_feature 1..58: note = hyper
  source 1..58: mol_type = genomic DNA
cataattatgcactgcagattctccagcctcctcgccctcaatcttggtaacctggtc

SEQ ID NO: 49472 - DNA, 356 bp, Homo sapiens; identical to SEQ ID NO: 18268
  misc_feature 1..356: note = chr3:181445013-181445369
  misc_feature 1..356: note = hyper
  source 1..356: mol_type = genomic DNA

SEQ ID NO: 49473 - DNA, 261 bp, Homo sapiens
  misc_feature 1..261: note = chr3:181445464-181445725
  misc_feature 1..261: note = hyper
  source 1..261: mol_type = genomic DNA
tttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatc

SEQ ID NO: 49474 - DNA, 30 bp, Homo sapiens; identical to SEQ ID NO: 28603
  misc_feature 1..30: note = chr3:182896611-182896641
  misc_feature 1..30: note = hyper
  source 1..30: mol_type = genomic DNA

SEQ ID NO: 49475 - DNA, 224 bp, Homo sapiens; identical to SEQ ID NO: 28604
  misc_feature 1..224: note = chr3:182896884-182897108
  misc_feature 1..224: note = hyper
  source 1..224: mol_type = genomic DNA

SEQ ID NO: 49476 - DNA, 313 bp, Homo sapiens; identical to SEQ ID NO: 28605
  misc_feature 1..313: note = chr3:182897157-182897470
  misc_feature 1..313: note = hyper
  source 1..313: mol_type = genomic DNA

SEQ ID NO: 49477 - DNA, 110 bp, Homo sapiens; identical to SEQ ID NO: 28606
  misc_feature 1..110: note = chr3:182971127-182971237
  misc_feature 1..110: note = hyper
  source 1..110: mol_type = genomic DNA

SEQ ID NO: 49478 - DNA, 41 bp, Homo sapiens; identical to SEQ ID NO: 18272
  misc_feature 1..41: note = chr3:183145371-183145412
  misc_feature 1..41: note = hyper
  source 1..41: mol_type = genomic DNA

SEQ ID NO: 49479 - DNA, 55 bp, Homo sapiens; identical to SEQ ID NO: 28608
  misc_feature 1..55: note = chr3:183948534-183948589
  misc_feature 1..55: note = hyper
  source 1..55: mol_type = genomic DNA

SEQ ID NO: 49480 - DNA, 78 bp, Homo sapiens; identical to SEQ ID NO: 28609
  misc_feature 1..78: note = chr3:183978018-183978096
  misc_feature 1..78: note = hyper
  source 1..78: mol_type = genomic DNA

SEQ ID NO: 49481 - DNA, 522 bp, Homo sapiens; identical to SEQ ID NO: 28610
  misc_feature 1..522: note = chr3:183980079-183980601
  misc_feature 1..522: note = hyper
  source 1..522: mol_type = genomic DNA

SEQ ID NO: 49482 - DNA, 37 bp, Homo sapiens; identical to SEQ ID NO: 28611
  misc_feature 1..37: note = chr3:183993816-183993853
  misc_feature 1..37: note = hyper
  source 1..37: mol_type = genomic DNA

SEQ ID NO: 49483 - DNA, 374 bp, Homo sapiens; identical to SEQ ID NO: 28612
  misc_feature 1..374: note = chr3:184243074-184243448
  misc_feature 1..374: note = hyper
  source 1..374: mol_type = genomic DNA

SEQ ID NO: 49484 - DNA, 169 bp, Homo sapiens; identical to SEQ ID NO: 28613
  misc_feature 1..169: note = chr3:184301502-184301671
  misc_feature 1..169: note = hyper
  source 1..169: mol_type = genomic DNA

SEQ ID NO: 49485 - DNA, 205 bp, Homo sapiens
  misc_feature 1..205: note = chr3:184319891-184320096
  misc_feature 1..205: note = hyper
  source 1..205: mol_type = genomic DNA
cattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggc

SEQ ID NO: 49486 - DNA, 95 bp, Homo sapiens; identical to SEQ ID NO: 28616
  misc_feature 1..95: note = chr3:184321779-184321874
  misc_feature 1..95: note = hyper
  source 1..95: mol_type = genomic DNA

SEQ ID NO: 49487 - DNA, 47 bp, Homo sapiens; identical to SEQ ID NO: 28617
  misc_feature 1..47: note = chr3:184322209-184322256
  misc_feature 1..47: note = hyper
  source 1..47: mol_type = genomic DNA

SEQ ID NO: 49488 - DNA, 46 bp, Homo sapiens; identical to SEQ ID NO: 28618
  misc_feature 1..46: note = chr3:184870261-184870307
  misc_feature 1..46: note = hyper
  source 1..46: mol_type = genomic DNA

SEQ ID NO: 49489 - DNA, 262 bp, Homo sapiens; identical to SEQ ID NO: 28619
  misc_feature 1..262: note = chr3:184871031-184871293
  misc_feature 1..262: note = hyper
  source 1..262: mol_type = genomic DNA

SEQ ID NO: 49490 - DNA, 43 bp, Homo sapiens; identical to SEQ ID NO: 28620
  misc_feature 1..43: note = chr3:185543626-185543669
  misc_feature 1..43: note = hyper
  source 1..43: mol_type = genomic DNA

SEQ ID NO: 49491 - DNA, 60 bp, Homo sapiens; identical to SEQ ID NO: 28621
  misc_feature 1..60: note = chr3:185544035-185544095
  misc_feature 1..60: note = hyper
  source 1..60: mol_type = genomic DNA

SEQ ID NO: 49492 - DNA, 43 bp, Homo sapiens
  misc_feature 1..43: note = chr3:186078723-186078766
  misc_feature 1..43: note = hyper
  source 1..43: mol_type = genomic DNA
agtccgaggaggcagcggcgcagcgcgggagagcgcgcccacg

SEQ ID NO: 49493 - DNA, 306 bp, Homo sapiens
  misc_feature 1..306: note = chr3:186078898-186079204
  misc_feature 1..306: note = hyper
  source 1..306: mol_type = genomic DNA
ccatctgggaggtggttctagctctagtcccaagctttccactgcagtgatggtggggatgggggcagcacgtcaaatcacctgtagggctttttagaactccacagccccctcccctaattctattccactagttcaaacgaagaaaatctcagactaggcaaggggaggtggaccggtggagtctgcgaaagcaccacaggtgactccgggtacgcactcctcaggacacaagcacacacacggacacatcttgtgactctgagactacacagatcaacctcagattcgacccttccctccttt

SEQ ID NO: 49494 - DNA, 104 bp, Homo sapiens; identical to SEQ ID NO: 7167
  misc_feature 1..104: note = chr3:186079667-186079771
  misc_feature 1..104: note = hyper
  source 1..104: mol_type = genomic DNA

SEQ ID NO: 49495 - DNA, 370 bp, Homo sapiens
  misc_feature 1..370: note = chr3:186079818-186080188
  misc_feature 1..370: note = hyper
  source 1..370: mol_type = genomic DNA
cgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcac

SEQ ID NO: 49496 - DNA, 27 bp, Homo sapiens
  misc_feature 1..27: note = chr3:186080218-186080245
  misc_feature 1..27: note = hyper
  source 1..27: mol_type = genomic DNA
tgaccccctttggtgcaactagggcgc

SEQ ID NO: 49497 - DNA, 49 bp, Homo sapiens; identical to SEQ ID NO: 7169
  misc_feature 1..49: note = chr3:186080246-186080295
  misc_feature 1..49: note = hyper
  source 1..49: mol_type = genomic DNA

SEQ ID NO: 49498 - DNA, 102 bp, Homo sapiens
  misc_feature 1..102: note = chr3:186857050-186857152
  misc_feature 1..102: note = hyper
  source 1..102: mol_type = genomic DNA
tgcaagggcctggggcgcgggcggaaaaggcgggcccagctccctcaggtctgcgtgtcaccgacccgaacccgctccgtcgtcctgacgcccccggcctag

SEQ ID NO: 49499 - DNA, 107 bp, Homo sapiens
  misc_feature 1..107: note = chr3:186857607-186857714
  misc_feature 1..107: note = hyper
  source 1..107: mol_type = genomic DNA
ggaaccgccaatgcctccagggggcgctctccctcccatcgagccaccgccgggccattggagaccaggaggacctctcagctccatccctgcgtctctaacaattg

SEQ ID NO: 49500 - DNA, 59 bp, Homo sapiens; identical to SEQ ID NO: 18284
  misc_feature 1..59: note = chr3:187387791-187387850
  misc_feature 1..59: note = hyper
  source 1..59: mol_type = genomic DNA

SEQ ID NO: 49501 - DNA, 1255 bp, Homo sapiens; identical to SEQ ID NO: 28629
  misc_feature 1..1255: note = chr3:187455388-187456643
  misc_feature 1..1255: note = hyper
  source 1..1255: mol_type = genomic DNA

SEQ ID NO: 49502 - DNA, 542 bp, Homo sapiens; identical to SEQ ID NO: 28630
  misc_feature 1..542: note = chr3:187457112-187457654
  misc_feature 1..542: note = hyper
  source 1..542: mol_type = genomic DNA

SEQ ID NO: 49503 - DNA, 329 bp, Homo sapiens; identical to SEQ ID NO: 28631
  misc_feature 1..329: note = chr3:189838508-189838837
  misc_feature 1..329: note = hyper
  source 1..329: mol_type = genomic DNA

SEQ ID NO: 49504 - DNA, 39 bp, Homo sapiens; identical to SEQ ID NO: 28632
  misc_feature 1..39: note = chr3:190039913-190039952
  misc_feature 1..39: note = hyper
  source 1..39: mol_type = genomic DNA

SEQ ID NO: 49505 - DNA, 48 bp, Homo sapiens; identical to SEQ ID NO: 28633
  misc_feature 1..48: note = chr3:190529604-190529652
  misc_feature 1..48: note = hyper
  source 1..48: mol_type = genomic DNA

SEQ ID NO: 49506 - DNA, 107 bp, Homo sapiens; identical to SEQ ID NO: 28634
  misc_feature 1..107: note = chr3:190580805-190580912
  misc_feature 1..107: note = hyper
  source 1..107: mol_type = genomic DNA

SEQ ID NO: 49507 - DNA, 97 bp, Homo sapiens; identical to SEQ ID NO: 18289
  misc_feature 1..97: note = chr3:192126863-192126960
  misc_feature 1..97: note = hyper
  source 1..97: mol_type = genomic DNA

SEQ ID NO: 49508 - DNA, 393 bp, Homo sapiens
  misc_feature 1..393: note = chr3:192126961-192127354
  misc_feature 1..393: note = hyper
  source 1..393: mol_type = genomic DNA
ctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtc

SEQ ID NO: 49509 - DNA, 66 bp, Homo sapiens
  misc_feature 1..66: note = chr3:192128074-192128140
  misc_feature 1..66: note = hyper
  source 1..66: mol_type = genomic DNA
tcctctctgtgtcttctgtctctccccttttctcctctctacgcaatcctacgtgattgaggtttg

SEQ ID NO: 49510 - DNA, 201 bp, Homo sapiens; identical to SEQ ID NO: 28642
  misc_feature 1..201: note = chr3:192231876-192232077
  misc_feature 1..201: note = hyper
  source 1..201: mol_type = genomic DNA

SEQ ID NO: 49511 - DNA, 19 bp, Homo sapiens
  misc_feature 1..19: note = chr3:192232078-192232097
  misc_feature 1..19: note = hyper
  source 1..19: mol_type = genomic DNA
agcaacttttcggagacac

SEQ ID NO: 49512 - DNA, 245 bp, Homo sapiens; identical to SEQ ID NO: 28644
  misc_feature 1..245: note = chr3:192232574-192232819
  misc_feature 1..245: note = hyper
  source 1..245: mol_type = genomic DNA

SEQ ID NO: 49513 - DNA, 379 bp, Homo sapiens
  misc_feature 1..379: note = chr3:192233150-192233529
  misc_feature 1..379: note = hyper
  source 1..379: mol_type = genomic DNA
agggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggc

SEQ ID NO: 49514 - DNA, 30 bp, Homo sapiens; identical to SEQ ID NO: 28647
  misc_feature 1..30: note = chr3:192445447-192445477
  misc_feature 1..30: note = hyper
  source 1..30: mol_type = genomic DNA

SEQ ID NO: 49515 - DNA, 136 bp, Homo sapiens; identical to SEQ ID NO: 28648
  misc_feature 1..136: note = chr3:192634345-192634481
  misc_feature 1..136: note = hyper
  source 1..136: mol_type = genomic DNA

SEQ ID NO: 49516 - DNA, 32 bp, Homo sapiens; identical to SEQ ID NO: 28649
  misc_feature 1..32: note = chr3:192959076-192959108
  misc_feature 1..32: note = hyper
  source 1..32: mol_type = genomic DNA

SEQ ID NO: 49517 - DNA, 13 bp, Homo sapiens
  misc_feature 1..13: note = chr3:193776076-193776089
  misc_feature 1..13: note = hyper
  source 1..13: mol_type = genomic DNA
cggttcctctgca

SEQ ID NO: 49518 - DNA, 60 bp, Homo sapiens; identical to SEQ ID NO: 18297
  misc_feature 1..60: note = chr3:193776119-193776179
  misc_feature 1..60: note = hyper
  source 1..60: mol_type = genomic DNA

SEQ ID NO: 49519 - DNA, 69 bp, Homo sapiens; identical to SEQ ID NO: 28651
  misc_feature 1..69: note = chr3:193776392-193776461
  misc_feature 1..69: note = hyper
  source 1..69: mol_type = genomic DNA

SEQ ID NO: 49520 - DNA, 33 bp, Homo sapiens; identical to SEQ ID NO: 28652
  misc_feature 1..33: note = chr3:194208225-194208258
  misc_feature 1..33: note = hyper
  source 1..33: mol_type = genomic DNA

SEQ ID NO: 49521 - DNA, 23 bp, Homo sapiens
  misc_feature 1..23: note = chr3:194208562-194208585
  misc_feature 1..23: note = hyper
  source 1..23: mol_type = genomic DNA
cttcttgccgctacttacagaac

SEQ ID NO: 49522 - DNA, 216 bp, Homo sapiens; identical to SEQ ID NO: 28654
  misc_feature 1..216: note = chr3:194407566-194407782
  misc_feature 1..216: note = hyper
  source 1..216: mol_type = genomic DNA

SEQ ID NO: 49523 - DNA, 98 bp, Homo sapiens
  misc_feature 1..98: note = chr3:194409021-194409119
  misc_feature 1..98: note = hyper
  source 1..98: mol_type = genomic DNA
ggctctgttgcgcgtggggatgcggggagatttgagaggggaaaaccccgccaggagggagagagaggcacccctctgggatgcgggtgagggaaggt

SEQ ID NO: 49524 - DNA, 95 bp, Homo sapiens; identical to SEQ ID NO: 28657
  misc_feature 1..95: note = chr3:195474927-195475022
  misc_feature 1..95: note = hyper
  source 1..95: mol_type = genomic DNA

SEQ ID NO: 49525 - DNA, 174 bp, Homo sapiens; identical to SEQ ID NO: 28659
  misc_feature 1..174: note = chr3:196366687-196366861
  misc_feature 1..174: note = hyper
  source 1..174: mol_type = genomic DNA

SEQ ID NO: 49526 - DNA, 30 bp, Homo sapiens; identical to SEQ ID NO: 28660
  misc_feature 1..30: note = chr3:196755999-196756029
  misc_feature 1..30: note = hyper
  source 1..30: mol_type = genomic DNA

SEQ ID NO: 49527 - DNA, 145 bp, Homo sapiens; identical to SEQ ID NO: 28661
  misc_feature 1..145: note = chr3:197183201-197183346
  misc_feature 1..145: note = hyper
  source 1..145: mol_type = genomic DNA

SEQ ID NO: 49528 - DNA, 131 bp, Homo sapiens; identical to SEQ ID NO: 28662
  misc_feature 1..131: note = chr3:197840417-197840548
  misc_feature 1..131: note = hyper
  source 1..131: mol_type = genomic DNA

SEQ ID NO: 49529 - DNA, 607 bp, Homo sapiens
  misc_feature 1..607: note = chr4:330715-331322
  misc_feature 1..607: note = hyper
  source 1..607: mol_type = genomic DNA
gggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgta

SEQ ID NO: 49530 - DNA, 172 bp, Homo sapiens; identical to SEQ ID NO: 28664
  misc_feature 1..172: note = chr4:331562-331734
  misc_feature 1..172: note = hyper
  source 1..172: mol_type = genomic DNA

SEQ ID NO: 49531 - DNA, 121 bp, Homo sapiens; identical to SEQ ID NO: 28665
  misc_feature 1..121: note = chr4:332122-332243
  misc_feature 1..121: note = hyper
  source 1..121: mol_type = genomic DNA

SEQ ID NO: 49532 - DNA, 30 bp, Homo sapiens; identical to SEQ ID NO: 28666
  misc_feature 1..30: note = chr4:380533-380563
  misc_feature 1..30: note = hyper
  source 1..30: mol_type = genomic DNA

SEQ ID NO: 49533 - DNA, 116 bp, Homo sapiens
  misc_feature 1..116: note = chr4:568313-568429
  misc_feature 1..116: note = hyper
  source 1..116: mol_type = genomic DNA
tcgctctgtccccctcgcctcggaccaccaggcagagcagccccagggtttggacttgccaagaaaagtgcagtcgggctagccaagcccaaacatttattgtaaacttgaaaatg

SEQ ID NO: 49534 - DNA, 33 bp, Homo sapiens; identical to SEQ ID NO: 28671
  misc_feature 1..33: note = chr4:570224-570257
  misc_feature 1..33: note = hyper
  source 1..33: mol_type = genomic DNA

SEQ ID NO: 49535 - DNA, 203 bp, Homo sapiens; identical to SEQ ID NO: 7201
  misc_feature 1..203: note = chr4:570298-570501
  misc_feature 1..203: note = hyper
  source 1..203: mol_type = genomic DNA

SEQ ID NO: 49536 - DNA, 130 bp, Homo sapiens; identical to SEQ ID NO: 18304
  misc_feature 1..130: note = chr4:570836-570966
  misc_feature 1..130: note = hyper
  source 1..130: mol_type = genomic DNA

SEQ ID NO: 49537 - DNA, 495 bp, Homo sapiens; identical to SEQ ID NO: 18305
  misc_feature 1..495: note = chr4:571013-571508
  misc_feature 1..495: note = hyper
  source 1..495: mol_type = genomic DNA

SEQ ID NO: 49538 - DNA, 264 bp, Homo sapiens
  misc_feature 1..264: note = chr4:571689-571953
  misc_feature 1..264: note = hyper
  source 1..264: mol_type = genomic DNA
gaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccaga

SEQ ID NO: 49539 - DNA, 108 bp, Homo sapiens; identical to SEQ ID NO: 28674
  misc_feature 1..108: note = chr4:779786-779894
  misc_feature 1..108: note = hyper
  source 1..108: mol_type = genomic DNA

SEQ ID NO: 49540 - DNA, 154 bp, Homo sapiens; identical to SEQ ID NO: 28675
  misc_feature 1..154: note = chr4:788810-788964
  misc_feature 1..154: note = hyper
  source 1..154: mol_type = genomic DNA

SEQ ID NO: 49541 - DNA, 341 bp, Homo sapiens; identical to SEQ ID NO: 28676
  misc_feature 1..341: note = chr4:789169-789510
  misc_feature 1..341: note = hyper
  source 1..341: mol_type = genomic DNA

SEQ ID NO: 49542 - DNA, 15 bp, Homo sapiens
  misc_feature 1..15: note = chr4:967602-967617
  misc_feature 1..15: note = hyper
  source 1..15: mol_type = genomic DNA
cgggccagacttctc

SEQ ID NO: 49543 - DNA, 36 bp, Homo sapiens; identical to SEQ ID NO: 28678
  misc_feature 1..36: note = chr4:967716-967752
  misc_feature 1..36: note = hyper
  source 1..36: mol_type = genomic DNA

SEQ ID NO: 49544 - DNA, 44 bp, Homo sapiens; identical to SEQ ID NO: 7207
  misc_feature 1..44: note = chr4:996495-996539
  misc_feature 1..44: note = hyper
  source 1..44: mol_type = genomic DNA

SEQ ID NO: 49545 - DNA, 103 bp, Homo sapiens
  misc_feature 1..103: note = chr4:1165470-1165573
  misc_feature 1..103: note = hyper
  source 1..103: mol_type = genomic DNA
ccgcatccccggaaccgcacaccgcaggcgctcggcaaacattctggtgttagagtctcccgacgtcagcacgccccagactgggaagcgccgccgtgcagct

SEQ ID NO: 49546 - DNA, 307 bp, Homo sapiens; identical to SEQ ID NO: 28683
  misc_feature 1..307: note = chr4:1165999-1166306
  misc_feature 1..307: note = hyper
  source 1..307: mol_type = genomic DNA

SEQ ID NO: 49547 - DNA, 172 bp, Homo sapiens
  misc_feature 1..172: note = chr4:1396406-1396578
  misc_feature 1..172: note = hyper
  source 1..172: mol_type = genomic DNA
ctcaaggccaacacccgaggagccttggtccccaccggagaggattcacgggtgggcccggccgggcggagggcggcgcgggagcctgggagaagggggcgcggccgcctgcggtttattgattgagtgaagttccgcaaagtgcttcgcagcgggccgagcccgcgggagc

SEQ ID NO: 49548 - DNA, 20 bp, Homo sapiens
  misc_feature 1..20: note = chr4:1397376-1397396
  misc_feature 1..20: note = hyper
  source 1..20: mol_type = genomic DNA
cgcgccctggcaacccgacc

SEQ ID NO: 49549 - DNA, 26 bp, Homo sapiens
  misc_feature 1..26: note = chr4:1398277-1398303
  misc_feature 1..26: note = hyper
  source 1..26: mol_type = genomic DNA
gggtagggccctgctcggcctcacca

SEQ ID NO: 49550 - DNA, 72 bp, Homo sapiens; identical to SEQ ID NO: 7212
  misc_feature 1..72: note = chr4:1399065-1399137
  misc_feature 1..72: note = hyper
  source 1..72: mol_type = genomic DNA

SEQ ID NO: 49551 - DNA, 30 bp, Homo sapiens; identical to SEQ ID NO: 28689
  misc_feature 1..30: note = chr4:1399500-1399530
  misc_feature 1..30: note = hyper
  source 1..30: mol_type = genomic DNA

SEQ ID NO: 49552 - DNA, 92 bp, Homo sapiens; identical to SEQ ID NO: 7213
  misc_feature 1..92: note = chr4:1400248-1400340
  misc_feature 1..92: note = hyper
  source 1..92: mol_type = genomic DNA

SEQ ID NO: 49553 - DNA, 525 bp, Homo sapiens; identical to SEQ ID NO: 28691
  misc_feature 1..525: note = chr4:1400997-1401522
  misc_feature 1..525: note = hyper
  source 1..525: mol_type = genomic DNA

SEQ ID NO: 49554 - DNA, 69 bp, Homo sapiens
  misc_feature 1..69: note = chr4:1401642-1401711
  misc_feature 1..69: note = hyper
  source 1..69: mol_type = genomic DNA
cgcgtgcaccggcgggtgtgcgcgccgccttacactgcggtccccggagcctgttccgcgcgcagggcg

SEQ ID NO: 49555 - DNA, 87 bp, Homo sapiens
  misc_feature 1..87: note = chr4:1401743-1401830
  misc_feature 1..87: note = hyper
  source 1..87: mol_type = genomic DNA
tggaagcagaaattaaaagttgggagaaataatggtggaccgatcggctgtaatttgggccaagctcggacacgctgagccccaggg

SEQ ID NO: 49556 - DNA, 99 bp, Homo sapiens; identical to SEQ ID NO: 28693
  misc_feature 1..99: note = chr4:1402294-1402393
  misc_feature 1..99: note = hyper
  source 1..99: mol_type = genomic DNA

SEQ ID NO: 49557 - DNA, 99 bp, Homo sapiens; identical to SEQ ID NO: 28694
  misc_feature 1..99: note = chr4:1403967-1404066
  misc_feature 1..99: note = hyper
  source 1..99: mol_type = genomic DNA

SEQ ID NO: 49558 - DNA, 411 bp, Homo sapiens; identical to SEQ ID NO: 28695
  misc_feature 1..411: note = chr4:1404120-1404531
  misc_feature 1..411: note = hyper
  source 1..411: mol_type = genomic DNA

SEQ ID NO: 49559 - DNA, 172 bp, Homo sapiens; identical to SEQ ID NO: 28696
  misc_feature 1..172: note = chr4:1407948-1408120
  misc_feature 1..172: note = hyper
  source 1..172: mol_type = genomic DNA

SEQ ID NO: 49560 - DNA, 41 bp, Homo sapiens; identical to SEQ ID NO: 28697
  misc_feature 1..41: note = chr4:1515026-1515067
  misc_feature 1..41: note = hyper
  source 1..41: mol_type = genomic DNA

SEQ ID NO: 49561 - DNA, 42 bp, Homo sapiens; identical to SEQ ID NO: 7219
  misc_feature 1..42: note = chr4:1811789-1811831
  misc_feature 1..42: note = hyper
  source 1..42: mol_type = genomic DNA

SEQ ID NO: 49562 - DNA, 66 bp, Homo sapiens; identical to SEQ ID NO: 28699
  misc_feature 1..66: note = chr4:1864167-1864233
  misc_feature 1..66: note = hyper
  source 1..66: mol_type = genomic DNA

SEQ ID NO: 49563 - DNA, 75 bp, Homo sapiens; identical to SEQ ID NO: 28700
  misc_feature 1..75: note = chr4:1864268-1864343
  misc_feature 1..75: note = hyper
  source 1..75: mol_type = genomic DNA

SEQ ID NO: 49564 - DNA, 56 bp, Homo sapiens; identical to SEQ ID NO: 28703
  misc_feature 1..56: note = chr4:2042655-2042711
  misc_feature 1..56: note = hyper
  source 1..56: mol_type = genomic DNA

SEQ ID NO: 49565 - DNA, 82 bp, Homo sapiens; identical to SEQ ID NO: 28704
  misc_feature 1..82: note = chr4:2043082-2043164
  misc_feature 1..82: note = hyper
  source 1..82: mol_type = genomic DNA

SEQ ID NO: 49566 - DNA, 90 bp, Homo sapiens; identical to SEQ ID NO: 28705
  misc_feature 1..90: note = chr4:2048818-2048908
  misc_feature 1..90: note = hyper
  source 1..90: mol_type = genomic DNA

SEQ ID NO: 49567 - DNA, 148 bp, Homo sapiens; identical to SEQ ID NO: 28706
  misc_feature 1..148: note = chr4:2060007-2060155
  misc_feature 1..148: note = hyper
  source 1..148: mol_type = genomic DNA

SEQ ID NO: 49568 - DNA, 115 bp, Homo sapiens; identical to SEQ ID NO: 28707
  misc_feature 1..115: note = chr4:2060173-2060288
  misc_feature 1..115: note = hyper
  source 1..115: mol_type = genomic DNA

SEQ ID NO: 49569 - DNA, 44 bp, Homo sapiens; identical to SEQ ID NO: 28708
  misc_feature 1..44: note = chr4:2061725-2061769
  misc_feature 1..44: note = hyper
  source 1..44: mol_type = genomic DNA

SEQ ID NO: 49570 - DNA, 114 bp, Homo sapiens; identical to SEQ ID NO: 28709
  misc_feature 1..114: note = chr4:2061972-2062086
  misc_feature 1..114: note = hyper
  source 1..114: mol_type = genomic DNA

SEQ ID NO: 49571 - DNA, 107 bp, Homo sapiens; identical to SEQ ID NO: 28710
  misc_feature 1..107: note = chr4:2418673-2418780
  misc_feature 1..107: note = hyper
  source 1..107: mol_type = genomic DNA

SEQ ID NO: 49572 - DNA, 84 bp, Homo sapiens; identical to SEQ ID NO: 18324
  misc_feature 1..84: note = chr4:2765778-2765862
  misc_feature 1..84: note = hyper
  source 1..84: mol_type = genomic DNA

SEQ ID NO: 49573 - DNA, 317 bp, Homo sapiens
  misc_feature 1..317: note = chr4:2765910-2766227
  misc_feature 1..317: note = hyper
  source 1..317: mol_type = genomic DNA
tgatgaaagctcgaatcttataggatccgtattcatttcccgtgggctcaagcccagcctccgcgggcggcgcgggccctcgcggcgagtgtccacgaggaggcggtgtggacccgcggccccagaccaggcctcaggcagaaggcgagcgcgagcgccccgcccagcccctccccgtcccgcaacccgcgccccgaccagcgcccccagcacctctccaccctcgctctcgagcagtctccacgtttgtctcagaggagacccactttgctccccagcgtgggcccctgagcgctgggggaagttggttggtttgt

SEQ ID NO: 49574 - DNA, 584 bp, Homo sapiens; identical to SEQ ID NO: 28712
  misc_feature 1..584: note = chr4:3767309-3767893
  misc_feature 1..584: note = hyper
  source 1..584: mol_type = genomic DNA

SEQ ID NO: 49575 - DNA, 91 bp, Homo sapiens; identical to SEQ ID NO: 28713
  misc_feature 1..91: note = chr4:3768116-3768207
  misc_feature 1..91: note = hyper
  source 1..91: mol_type = genomic DNA

SEQ ID NO: 49576 - DNA, 48 bp, Homo sapiens
  misc_feature 1..48: note = chr4:3769574-3769622
  misc_feature 1..48: note = hyper
  source 1..48: mol_type = genomic DNA
gcccggcccgctcttcaagttcttcttctggatcggctactgcaacag

SEQ ID NO: 49577 - DNA, 611 bp, Homo sapiens; identical to SEQ ID NO: 18329
  misc_feature 1..611: note = chr4:3873083-3873694
  misc_feature 1..611: note = hyper
  source 1..611: mol_type = genomic DNA

SEQ ID NO: 49578 - DNA, 154 bp, Homo sapiens; identical to SEQ ID NO: 28718
  misc_feature 1..154: note = chr4:3882096-3882250
  misc_feature 1..154: note = hyper
  source 1..154: mol_type = genomic DNA

SEQ ID NO: 49579 - DNA, 96 bp, Homo sapiens; identical to SEQ ID NO: 28719
  misc_feature 1..96: note = chr4:4145235-4145331
  misc_feature 1..96: note = hyper
  source 1..96: mol_type = genomic DNA

SEQ ID NO: 49580 - DNA, 46 bp, Homo sapiens; identical to SEQ ID NO: 28720
  misc_feature 1..46: note = chr4:4145386-4145432
  misc_feature 1..46: note = hyper
  source 1..46: mol_type = genomic DNA

SEQ ID NO: 49581 - DNA, 84 bp, Homo sapiens; identical to SEQ ID NO: 7234
  misc_feature 1..84: note = chr4:4228084-4228168
  misc_feature 1..84: note = hyper
  source 1..84: mol_type = genomic DNA

SEQ ID NO: 49582 - DNA, 34 bp, Homo sapiens; identical to SEQ ID NO: 18333
  misc_feature 1..34: note = chr4:4228241-4228275
  misc_feature 1..34: note = hyper
  source 1..34: mol_type = genomic DNA

SEQ ID NO: 49583 - DNA, 45 bp, Homo sapiens
  misc_feature 1..45: note = chr4:4229644-4229689
  misc_feature 1..45: note = hyper
  source 1..45: mol_type = genomic DNA
ctgccctgttgctaccggcgcccaagcgtcttcactagccccttc

SEQ ID NO: 49584 - DNA, 116 bp, Homo sapiens
  misc_feature 1..116: note = chr4:4229781-4229897
  misc_feature 1..116: note = hyper
  source 1..116: mol_type = genomic DNA
tgggaagtttcagctgaagagcgttctacgggtctggcgtggctgacaggaggcgccggaccccagccccccagccgcaggttggagaggggagttgggagcgagcctggggcaag

SEQ ID NO: 49585 - DNA, 73 bp, Homo sapiens
  misc_feature 1..73: note = chr4:4387460-4387533
  misc_feature 1..73: note = hyper
  source 1..73: mol_type = genomic DNA
gtcacctgtcaaagacggctagccctcctggggattttgaaatcagggcacccgcggcaagttcccaggctgt

SEQ ID NO: 49586 - DNA, 878 bp, Homo sapiens
  misc_feature 1..878: note = chr4:4387627-4388505
  misc_feature 1..878: note = hyper
  source 1..878: mol_type = genomic DNA
gccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggc

SEQ ID NO: 49587 - DNA, 505 bp, Homo sapiens; identical to SEQ ID NO: 28725
  misc_feature 1..505: note = chr4:4388506-4389011
  misc_feature 1..505: note = hyper
  source 1..505: mol_type = genomic DNA

SEQ ID NO: 49588 - DNA, 35 bp, Homo sapiens; identical to SEQ ID NO: 28726
  misc_feature 1..35: note = chr4:4389262-4389297
  misc_feature 1..35: note = hyper
  source 1..35: mol_type = genomic DNA

SEQ ID NO: 49589 - DNA, 30 bp, Homo sapiens; identical to SEQ ID NO: 28727
  misc_feature 1..30: note = chr4:4854402-4854432
  misc_feature 1..30: note = hyper
  source 1..30: mol_type = genomic DNA

SEQ ID NO: 49590 - DNA, 433 bp, Homo sapiens
  misc_feature 1..433: note = chr4:4854669-4855102
  misc_feature 1..433: note = hyper
  source 1..433: mol_type = genomic DNA
ctctcctgcctgggccgacccggcgctttactgcttctcacgaaggtgcgccggctgctccagaaatcgcagactgcctccaggaagaacttgctggagtcacagcagcttctcagcgacttgacagcagtgattcagacttcaacttgggcggaggggcgggggaggagaaagagatttccagagaaaacgactgagcggtagggaggggaagagagaccgagccacgcgcctcgagaagcagtgcagagagcggaagagacagaggctgcgagacctacccacagagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactccc

SEQ ID NO: 49591 - DNA, 21 bp, Homo sapiens
  misc_feature 1..21: note = chr4:4855171-4855192
  misc_feature 1..21: note = hyper
  source 1..21: mol_type = genomic DNA
gctgcccccgcgaaggtgggg

SEQ ID NO: 49592 - DNA, 141 bp, Homo sapiens
  misc_feature 1..141: note = chr4:4855230-4855371
  misc_feature 1..141: note = hyper
  source 1..141: mol_type = genomic DNA
cgcccctcctttccagcctcagctctggcctttctcggcatccccagcttgccttcagtttcactccatatctgggtctctcagaggcctcgggaggtcttccgttctctctgtcgccgtgtccacggaaggagcctcccc

SEQ ID NO: 49593 - DNA, 210 bp, Homo sapiens
  misc_feature 1..210: note = chr4:4855433-4855643
  misc_feature 1..210: note = hyper
  source 1..210: mol_type = genomic DNA
attgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggag

SEQ ID NO: 49594 - DNA, 171 bp, Homo sapiens; identical to SEQ ID NO: 28730
  misc_feature 1..171: note = chr4:4858696-4858867
  misc_feature 1..171: note = hyper
  source 1..171: mol_type = genomic DNA

SEQ ID NO: 49595 - DNA, 226 bp, Homo sapiens; identical to SEQ ID NO: 28731
  misc_feature 1..226: note = chr4:4861342-4861568
  misc_feature 1..226: note = hyper
  source 1..226: mol_type = genomic DNA

SEQ ID NO: 49596 - DNA, 183 bp, Homo sapiens; identical to SEQ ID NO: 28732
  misc_feature 1..183: note = chr4:4861780-4861963
  misc_feature 1..183: note = hyper
  source 1..183: mol_type = genomic DNA

SEQ ID NO: 49597 - DNA, 280 bp, Homo sapiens; identical to SEQ ID NO: 28733
  misc_feature 1..280: note = chr4:4862165-4862445
  misc_feature 1..280: note = hyper
  source 1..280: mol_type = genomic DNA

SEQ ID NO: 49598 - DNA, 107 bp, Homo sapiens; identical to SEQ ID NO: 18344
  misc_feature 1..107: note = chr4:4867591-4867698
  misc_feature 1..107: note = hyper
  source 1..107: mol_type = genomic DNA

SEQ ID NO: 49599 - DNA, 30 bp, Homo sapiens; identical to SEQ ID NO: 7247
  misc_feature 1..30: note = chr4:4868050-4868080
  misc_feature 1..30: note = hyper
  source 1..30: mol_type = genomic DNA

SEQ ID NO: 49600 - DNA, 21 bp, Homo sapiens
  misc_feature 1..21: note = chr4:4868545-4868566
  misc_feature 1..21: note = hyper
  source 1..21: mol_type = genomic DNA
ataggggcgtctcaccggccc

SEQ ID NO: 49601 - DNA, 127 bp, Homo sapiens; identical to SEQ ID NO: 2364
  misc_feature 1..127: note = chr4:4869131-4869258
  misc_feature 1..127: note = hyper
  source 1..127: mol_type = genomic DNA

SEQ ID NO: 49602 - DNA, 61 bp, Homo sapiens; identical to SEQ ID NO: 28740
  misc_feature 1..61: note = chr4:4870173-4870234
  misc_feature 1..61: note = hyper
  source 1..61: mol_type = genomic DNA

SEQ ID NO: 49603 - DNA, 44 bp, Homo sapiens; identical to SEQ ID NO: 28741
  misc_feature 1..44: note = chr4:4871340-4871384
  misc_feature 1..44: note = hyper
  source 1..44: mol_type = genomic DNA

SEQ ID NO: 49604 - DNA, 149 bp, Homo sapiens; identical to SEQ ID NO: 28742
  misc_feature 1..149: note = chr4:4871883-4872032
  misc_feature 1..149: note = hyper
  source 1..149: mol_type = genomic DNA

SEQ ID NO: 49605 - DNA, 29 bp, Homo sapiens
  misc_feature 1..29: note = chr4:4872059-4872088
  misc_feature 1..29: note = hyper
  source 1..29: mol_type = genomic DNA
cggagcatagaggcaggatggtgacctga

SEQ ID NO: 49606 - DNA, 97 bp, Homo sapiens; identical to SEQ ID NO: 28744
  misc_feature 1..97: note = chr4:4873139-4873236
  misc_feature 1..97: note = hyper
  source 1..97: mol_type = genomic DNA

SEQ ID NO: 49607 - DNA, 149 bp, Homo sapiens
  misc_feature 1..149: note = chr4:5052921-5053070
  misc_feature 1..149: note = hyper
  source 1..149: mol_type = genomic DNA
ctacctctagacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgc

SEQ ID NO: 49608 - DNA, 229 bp, Homo sapiens; identical to SEQ ID NO: 18352
  misc_feature 1..229: note = chr4:5053518-5053747
  misc_feature 1..229: note = hyper
  source 1..229: mol_type = genomic DNA

SEQ ID NO: 49609 - DNA, 12 bp, Homo sapiens
  misc_feature 1..12: note = chr4:5054093-5054105
  misc_feature 1..12: note = hyper
  source 1..12: mol_type = genomic DNA
gcaagggcctgt

SEQ ID NO: 49610 - DNA, 88 bp, Homo sapiens
  misc_feature 1..88: note = chr4:5712891-5712979
  misc_feature 1..88: note = hyper
  source 1..88: mol_type = genomic DNA
gctgaaagttttgagcggtgatccaggctcctccctccggctcggcgaagcagggaaggggagagaagcaggagtcgggagactgcac

SEQ ID NO: 49611 - DNA, 832 bp, Homo sapiens
  misc_feature 1..832: note = chr4:5889116-5889948
  misc_feature 1..832: note = hyper
  source 1..832: mol_type = genomic DNA
tgggctccagtggtccgcatccctcaggaacagtcaggctccacgctgatgccaggcaggaactggggcggagggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcgggaacattaacccttcccgggccgcagccgccagcgtcgccccattaggttatttttagctgcggggaggggtggaccgagcttccatcatggcgctgtccctaggtccggacttccactccatcagtaaaggcggggagtggggagcgctggatgatctttttccctcctccagcgggggaggtaccgggctgtggggtgcatgggccggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggcc

SEQ ID NO: 49612 - DNA, 229 bp, Homo sapiens; identical to SEQ ID NO: 18356
  misc_feature 1..229: note = chr4:5890045-5890274
  misc_feature 1..229: note = hyper
  source 1..229: mol_type = genomic DNA

SEQ ID NO: 49613 - DNA, 162 bp, Homo sapiens
  misc_feature 1..162: note = chr4:5890444-5890606
  misc_feature 1..162: note = hyper
  source 1..162: mol_type = genomic DNA
atggttttcagggctcctttaaaagaaaaagacggcgcggtcagggcccgcgggcggcgccacaggtgtgtggccgcgcgtctggaggcctccccggaacatctgcgggggtgtggggggagggagtgtgggacgggggccaaggatcggcccaagctgctg

SEQ ID NO: 49614 - DNA, 35 bp, Homo sapiens
  misc_feature 1..35: note = chr4:5892194-5892229
  misc_feature 1..35: note = hyper
  source 1..35: mol_type = genomic DNA
gtgaggcccgccccggaacccgagcccactgtaac

SEQ ID NO: 49615 - DNA, 30 bp, Homo sapiens; identical to SEQ ID NO: 28751
  misc_feature 1..30: note = chr4:5892597-5892627
  misc_feature 1..30: note = hyper
  source 1..30: mol_type = genomic DNA

SEQ ID NO: 49616 - DNA, 237 bp, Homo sapiens; identical to SEQ ID NO: 28752
  misc_feature 1..237: note = chr4:5893517-5893754
  misc_feature 1..237: note = hyper
  source 1..237: mol_type = genomic DNA

SEQ ID NO: 49617 - DNA, 300 bp, Homo sapiens; identical to SEQ ID NO: 28754
  misc_feature 1..300: note = chr4:5894812-5895112
  misc_feature 1..300: note = hyper
  source 1..300: mol_type = genomic DNA

SEQ ID NO: 49618 - DNA, 69 bp, Homo sapiens
  misc_feature 1..69: note = chr4:6200828-6200897
  misc_feature 1..69: note = hyper
  source 1..69: mol_type = genomic DNA
cagctgaagttagggcgttcgcggagagagcacagcactggcaaaggccaaggacagtgtgcctgcgag

SEQ ID NO: 49619 - DNA, 58 bp, Homo sapiens; identical to SEQ ID NO: 18361
  misc_feature 1..58: note = chr4:6201235-6201293
  misc_feature 1..58: note = hyper
  source 1..58: mol_type = genomic DNA

SEQ ID NO: 49620 - DNA, 299 bp, Homo sapiens; identical to SEQ ID NO: 28756
  misc_feature 1..299: note = chr4:6201349-6201648
  misc_feature 1..299: note = hyper
  source 1..299: mol_type = genomic DNA

SEQ ID NO: 49621 - DNA, 208 bp, Homo sapiens; identical to SEQ ID NO: 18363
  misc_feature 1..208: note = chr4:6201895-6202103
  misc_feature 1..208: note = hyper
  source 1..208: mol_type = genomic DNA

SEQ ID NO: 49622 - DNA, 382 bp, Homo sapiens
  misc_feature 1..382: note = chr4:6202276-6202658
  misc_feature 1..382: note = hyper
  source 1..382: mol_type = genomic DNA
gcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggg

SEQ ID NO: 49623 - DNA, 73 bp, Homo sapiens; identical to SEQ ID NO: 28758
  misc_feature 1..73: note = chr4:6223724-6223797
  misc_feature 1..73: note = hyper
  source 1..73: mol_type = genomic DNA

SEQ ID NO: 49624 - DNA, 35 bp, Homo sapiens; identical to SEQ ID NO: 28759
  misc_feature 1..35: note = chr4:6224121-6224156
  misc_feature 1..35: note = hyper
  source 1..35: mol_type = genomic DNA

SEQ ID NO: 49625 - DNA, 152 bp, Homo sapiens
  misc_feature 1..152: note = chr4:6247199-6247351
  misc_feature 1..152: note = hyper
  source 1..152: mol_type = genomic DNA
ctcgggtgtgggggtcgcccgcgctcctgggagccgagcaagggcgcgcaccccgcagtgggagaggggcttcctgcgcagcgcgggaggagcttccaggacgggagctgtctggggcagagccctggctacggtggcctcgcagcacagcg

SEQ ID NO: 49626 - DNA, 336 bp, Homo sapiens; identical to SEQ ID NO: 18365
  misc_feature 1..336: note = chr4:6247381-6247717
  misc_feature 1..336: note = hyper
  source 1..336: mol_type = genomic DNA

SEQ ID NO: 49627 - DNA, 30 bp, Homo sapiens; identical to SEQ ID NO: 28761
  misc_feature 1..30: note = chr4:6472398-6472428
  misc_feature 1..30: note = hyper
  source 1..30: mol_type = genomic DNA

SEQ ID NO: 49628 - DNA, 100 bp, Homo sapiens; identical to SEQ ID NO: 28762
  misc_feature 1..100: note = chr4:6472882-6472982
  misc_feature 1..100: note = hyper
  source 1..100: mol_type = genomic DNA

SEQ ID NO: 49629 - DNA, 172 bp, Homo sapiens; identical to SEQ ID NO: 28763
  misc_feature 1..172: note = chr4:6473792-6473964
  misc_feature 1..172: note = hyper
  source 1..172: mol_type = genomic DNA

SEQ ID NO: 49630 - DNA, 277 bp, Homo sapiens; identical to SEQ ID NO: 7269
  misc_feature 1..277: note = chr4:6473965-6474242
  misc_feature 1..277: note = hyper
  source 1..277: mol_type = genomic DNA

SEQ ID NO: 49631 - DNA, 40 bp, Homo sapiens; identical to SEQ ID NO: 28765
  misc_feature 1..40: note = chr4:6474447-6474487
  misc_feature 1..40: note = hyper
  source 1..40: mol_type = genomic DNA

SEQ ID NO: 49632 - DNA, 136 bp, Homo sapiens; identical to SEQ ID NO: 28766
  misc_feature 1..136: note = chr4:6564642-6564778
  misc_feature 1..136: note = hyper
  source 1..136: mol_type = genomic DNA

SEQ ID NO: 49633 - DNA, 59 bp, Homo sapiens
  misc_feature 1..59: note = chr4:6565042-6565101
  misc_feature 1..59: note = hyper
  source 1..59: mol_type = genomic DNA
ccccggcacttcggaccctagcagagccagccctgccccaggaccgccccggggtcggt

SEQ ID NO: 49634 - DNA, 161 bp, Homo sapiens; identical to SEQ ID NO: 28768
  misc_feature 1..161: note = chr4:7194377-7194538
  misc_feature 1..161: note = hyper
  source 1..161: mol_type = genomic DNA

SEQ ID NO: 49635 - DNA, 93 bp, Homo sapiens; identical to SEQ ID NO: 28769
  misc_feature 1..93: note = chr4:7194789-7194882
  misc_feature 1..93: note = hyper
  source 1..93: mol_type = genomic DNA

SEQ ID NO: 49636 - DNA, 30 bp, Homo sapiens; identical to SEQ ID NO: 7272
  misc_feature 1..30: note = chr4:7195153-7195183
  misc_feature 1..30: note = hyper
  source 1..30: mol_type = genomic DNA

SEQ ID NO: 49637 - DNA, 30 bp, Homo sapiens; identical to SEQ ID NO: 28771
  misc_feature 1..30: note = chr4:7195419-7195449
  misc_feature 1..30: note = hyper
  source 1..30: mol_type = genomic DNA

SEQ ID NO: 49638 - DNA, 290 bp, Homo sapiens; identical to SEQ ID NO: 28772
  misc_feature 1..290: note = chr4:8201139-8201429
  misc_feature 1..290: note = hyper
  source 1..290: mol_type = genomic DNA

SEQ ID NO: 49639 - DNA, 289 bp, Homo sapiens; identical to SEQ ID NO: 28773
  misc_feature 1..289: note = chr4:8271325-8271614
  misc_feature 1..289: note = hyper
  source 1..289: mol_type = genomic DNA

SEQ ID NO: 49640 - DNA, 70 bp, Homo sapiens; identical to SEQ ID NO: 28774
  misc_feature 1..70: note = chr4:8582115-8582185
  misc_feature 1..70: note = hyper
  source 1..70: mol_type = genomic DNA

SEQ ID NO: 49641 - DNA, 39 bp, Homo sapiens; identical to SEQ ID NO: 28775
  misc_feature 1..39: note = chr4:8594420-8594459
  misc_feature 1..39: note = hyper
  source 1..39: mol_type = genomic DNA

SEQ ID NO: 49642 - DNA, 137 bp, Homo sapiens; identical to SEQ ID NO: 28776
  misc_feature 1..137: note = chr4:8690019-8690156
  misc_feature 1..137: note = hyper
  source 1..137: mol_type = genomic DNA

SEQ ID NO: 49643 - DNA, 33 bp, Homo sapiens
  misc_feature 1..33: note = chr4:8858794-8858827
  misc_feature 1..33: note = hyper
  source 1..33: mol_type = genomic DNA
gcggaccatctcaataacaaaccgaaactctgg

SEQ ID NO: 49644 - DNA, 200 bp, Homo sapiens; identical to SEQ ID NO: 18373
  misc_feature 1..200: note = chr4:8859738-8859938
  misc_feature 1..200: note = hyper
  source 1..200: mol_type = genomic DNA

SEQ ID NO: 49645 - DNA, 98 bp, Homo sapiens; identical to SEQ ID NO: 28780
  misc_feature 1..98: note = chr4:8861448-8861546
  misc_feature 1..98: note = hyper
  source 1..98: mol_type = genomic DNA

SEQ ID NO: 49646 - DNA, 44 bp, Homo sapiens
  misc_feature 1..44: note = chr4:8861605-8861649
  misc_feature 1..44: note = hyper
  source 1..44: mol_type = genomic DNA
cgggcagtggcccacggctctgggcccggatctgtgtccacctc

SEQ ID NO: 49647 - DNA, 169 bp, Homo sapiens
  misc_feature 1..169: note = chr4:8862014-8862183
  misc_feature 1..169: note = hyper
  source 1..169: mol_type = genomic DNA
gggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaaga

SEQ ID NO: 49648 - DNA, 404 bp, Homo sapiens
  misc_feature 1..404: note = chr4:8862393-8862797
  misc_feature 1..404: note = hyper
  source 1..404: mol_type = genomic DNA
ctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcg

SEQ ID NO: 49649 - DNA, 111 bp, Homo sapiens
  misc_feature 1..111: note = chr4:8863330-8863441
  misc_feature 1..111: note = hyper
  source 1..111: mol_type = genomic DNA
ggagccccgggggcacggccgaggctgcgcttcaggagtgtccgccaggcgccttcccgggcggttggcgaaacccgaggaggcccacagctctggcctggggcgccgtcg

SEQ ID NO: 49650 - DNA, 79 bp, Homo sapiens; identical to SEQ ID NO: 28785
  misc_feature 1..79: note = chr4:8863856-8863935
  misc_feature 1..79: note = hyper
  source 1..79: mol_type = genomic DNA

SEQ ID NO: 49651 - DNA, 18 bp, Homo sapiens
  misc_feature 1..18: note = chr4:8864598-8864616
  misc_feature 1..18: note = hyper
  source 1..18: mol_type = genomic DNA
ttccgtgcatgacacgca

SEQ ID NO: 49652 - DNA, 62 bp, Homo sapiens
  misc_feature 1..62: note = chr4:8865058-8865120
  misc_feature 1..62: note = hyper
  source 1..62: mol_type = genomic DNA
ggagaggcactgacagaaagggaaagagaagcccacccggcctctcccgcctccctggtgct

SEQ ID NO: 49653 - DNA, 112 bp, Homo sapiens
  misc_feature 1..112: note = chr4:8868710-8868822
  misc_feature 1..112: note = hyper
  source 1..112: mol_type = genomic DNA
agggacggcacccagcgcagcttgagctgtctctgccctcgtgatcacaaagcagtgaaactgtccagaaaatgtccctttttattccatacgcaaataagtagattcattt

SEQ ID NO: 49654 - DNA, 233 bp, Homo sapiens; identical to SEQ ID NO: 18377
  misc_feature 1..233: note = chr4:8869368-8869601
  misc_feature 1..233: note = hyper
  source 1..233: mol_type = genomic DNA

SEQ ID NO: 49655 - DNA, 32 bp, Homo sapiens
  misc_feature 1..32: note = chr4:8869813-8869845
  misc_feature 1..32: note = hyper
  source 1..32: mol_type = genomic DNA
gctggaagacctggctgcgggagaagactgtg

SEQ ID NO: 49656 - DNA, 30 bp, Homo sapiens; identical to SEQ ID NO: 28791
  misc_feature 1..30: note = chr4:8870046-8870076
  misc_feature 1..30: note = hyper
  source 1..30: mol_type = genomic DNA

SEQ ID NO: 49657 - DNA, 330 bp, Homo sapiens
  misc_feature 1..330: note = chr4:8872724-8873054
  misc_feature 1..330: note = hyper
  source 1..330: mol_type = genomic DNA
cctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgag

SEQ ID NO: 49658 - DNA, 36 bp, Homo sapiens; identical to SEQ ID NO: 18379
  misc_feature 1..36: note = chr4:8873773-8873809
  misc_feature 1..36: note = hyper
  source 1..36: mol_type = genomic DNA

SEQ ID NO: 49659 - skipped

SEQ ID NO: 49660 - DNA, 121 bp, Homo sapiens
  misc_feature 1..121: note = chr4:8875756-8875877
  misc_feature 1..121: note = hyper
  source 1..121: mol_type = genomic DNA
ctggccaccaccaggcgggtggtggccctgagcgcataacgctcgcgggtgtcttcccactgcctctggggggcgcgcatgagaggggcgcttccacacactgccgcgtggggcctgggat

SEQ ID NO: 49661 - DNA, 21 bp, Homo sapiens
  misc_feature 1..21: note = chr4:8875907-8875928
  misc_feature 1..21: note = hyper
  source 1..21: mol_type = genomic DNA
gaggaccgtgcacccttttcc

SEQ ID NO: 49662 - DNA, 128 bp, Homo sapiens; identical to SEQ ID NO: 28796
  misc_feature 1..128: note = chr4:8878547-8878675
  misc_feature 1..128: note = hyper
  source 1..128: mol_type = genomic DNA

SEQ ID NO: 49663 - DNA, 103 bp, Homo sapiens; identical to SEQ ID NO: 28797
  misc_feature 1..103: note = chr4:8879491-8879594
  misc_feature 1..103: note = hyper
  source 1..103: mol_type = genomic DNA

SEQ ID NO: 49664 - DNA, 61 bp, Homo sapiens; identical to SEQ ID NO: 28798
  misc_feature 1..61: note = chr4:8893403-8893464
  misc_feature 1..61: note = hyper
  source 1..61: mol_type = genomic DNA

SEQ ID NO: 49665 - DNA, 100 bp, Homo sapiens
  misc_feature 1..100: note = chr4:8893931-8894031
  misc_feature 1..100: note = hyper
  source 1..100: mol_type = genomic DNA
cattttatggaggaagactgaggctttgggttgcatgggacccgcggttaccccgcaaacacagacgcttacgaagacgctatcgcgagccgaacagtct

SEQ ID NO: 49666 - DNA, 204 bp, Homo sapiens
  misc_feature 1..204: note = chr4:8895350-8895554
  misc_feature 1..204: note = hyper
  source 1..204: mol_type = genomic DNA
ctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctgg

SEQ ID NO: 49667 - DNA, 46 bp, Homo sapiens; identical to SEQ ID NO: 18385
  misc_feature 1..46: note = chr4:8896052-8896098
  misc_feature 1..46: note = hyper
  source 1..46: mol_type = genomic DNA

SEQ ID NO: 49668 - DNA, 205 bp, Homo sapiens; identical to SEQ ID NO: 2376
  misc_feature 1..205: note = chr4:8896117-8896322
  misc_feature 1..205: note = hyper
  source 1..205: mol_type = genomic DNA

SEQ ID NO: 49669 - DNA, 40 bp, Homo sapiens; identical to SEQ ID NO: 28804
  misc_feature 1..40: note = chr4:9499335-9499375
  misc_feature 1..40: note = hyper
  source 1..40: mol_type = genomic DNA

SEQ ID NO: 49670 - DNA, 113 bp, Homo sapiens; identical to SEQ ID NO: 28805
  misc_feature 1..113: note = chr4:9499921-9500034
  misc_feature 1..113: note = hyper
  source 1..113: mol_type = genomic DNA

SEQ ID NO: 49671 - DNA, 17 bp, Homo sapiens
  misc_feature 1..17: note = chr4:10458378-10458395
  misc_feature 1..17: note = hyper
  source 1..17: mol_type = genomic DNA
aaccaaaaccgtcaacg

SEQ ID NO: 49672 - DNA, 130 bp, Homo sapiens
  misc_feature 1..130: note = chr4:10459121-10459251
  misc_feature 1..130: note = hyper
  source 1..130: mol_type = genomic DNA
aggctgcgcccgcccccgccgggcttctaagctgtccagagcggggagcctcagacccagccgagccccacttctgggcttagagcttgacccaacacgttcgcaccgtagcgagcgaggtccacattta

SEQ ID NO: 49673 - DNA, 58 bp, Homo sapiens; identical to SEQ ID NO: 18387
  misc_feature 1..58: note = chr4:10462775-10462833
  misc_feature 1..58: note = hyper
  source 1..58: mol_type = genomic DNA

SEQ ID NO: 49674 - DNA, 70 bp, Homo sapiens
  misc_feature 1..70: note = chr4:11429633-11429703
  misc_feature 1..70: note = hyper
  source 1..70: mol_type = genomic DNA
ccatccctcacctccatccgctgccactacccaagggcccggaaatagaaaaccacgaagggggaaaaaa

SEQ ID NO: 49675 - DNA, 78 bp, Homo sapiens
  misc_feature 1..78: note = chr4:13523948-13524026
  misc_feature 1..78: note = hyper
  source 1..78: mol_type = genomic DNA
tccctaccttcctcccgagggagaggcagagcctctagctccatttcagacctgcaaggaaagggctttgagaaggga

SEQ ID NO: 49676 - DNA, 37 bp, Homo sapiens; identical to SEQ ID NO: 28814
  misc_feature 1..37: note = chr4:13529606-13529643
  misc_feature 1..37: note = hyper
  source 1..37: mol_type = genomic DNA

SEQ ID NO: 49677 - DNA, 68 bp, Homo sapiens; identical to SEQ ID NO: 28815
  misc_feature 1..68: note = chr4:13530912-13530980
  misc_feature 1..68: note = hyper
  source 1..68: mol_type = genomic DNA

SEQ ID NO: 49678 - DNA, 54 bp, Homo sapiens; identical to SEQ ID NO: 18390
  misc_feature 1..54: note = chr4:13537688-13537742
  misc_feature 1..54: note = hyper
  source 1..54: mol_type = genomic DNA

SEQ ID NO: 49679 - DNA, 30 bp, Homo sapiens; identical to SEQ ID NO: 28817
  misc_feature 1..30: note = chr4:13539344-13539374
  misc_feature 1..30: note = hyper
  source 1..30: mol_type = genomic DNA

SEQ ID NO: 49680 - DNA, 43 bp, Homo sapiens; identical to SEQ ID NO: 28818
  misc_feature 1..43: note = chr4:13541880-13541923
  misc_feature 1..43: note = hyper
  source 1..43: mol_type = genomic DNA

SEQ ID NO: 49681 - DNA, 86 bp, Homo sapiens
  misc_feature 1..86: note = chr4:13545940-13546026
  misc_feature 1..86: note = hyper
  source 1..86: mol_type = genomic DNA
cgcccctctggcgcggccagcccgccgcgctcctctttcttgttgaggatcgcctggatggagaaggacgtcaaggtgttggcgcc

SEQ ID NO: 49682 - DNA, 240 bp, Homo sapiens; identical to SEQ ID NO: 28820
  misc_feature 1..240: note = chr4:13546362-13546602
  misc_feature 1..240: note = hyper
  source 1..240: mol_type = genomic DNA

SEQ ID NO: 49683 - DNA, 445 bp, Homo sapiens
  misc_feature 1..445: note = chr4:13548895-13549340
  misc_feature 1..445: note = hyper
  source 1..445: mol_type = genomic DNA
ctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcggg

SEQ ID NO: 49684 - DNA, 125 bp, Homo sapiens
  misc_feature 1..125: note = chr4:13549510-13549635
  misc_feature 1..125: note = hyper
  source 1..125: mol_type = genomic DNA
gcccgccacctgtgccctgggccgccttccctgacgccagcggccggaggtcgcgcgcgccgggtgctgcccagcaacgaaaggccatgcggggttcgtccctcagatgccggtgaccttgattg

SEQ ID NO: 49685 - DNA, 179 bp, Homo sapiens
  misc_feature 1..179: note = chr4:15780044-15780223
  misc_feature 1..179: note = hyper
  source 1..179: mol_type = genomic DNA
actgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagacc

SEQ ID NO: 49686 - DNA, 240 bp, Homo sapiens
  misc_feature 1..240: note = chr4:15780320-15780560
  misc_feature 1..240: note = hyper
  source 1..240: mol_type = genomic DNA
cccgcgcgcagggaagccgcccggatcgcccggaaccgggcatcttccgtggcgggtcagccgagagcccgccgggtggtgctgagtagggagtcccgggctcggggctccgcgggccgctttcaggagcagctggccttggcaccgagcgtgcccgcgggaggcgggggggggcgctgctcggtggctctgctgcgtagccggtgaacacttggcaccgatgcccgccttctgggcaag

SEQ ID NO: 49687 - DNA, 48 bp, Homo sapiens; identical to SEQ ID NO: 28824
  misc_feature 1..48: note = chr4:16083930-16083978
  misc_feature 1..48: note = hyper
  source 1..48: mol_type = genomic DNA

SEQ ID NO: 49688 - DNA, 60 bp, Homo sapiens; identical to SEQ ID NO: 7312
  misc_feature 1..60: note = chr4:16084408-16084468
  misc_feature 1..60: note = hyper
  source 1..60: mol_type = genomic DNA

SEQ ID NO: 49689 - DNA, 221 bp, Homo sapiens
  misc_feature 1..221: note = chr4:16085381-16085602
  misc_feature 1..221: note = hyper
  source 1..221: mol_type = genomic DNA
acccggcttctgggaccaccgcgacggctttcggagagcccgcctcccactgccggccgcggaggggctcaggcggcgctgcggccggaccctcggacgtggcgggaggcaggagaaaggcccgggtgcccggggggacccgttgcggcttcctctgtcccggacggggacctaggtatggggccgccgtaatggaaaggattccttaaacatactcaccg

SEQ ID NO: 49690 - DNA, 18 bp, Homo sapiens
  misc_feature 1..18: note = chr4:16085682-16085700
  misc_feature 1..18: note = hyper
  source 1..18: mol_type = genomic DNA
ggacgcactctgattgga

SEQ ID NO: 49691 - DNA, 30 bp, Homo sapiens; identical to SEQ ID NO: 28831
  misc_feature 1..30: note = chr4:17326218-17326248
  misc_feature 1..30: note = hyper
  source 1..30: mol_type = genomic DNA

SEQ ID NO: 49692 - DNA, 65 bp, Homo sapiens
  misc_feature 1..65: note = chr4:17782938-17783003
  misc_feature 1..65: note = hyper
  source 1..65: mol_type = genomic DNA
gcactcagactctctcgttttctccctgcccaccgtgtgcacgtgcgtgcgcgcgcgggcgtgcg

SEQ ID NO: 49693 - DNA, 275 bp, Homo sapiens; identical to SEQ ID NO: 28835
  misc_feature 1..275: note = chr4:20253687-20253962
  misc_feature 1..275: note = hyper
  source 1..275: mol_type = genomic DNA

SEQ ID NO: 49694 - DNA, 84 bp, Homo sapiens; identical to SEQ ID NO: 28836
  misc_feature 1..84: note = chr4:20254239-20254323
  misc_feature 1..84: note = hyper
  source 1..84: mol_type = genomic DNA

SEQ ID NO: 49695 - DNA, 27 bp, Homo sapiens
  misc_feature 1..27: note = chr4:20254723-20254750
  misc_feature 1..27: note = hyper
  source 1..27: mol_type = genomic DNA
tttgtaaaccatcgttggctgtcggga

SEQ ID NO: 49696 - DNA, 51 bp, Homo sapiens; identical to SEQ ID NO: 7323
  misc_feature 1..51: note = chr4:20255045-20255096
  misc_feature 1..51: note = hyper
  source 1..51: mol_type = genomic DNA

SEQ ID NO: 49697 - DNA, 38 bp, Homo sapiens; identical to SEQ ID NO: 28839
  misc_feature 1..38: note = chr4:20255330-20255368
  misc_feature 1..38: note = hyper
  source 1..38: mol_type = genomic DNA

SEQ ID NO: 49698 - DNA, 291 bp, Homo sapiens; identical to SEQ ID NO: 18404
  misc_feature 1..291: note = chr4:20255861-20256152
  misc_feature 1..291: note = hyper
  source 1..291: mol_type = genomic DNA

SEQ ID NO: 49699 - DNA, 15 bp, Homo sapiens
  misc_feature 1..15: note = chr4:20256562-20256577
  misc_feature 1..15: note = hyper
  source 1..15: mol_type = genomic DNA
aagtaaatgcagacc

SEQ ID NO: 49700 - DNA, 62 bp, Homo sapiens; identical to SEQ ID NO: 28842
  misc_feature 1..62: note = chr4:20256841-20256903
  misc_feature 1..62: note = hyper
  source 1..62: mol_type = genomic DNA

SEQ ID NO: 49701 - DNA, 32 bp, Homo sapiens; identical to SEQ ID NO: 28843
  misc_feature 1..32: note = chr4:21950123-21950155
  misc_feature 1..32: note = hyper
  source 1..32: mol_type = genomic DNA

SEQ ID NO: 49702 - DNA, 92 bp, Homo sapiens
  misc_feature 1..92: note = chr4:21950156-21950248
  misc_feature 1..92: note = hyper
  source 1..92: mol_type = genomic DNA
gaagcgggcgcccgctcgcaagcttattgcatcctaccgcctgtagagctggcctcctccagctgagccgaaatgctttccaccctcctcac

SEQ ID NO: 49703 - DNA, 40 bp, Homo sapiens; identical to SEQ ID NO: 28845
  misc_feature 1..40: note = chr4:21950838-21950878
  misc_feature 1..40: note = hyper
  source 1..40: mol_type = genomic DNA

SEQ ID NO: 49704 - DNA, 90 bp, Homo sapiens; identical to SEQ ID NO: 28846
  misc_feature 1..90: note = chr4:24473588-24473678
  misc_feature 1..90: note = hyper
  source 1..90: mol_type = genomic DNA

SEQ ID NO: 49705 - DNA, 232 bp, Homo sapiens
  misc_feature 1..232: note = chr4:24914406-24914638
  misc_feature 1..232: note = hyper
  source 1..232: mol_type = genomic DNA
cccatcccgcctggccggcgccgcggcctcacctcgctcaccagcccctgccagtcgctctcagtccggtcgccgttcatggcctcctcctccatgcgctggccggcctcctggacccccgccgcctcctcctcctcgcgacgtcgcgtcgccgccgccgcccgggccccgcgcggccccgagagggcccggcgcctccgagccgctgcgccgccgcctctcgcggccgcca

SEQ ID NO: 49706 - DNA, 235 bp, Homo sapiens; identical to SEQ ID NO: 28849
  misc_feature 1..235: note = chr4:25657130-25657365
  misc_feature 1..235: note = hyper
  source 1..235: mol_type = genomic DNA

SEQ ID NO: 49707 - DNA, 48 bp, Homo sapiens; identical to SEQ ID NO: 28850
  misc_feature 1..48: note = chr4:25657366-25657414
  misc_feature 1..48: note = hyper
  source 1..48: mol_type = genomic DNA

SEQ ID NO: 49708 - DNA, 22 bp, Homo sapiens
  misc_feature 1..22: note = chr4:25657415-25657437
  misc_feature 1..22: note = hyper
  source 1..22: mol_type = genomic DNA
gccagcctctttgcgcaacacc

SEQ ID NO: 49709 - DNA, 137 bp, Homo sapiens; identical to SEQ ID NO: 28852
  misc_feature 1..137: note = chr4:26030429-26030566
  misc_feature 1..137: note = hyper
  source 1..137: mol_type = genomic DNA

SEQ ID NO: 49710 - DNA, 15 bp, Homo sapiens
  misc_feature 1..15: note = chr4:26030635-26030650
  misc_feature 1..15: note = hyper
  source 1..15: mol_type = genomic DNA
cgtcccaggggacct

SEQ ID NO: 49711 - DNA, 250 bp, Homo sapiens; identical to SEQ ID NO: 28855
  misc_feature 1..250: note = chr4:30719374-30719624
  misc_feature 1..250: note = hyper
  source 1..250: mol_type = genomic DNA

SEQ ID NO: 49712 - DNA, 43 bp, Homo sapiens; identical to SEQ ID NO: 28856
  misc_feature 1..43: note = chr4:30719991-30720034
  misc_feature 1..43: note = hyper
  source 1..43: mol_type = genomic DNA

SEQ ID NO: 49713 - DNA, 367 bp, Homo sapiens; identical to SEQ ID NO: 28857
  misc_feature 1..367: note = chr4:30720054-30720421
  misc_feature 1..367: note = hyper
  source 1..367: mol_type = genomic DNA

SEQ ID NO: 49714 - DNA, 34 bp, Homo sapiens; identical to SEQ ID NO: 28858
  misc_feature 1..34: note = chr4:30720861-30720895
  misc_feature 1..34: note = hyper
  source 1..34: mol_type = genomic DNA

SEQ ID NO: 49715 - DNA, 30 bp, Homo sapiens; identical to SEQ ID NO: 28859
  misc_feature 1..30: note = chr4:30721247-30721277
  misc_feature 1..30: note = hyper
  source 1..30: mol_type = genomic DNA

SEQ ID NO: 49716 - DNA, 30 bp, Homo sapiens; identical to SEQ ID NO: 28860
  misc_feature 1..30: note = chr4:30722839-30722869
  misc_feature 1..30: note = hyper
  source 1..30: mol_type = genomic DNA

SEQ ID NO: 49717 - DNA, 21 bp, Homo sapiens
  misc_feature 1..21: note = chr4:30724228-30724249
  misc_feature 1..21: note = hyper
  source 1..21: mol_type = genomic DNA
gaccgacaaggccaccgtggt

SEQ ID NO: 49718 - DNA, 81 bp, Homo sapiens; identical to SEQ ID NO: 18407
  misc_feature 1..81: note = chr4:30724372-30724453
  misc_feature 1..81: note = hyper
  source 1..81: mol_type = genomic DNA

SEQ ID NO: 49719 - DNA, 45 bp, Homo sapiens; identical to SEQ ID NO: 2391
  misc_feature 1..45: note = chr4:37245537-37245582
  misc_feature 1..45: note = hyper
  source 1..45: mol_type = genomic DNA

SEQ ID NO: 49720 - DNA, 283 bp, Homo sapiens; identical to SEQ ID NO: 18409
  misc_feature 1..283: note = chr4:37245851-37246134
  misc_feature 1..283: note = hyper
  source 1..283: mol_type = genomic DNA

SEQ ID NO: 49721 - DNA, 81 bp, Homo sapiens; identical to SEQ ID NO: 18410
  misc_feature 1..81: note = chr4:37247015-37247096
  misc_feature 1..81: note = hyper
  source 1..81: mol_type = genomic DNA

SEQ ID NO: 49722 - DNA, 22 bp, Homo sapiens
  misc_feature 1..22: note = chr4:37247216-37247238
  misc_feature 1..22: note = hyper
  source 1..22: mol_type = genomic DNA
cacaaacagtagctctcctccc

SEQ ID NO: 49723 - DNA, 138 bp, Homo sapiens; identical to SEQ ID NO: 28866
  misc_feature 1..138: note = chr4:37247293-37247431
  misc_feature 1..138: note = hyper
  source 1..138: mol_type = genomic DNA

SEQ ID NO: 49724 - DNA, 116 bp, Homo sapiens; identical to SEQ ID NO: 28867
  misc_feature 1..116: note = chr4:39047287-39047403
  misc_feature 1..116: note = hyper
  source 1..116: mol_type = genomic DNA

SEQ ID NO: 49725 - DNA, 674 bp, Homo sapiens
  misc_feature 1..674: note = chr4:41259176-41259850
  misc_feature 1..674: note = hyper
  source 1..674: mol_type = genomic DNA
cccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgt

SEQ ID NO: 49726 - DNA, 208 bp, Homo sapiens; identical to SEQ ID NO: 28870
  misc_feature 1..208: note = chr4:41362555-41362763
  misc_feature 1..208: note = hyper
  source 1..208: mol_type = genomic DNA

SEQ ID NO: 49727 - DNA, 157 bp, Homo sapiens; identical to SEQ ID NO: 28871
  misc_feature 1..157: note = chr4:41362780-41362937
  misc_feature 1..157: note = hyper
  source 1..157: mol_type = genomic DNA

SEQ ID NO: 49728 - DNA, 185 bp, Homo sapiens
  misc_feature 1..185: note = chr4:41746824-41747009
  misc_feature 1..185: note = hyper
  source 1..185: mol_type = genomic DNA
agaagaaaatgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatgg

SEQ ID NO: 49729 - DNA, 103 bp, Homo sapiens; identical to SEQ ID NO: 18415
  misc_feature 1..103: note = chr4:41747133-41747236
  misc_feature 1..103: note = hyper
  source 1..103: mol_type = genomic DNA

SEQ ID NO: 49730 - DNA, 48 bp, Homo sapiens
  misc_feature 1..48: note = chr4:41747445-41747493
  misc_feature 1..48: note = hyper
  source 1..48: mol_type = genomic DNA
cagacacacattccccgagacagacacaaactgacacgcagacacagc

SEQ ID NO: 49731 - DNA, 187 bp, Homo sapiens
  misc_feature 1..187: note = chr4:41747582-41747769
  misc_feature 1..187: note = hyper
  source 1..187: mol_type = genomic DNA
gtgcgaagccagggaagtttgtttgttttgtttgggggttgaggaagggggtaggagtggggttgaaatgagggcgacgccgttttccctttattcttagcgcgattactttaggccctcaatgaaaaagccatggcagcagcgacgacaatagccttgggcctacccgctcgcccactcgcccgcc

SEQ ID NO: 49732 - DNA, 70 bp, Homo sapiens; identical to SEQ ID NO: 18416
  misc_feature 1..70: note = chr4:41747888-41747958
  misc_feature 1..70: note = hyper
  source 1..70: mol_type = genomic DNA

SEQ ID NO: 49733 - DNA, 364 bp, Homo sapiens
  misc_feature 1..364: note = chr4:41748296-41748660
  misc_feature 1..364: note = hyper
  source 1..364: mol_type = genomic DNA
gctcctgcttgcgaaacttggcgcggcggttctggaaccacacctggcccaagacggaaggagagacggtgaagcagggggagaaagaagaaaatgggaaagaaaagcaccggttagggtggcccaagttctacttcggcttgttttaacaccctcctccccatgcgctgtgatcacccccgcgcgcacatccaccaagtctaccgcttcttattgctgtgcattttcggagaaactttcttagggggagtgagcacgccagggacatgaaggcttgcggcagagtttaaaaagccgcaggtcccagaaagacccgaaaagggaaggccttattttggtgggcctctgttcagtcggcttcttg

SEQ ID NO: 49734 - DNA, 121 bp, Homo sapiens
  misc_feature 1..121: note = chr4:41750102-41750223
  misc_feature 1..121: note = hyper
  source 1..121: mol_type = genomic DNA
attttctaagctttacgtctcatcgcaaagtaaataaattatgcctatcattttggcagcttaagataattttgttggcggttcgggtgtgactaggatagtgtaaccctgtaagtgaatt

SEQ ID NO: 49735 - DNA, 95 bp, Homo sapiens; identical to SEQ ID NO: 18418
  misc_feature 1..95: note = chr4:41750504-41750599
  misc_feature 1..95: note = hyper
  source 1..95: mol_type = genomic DNA

SEQ ID NO: 49736 - DNA, 30 bp, Homo sapiens; identical to SEQ ID NO: 28878
  misc_feature 1..30: note = chr4:41751372-41751402
  misc_feature 1..30: note = hyper
  source 1..30: mol_type = genomic DNA

SEQ ID NO: 49737 - DNA, 151 bp, Homo sapiens
  misc_feature 1..151: note = chr4:41751719-41751870
  misc_feature 1..151: note = hyper
  source 1..151: mol_type = genomic DNA
ctctttcatctctttcgggcgctctccctctttctcgcctctttttttttttcaggtgcccacaatcctccacagacccggggattgtgtctgtttgccttttaggtttgcggactgtagtgagggaaattcttgccatgtaaatgcccag

SEQ ID NO: 49738 - DNA, 10 bp, Homo sapiens
  misc_feature 1..10: note = chr4:41752441-41752451
  misc_feature 1..10: note = hyper
  source 1..10: mol_type = genomic DNA
tgcaaatcct

SEQ ID NO: 49739 - DNA, 14 bp, Homo sapiens
  misc_feature 1..14: note = chr4:41752954-41752968
  misc_feature 1..14: note = hyper
  source 1..14: mol_type = genomic DNA
gcacaaggctgaga

SEQ ID NO: 49740 - DNA, 212 bp, Homo sapiens; identical to SEQ ID NO: 18420
  misc_feature 1..212: note = chr4:41753398-41753610
  misc_feature 1..212: note = hyper
  source 1..212: mol_type = genomic DNA

SEQ ID NO: 49741 - DNA, 224 bp, Homo sapiens; identical to SEQ ID NO: 28885
  misc_feature 1..224: note = chr4:41867612-41867836
  misc_feature 1..224: note = hyper
  source 1..224: mol_type = genomic DNA

SEQ ID NO: 49742 - DNA, 20 bp, Homo sapiens
  misc_feature 1..20: note = chr4:41875410-41875430
  misc_feature 1..20: note = hyper
  source 1..20: mol_type = genomic DNA
aaccttttttgtaaccggct

SEQ ID NO: 49743 - DNA, 42 bp, Homo sapiens
  misc_feature 1..42: note = chr4:41881343-41881385
  misc_feature 1..42: note = hyper
  source 1..42: mol_type = genomic DNA
ccacgcgcccccatccgaggggacctcacccctgggaagact

SEQ ID NO: 49744 - skipped

SEQ ID NO: 49745 - DNA, 30 bp, Homo sapiens; identical to SEQ ID NO: 28888
  misc_feature 1..30: note = chr4:41881717-41881747
  misc_feature 1..30: note = hyper
  source 1..30: mol_type = genomic DNA

SEQ ID NO: 49746 - skipped

SEQ ID NO: 49747 - DNA, 197 bp, Homo sapiens
  misc_feature 1..197: note = chr4:41882894-41883091
  misc_feature 1..197: note = hyper
  source 1..197: mol_type = genomic DNA
tcgggtgttagtgagcgtaatctgaccgcagaaaagctgatgggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaag

SEQ ID NO: 49748 - DNA, 208 bp, Homo sapiens; identical to SEQ ID NO: 18425
  misc_feature 1..208: note = chr4:41883302-41883510
  misc_feature 1..208: note = hyper
  source 1..208: mol_type = genomic DNA

SEQ ID NO: 49749 - DNA, 822 bp, Homo sapiens
  misc_feature 1..822: note = chr4:41883610-41884432
  misc_feature 1..822: note = hyper
  source 1..822: mol_type = genomic DNA
gctcacccgccccgggtttgggcgctgggggtggggaagggagagaaggttcgaacagttttgtctctcccgcgccccggctcccccagggtgctgcgcctccagccgccccgaggcgcttcccccggcgtccgcgcgctcctctccgcaggggtctcgcgcccacggtgccgcagccgcgcggctcagccgccctccgcacccgcgcctttccagcgcccgggttcccaaaccatcgctaaaggcggacggggggcgccaggagtaacggctgctccccggagaccccaccgagcccagcgcccgcccccgccccctgggcgccctgccccattttctccctttcccaactatcccagacccccagaagggccagaattttccagaactgtcccactccacccgcgcccagggcttctgcacattgcccttggcaggacgcgagccggtcgaggggcatttaggggtggccctgcacggccctcactgctgtcccttcttctccctccgttctccgggccagggtcctcggagaccccgttccgcggcaagtacccctcccccacccccggaggcgggtgcagtgcagggcgggggcggcggtcgcagcggctcagaagccgaccctccttgaacccgaagctgccctggcccgagtatccgcactggcctgggcccgagcgaggctgcaaccctgtgaaaccccctgcaaggcggaagcctccaaacccaaacgaccccgagggcgattccgccagaaatccaacgcgggcccaaataaagtccgaggcctttttgtcggaagcccgggaggtgcccggc

SEQ ID NO: 49750 - DNA, 48 bp, Homo sapiens; identical to SEQ ID NO: 28891
  misc_feature 1..48: note = chr4:42152718-42152766
  misc_feature 1..48: note = hyper
  source 1..48: mol_type = genomic DNA

SEQ ID NO: 49751 - DNA, 255 bp, Homo sapiens; identical to SEQ ID NO: 18429
  misc_feature 1..255: note = chr4:42154025-42154280
  misc_feature 1..255: note = hyper
  source 1..255: mol_type = genomic DNA

SEQ ID NO: 49752 - DNA, 26 bp, Homo sapiens
  misc_feature 1..26: note = chr4:42154359-42154385
  misc_feature 1..26: note = hyper
  source 1..26: mol_type = genomic DNA
cgagctcctgattgacaggctgcctc

SEQ ID NO: 49753 - DNA, 276 bp, Homo sapiens; identical to SEQ ID NO: 18431
  misc_feature 1..276: note = chr4:42154386-42154662
  misc_feature 1..276: note = hyper
  source 1..276: mol_type = genomic DNA

SEQ ID NO: 49754 - DNA, 100 bp, Homo sapiens
  misc_feature 1..100: note = chr4:42154997-42155097
  misc_feature 1..100: note = hyper
  source 1..100: mol_type = genomic DNA
gatttcccccccattataaagatgagaaaaccgaggctctgagaggttgaagggaattgcccaaagtcagacactcgggagtgtgcggctgtgttgcact

SEQ ID NO: 49755 - DNA, 28 bp, Homo sapiens
  misc_feature 1..28: note = chr4:42398814-42398842
  misc_feature 1..28: note = hyper
  source 1..28: mol_type = genomic DNA
ctttgcgggcgtgaacggagaagtcgtg

SEQ ID NO: 49756 - DNA, 38 bp, Homo sapiens; identical to SEQ ID NO: 18432
  misc_feature 1..38: note = chr4:42399099-42399137
  misc_feature 1..38: note = hyper
  source 1..38: mol_type = genomic DNA

SEQ ID NO: 49757 - DNA, 497 bp, Homo sapiens
  misc_feature 1..497: note = chr4:42399191-42399688
  misc_feature 1..497: note = hyper
  source 1..497: mol_type = genomic DNA
gaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgcctgtctggggtactcgcacgtggggaacaaattcttttcctccggctcctctcgggacccggcgatcgccacaggttgggactctgtgcggcgctggag

SEQ ID NO: 49758 - DNA, 623 bp, Homo sapiens
  misc_feature 1..623: note = chr4:42399872-42400495
  misc_feature 1..623: note = hyper
  source 1..623: mol_type = genomic DNA
cccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcggccgggtgggggaatca

SEQ ID NO: 49759 - DNA, 207 bp, Homo sapiens; identical to SEQ ID NO: 28898
  misc_feature 1..207: note = chr4:42400850-42401057
  misc_feature 1..207: note = hyper
  source 1..207: mol_type = genomic DNA

SEQ ID NO: 49760 - DNA, 77 bp, Homo sapiens; identical to SEQ ID NO: 28899
  misc_feature 1..77: note = chr4:44448966-44449043
  misc_feature 1..77: note = hyper
  source 1..77: mol_type = genomic DNA

SEQ ID NO: 49761 - DNA, 91 bp, Homo sapiens; identical to SEQ ID NO: 28901
  misc_feature 1..91: note = chr4:44449652-44449743
  misc_feature 1..91: note = hyper
  source 1..91: mol_type = genomic DNA

SEQ ID NO: 49762 - DNA, 206 bp, Homo sapiens; identical to SEQ ID NO: 28902
  misc_feature 1..206: note = chr4:44449971-44450177
  misc_feature 1..206: note = hyper
  source 1..206: mol_type = genomic DNA

SEQ ID NO: 49763 - DNA, 294 bp, Homo sapiens; identical to SEQ ID NO: 28903
  misc_feature 1..294: note = chr4:44450741-44451035
  misc_feature 1..294: note = hyper
  source 1..294: mol_type = genomic DNA

SEQ ID NO: 49764 - DNA, 32 bp, Homo sapiens; identical to SEQ ID NO: 28904
  misc_feature 1..32: note = chr4:46391678-46391710
  misc_feature 1..32: note = hyper
  source 1..32: mol_type = genomic DNA

SEQ ID NO: 49765 - DNA, 30 bp, Homo sapiens; identical to SEQ ID NO: 28905
  misc_feature 1..30: note = chr4:46392469-46392499
  misc_feature 1..30: note = hyper
  source 1..30: mol_type = genomic DNA

SEQ ID NO: 49766 - DNA, 191 bp, Homo sapiens
  misc_feature 1..191: note = chr4:46994970-46995161
  misc_feature 1..191: note = hyper
  source 1..191: mol_type = genomic DNA
cgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacac

SEQ ID NO: 49767 - DNA, 554 bp, Homo sapiens; identical to SEQ ID NO: 18440
  misc_feature 1..554: note = chr4:46995835-46996389
  misc_feature 1..554: note = hyper
  source 1..554: mol_type = genomic DNA

SEQ ID NO: 49768 - DNA, 30 bp, Homo sapiens; identical to SEQ ID NO: 28908
  misc_feature 1..30: note = chr4:47034011-47034041
  misc_feature 1..30: note = hyper
  source 1..30: mol_type = genomic DNA

SEQ ID NO: 49769 - DNA, 432 bp, Homo sapiens; identical to SEQ ID NO: 28909
  misc_feature 1..432: note = chr4:47034321-47034753
  misc_feature 1..432: note = hyper
  source 1..432: mol_type = genomic DNA

SEQ ID NO: 49770 - DNA, 154 bp, Homo sapiens; identical to SEQ ID NO: 18442
  misc_feature 1..154: note = chr4:47034754-47034908
  misc_feature 1..154: note = hyper
  source 1..154: mol_type = genomic DNA

SEQ ID NO: 49771 - DNA, 38 bp, Homo sapiens
  misc_feature 1..38: note = chr4:47034938-47034976
  misc_feature 1..38: note = hyper
  source 1..38: mol_type = genomic DNA
cggatgcaccaaggccctgccaccgagagcacagtctg

SEQ ID NO: 49772 - DNA, 30 bp, Homo sapiens; identical to SEQ ID NO: 28911
  misc_feature 1..30: note = chr4:47839373-47839403
  misc_feature 1..30: note = hyper
  source 1..30: mol_type = genomic DNA

SEQ ID NO: 49773 - DNA, 97 bp, Homo sapiens
  misc_feature 1..97: note = chr4:48486389-48486486
  misc_feature 1..97: note = hyper
  source 1..97: mol_type = genomic DNA
aaggctgggattccatgcgcagcgcggcccttcagcagggtccctcgccgtcctccccgagcgtcggggtggcagcgcaggtcgttgtccagtggaa

SEQ ID NO: 49774 - DNA, 186 bp, Homo sapiens
  misc_feature 1..186: note = chr4:48492433-48492619
  misc_feature 1..186: note = hyper
  source 1..186: mol_type = genomic DNA
gcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctg

SEQ ID NO: 49775 - DNA, 197 bp, Homo sapiens
  misc_feature 1..197: note = chr4:48987912-48988109
  misc_feature 1..197: note = hyper
  source 1..197: mol_type = genomic DNA
catctgggtctccagcggtccttcctctctgccttctcctcgcagagcaccccgtgggcctagtctaaacgagggcaccactggtccggagttgcacttgttcgctccctcctgggctctggcagcgctgcatccccggggttgcttcgggttcgggcccaatagcagagtcagagccgagacgcatgtcccctgca

SEQ ID NO: 49776 - DNA, 68 bp, Homo sapiens; identical to SEQ ID NO: 28917
  misc_feature 1..68: note = chr4:48988465-48988533
  misc_feature 1..68: note = hyper
  source 1..68: mol_type = genomic DNA

SEQ ID NO: 49777 - DNA, 75 bp, Homo sapiens; identical to SEQ ID NO: 28918
  misc_feature 1..75: note = chr4:52917590-52917665
  misc_feature 1..75: note = hyper
  source 1..75: mol_type = genomic DNA

SEQ ID NO: 49778 - DNA, 117 bp, Homo sapiens; identical to SEQ ID NO: 28919
  misc_feature 1..117: note = chr4:52917964-52918081
  misc_feature 1..117: note = hyper
  source 1..117: mol_type = genomic DNA

SEQ ID NO: 49779 - DNA, 114 bp, Homo sapiens; identical to SEQ ID NO: 28920
  misc_feature 1..114: note = chr4:53617401-53617515
  misc_feature 1..114: note = hyper
  source 1..114: mol_type = genomic DNA

SEQ ID NO: 49780 - DNA, 52 bp, Homo sapiens; identical to SEQ ID NO: 28921
  misc_feature 1..52: note = chr4:53617855-53617907
  misc_feature 1..52: note = hyper
  source 1..52: mol_type = genomic DNA

SEQ ID NO: 49781 - DNA, 181 bp, Homo sapiens; identical to SEQ ID NO: 28922
  misc_feature 1..181: note = chr4:53728041-53728222
  misc_feature 1..181: note = hyper
  source 1..181: mol_type = genomic DNA

SEQ ID NO: 49782 - DNA, 1055 bp, Homo sapiens
  misc_feature 1..1055: note = chr4:54965799-54966854
  misc_feature 1..1055: note = hyper
  source 1..1055: mol_type = genomic DNA
aggggtaggtgtaaccgtggccagagctgcgctcagggactggacgactgccagtccgtcgcccgcacaatcctgctccaaaccgcaggcctcacacttcaccgcgccgcagccacccctaccacagaggagctggaaacactgagcattcctattaaataagcctccaagtccccacctggtacgctttgcggtggggcgtggggaagagttgggctgcggccagggtagcgagagggggtgggatggaggatgcagcgctgtgatttctcagtaaagcgtggagaaagagggggaggaggccggcctccccgggaaattaacaaaacctacactttgcaaagtctcccccatccccctcccccgagttcttccccgccgcgcgcccgcccctcctcgcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctgggg

SEQ ID NO: 49783 - DNA, 267 bp, Homo sapiens
  misc_feature 1..267: note = chr4:54967075-54967342
  misc_feature 1..267: note = hyper
  source 1..267: mol_type = genomic DNA
ctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttaggga

SEQ ID NO: 49784 - skipped

SEQ ID NO: 49785 - DNA, 24 bp, Homo sapiens
  misc_feature 1..24: note = chr4:54969747-54969771
  misc_feature 1..24: note = hyper
  source 1..24: mol_type = genomic DNA
gagtgttgtctttagcgcgcgcgc

SEQ ID NO: 49786 - skipped

SEQ ID NO: 49787 - DNA, 274 bp, Homo sapiens; identical to SEQ ID NO: 18451
  misc_feature 1..274: note = chr4:54970095-54970369
  misc_feature 1..274: note = hyper
  source 1..274: mol_type = genomic DNA

SEQ ID NO: 49788 - DNA, 33 bp, Homo sapiens; identical to SEQ ID NO: 18452
  misc_feature 1..33: note = chr4:54970482-54970515
  misc_feature 1..33: note = hyper
  source 1..33: mol_type = genomic DNA

SEQ ID NO: 49789 - DNA, 164 bp, Homo sapiens; identical to SEQ ID NO: 28927
  misc_feature 1..164: note = chr4:54975768-54975932
  misc_feature 1..164: note = hyper
  source 1..164: mol_type = genomic DNA

SEQ ID NO: 49790 - DNA, 15 bp, Homo sapiens
  misc_feature 1..15: note = chr4:54976170-54976185
  misc_feature 1..15: note = hyper
  source 1..15: mol_type = genomic DNA
cgtgggaaagagacg

SEQ ID NO: 49791 - DNA, 134 bp, Homo sapiens
  misc_feature 1..134: note = chr4:55092914-55093048
  misc_feature 1..134: note = hyper
  source 1..134: mol_type = genomic DNA
aaaagacccgcagcccgcctcaggagggcaaggtttctagccccctgcggctccgggaccacccaggacccggggcgtcgtgggaccgatctcgaaggatcttagaacgacactgggagagcgcggcaagaact

SEQ ID NO: 49792 - DNA, 578 bp, Homo sapiens
  misc_feature 1..578: note = chr4:55093255-55093833
  misc_feature 1..578: note = hyper
  source 1..578: mol_type = genomic DNA
accactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattc

SEQ ID NO: 49793 - DNA, 123 bp, Homo sapiens; identical to SEQ ID NO: 7383
  misc_feature 1..123: note = chr4:55093888-55094011
  misc_feature 1..123: note = hyper
  source 1..123: mol_type = genomic DNA

SEQ ID NO: 49794 - DNA, 74 bp, Homo sapiens; identical to SEQ ID NO: 28932
  misc_feature 1..74: note = chr4:55094012-55094086
  misc_feature 1..74: note = hyper
  source 1..74: mol_type = genomic DNA

SEQ ID NO: 49795 - DNA, 92 bp, Homo sapiens; identical to SEQ ID NO: 28933
  misc_feature 1..92: note = chr4:55094514-55094606
  misc_feature 1..92: note = hyper
  source 1..92: mol_type = genomic DNA

SEQ ID NO: 49796 - DNA, 25 bp, Homo sapiens
  misc_feature 1..25: note = chr4:55096214-55096239
  misc_feature 1..25: note = hyper
  source 1..25: mol_type = genomic DNA
tacagcacagggagccggccgaatg

SEQ ID NO: 49797 - DNA, 103 bp, Homo sapiens; identical to SEQ ID NO: 28935
  misc_feature 1..103: note = chr4:55096538-55096641
  misc_feature 1..103: note = hyper
  source 1..103: mol_type = genomic DNA

SEQ ID NO: 49798 - DNA, 69 bp, Homo sapiens
  misc_feature 1..69: note = chr4:55098605-55098674
  misc_feature 1..69: note = hyper
  source 1..69: mol_type = genomic DNA
aaacccgacttggggcgcctccttccctgcctcctactgcagtttctcggcccccgcgaaaggggagcg

SEQ ID NO: 49799 - DNA, 25 bp, Homo sapiens
  misc_feature 1..25: note = chr4:55098744-55098769
  misc_feature 1..25: note = hyper
  source 1..25: mol_type = genomic DNA
cagaaggcacttttgtgtgtgtgtg

SEQ ID NO: 49800 - DNA, 104 bp, Homo sapiens; identical to SEQ ID NO: 28939
  misc_feature 1..104: note = chr4:55099069-55099173
  misc_feature 1..104: note = hyper
  source 1..104: mol_type = genomic DNA

SEQ ID NO: 49801 - DNA, 30 bp, Homo sapiens; identical to SEQ ID NO: 28940
  misc_feature 1..30: note = chr4:55099383-55099413
  misc_feature 1..30: note = hyper
  source 1..30: mol_type = genomic DNA

SEQ ID NO: 49802 - DNA, 208 bp, Homo sapiens; identical to SEQ ID NO: 28941
  misc_feature 1..208: note = chr4:55523645-55523853
  misc_feature 1..208: note = hyper
  source 1..208: mol_type = genomic DNA

SEQ ID NO: 49803 - DNA, 689 bp, Homo sapiens; identical to SEQ ID NO: 28943
  misc_feature 1..689: note = chr4:55524562-55525251
  misc_feature 1..689: note = hyper
  source 1..689: mol_type = genomic DNA

SEQ ID NO: 49804 - DNA, 161 bp, Homo sapiens
  misc_feature 1..161: note = chr4:55990946-55991107
  misc_feature 1..161: note = hyper
  source 1..161: mol_type = genomic DNA
ccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaag

SEQ ID NO: 49805 - DNA, 15 bp, Homo sapiens
  misc_feature 1..15: note = chr4:55992169-55992184
  misc_feature 1..15: note = hyper
  source 1..15: mol_type = genomic DNA
cgagaatctgcagca

SEQ ID NO: 49806 - DNA, 86 bp, Homo sapiens; identical to SEQ ID NO: 28946
  misc_feature 1..86: note = chr4:56501604-56501690
  misc_feature 1..86: note = hyper
  source 1..86: mol_type = genomic DNA

SEQ ID NO: 49807 - DNA, 30 bp, Homo sapiens; identical to SEQ ID NO: 28947
  misc_feature 1..30: note = chr4:56503489-56503519
  misc_feature 1..30: note = hyper
  source 1..30: mol_type = genomic DNA

SEQ ID NO: 49808 - DNA, 41 bp, Homo sapiens
  misc_feature 1..41: note = chr4:56660021-56660062
  misc_feature 1..41: note = hyper
  source 1..41: mol_type = genomic DNA
accctttggatttttctcttccacaccgcctcatccgaggg

SEQ ID NO: 49809 - DNA, 72 bp, Homo sapiens
  misc_feature 1..72: note = chr4:57371963-57372035
  misc_feature 1..72: note = hyper
  source 1..72: mol_type = genomic DNA
gggcccagagccaccgctcagcacgcgggcacgcggcgggagggaaggaaaccgcggcgctggggatggaga

SEQ ID NO: 49810 - DNA, 192 bp, Homo sapiens; identical to SEQ ID NO: 28952
  misc_feature 1..192: note = chr4:57396459-57396651
  misc_feature 1..192: note = hyper
  source 1..192: mol_type = genomic DNA

SEQ ID NO: 49811 - DNA, 61 bp, Homo sapiens
  misc_feature 1..61: note = chr4:57397264-57397325
  misc_feature 1..61: note = hyper
  source 1..61: mol_type = genomic DNA
cgccgcagtaatgatctccccctctctgatcaccagagccccgccacggcctcagctgtct

SEQ ID NO: 49812 - DNA, 15 bp, Homo sapiens
  misc_feature 1..15: note = chr4:57521381-57521396
  misc_feature 1..15: note = hyper
  source 1..15: mol_type = genomic DNA
aattttttaaaaaat

SEQ ID NO: 49813 - DNA, 51 bp, Homo sapiens
  misc_feature 1..51: note = chr4:57687669-57687720
  misc_feature 1..51: note = hyper
  source 1..51: mol_type = genomic DNA
gtcgccgaggccgcccggagcagggcagggtccgccgccggtctgactccc

SEQ ID NO: 49814 - DNA, 74 bp, Homo sapiens
  misc_feature 1..74: note = chr4:57687782-57687856
  misc_feature 1..74: note = hyper
  source 1..74: mol_type = genomic DNA
taactgccaggagcagcagcgccaagcgcagcaccgacagcgccatcctcctcccgcgccggctgtcttgcccc

SEQ ID NO: 49815 - DNA, 256 bp, Homo sapiens
  misc_feature 1..256: note = chr4:57975777-57976033
  misc_feature 1..256: note = hyper
  source 1..256: mol_type = genomic DNA
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgct

SEQ ID NO: 49816 - DNA, 231 bp, Homo sapiens
  misc_feature 1..231: note = chr4:57976185-57976416
  misc_feature 1..231: note = hyper
  source 1..231: mol_type = genomic DNA
cacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcag

SEQ ID NO: 49817 - DNA, 127 bp, Homo sapiens
  misc_feature 1..127: note = chr4:57976573-57976700
  misc_feature 1..127: note = hyper
  source 1..127: mol_type = genomic DNA
gccttaaacccgccgccccgcccggcctgtccgcgggaaccacaccccggggcggtgagagcacgggggccccgcccgtgccgccctcccggccccgcggggcctgcgcgcgcgctcctgctggcgt

SEQ ID NO: 49818 - DNA, 30 bp, Homo sapiens; identical to SEQ ID NO: 7405
  misc_feature 1..30: note = chr4:57977077-57977107
  misc_feature 1..30: note = hyper
  source 1..30: mol_type = genomic DNA

SEQ ID NO: 49819 - DNA, 290 bp, Homo sapiens; identical to SEQ ID NO: 28961
  misc_feature 1..290: note = chr4:62065781-62066071
  misc_feature 1..290: note = hyper
  source 1..290: mol_type = genomic DNA

SEQ ID NO: 49820 - DNA, 63 bp, Homo sapiens
  misc_feature 1..63: note = chr4:62066133-62066196
  misc_feature 1..63: note = hyper
  source 1..63: mol_type = genomic DNA
cgtcgcccccctcgcctgctggcccggcaccgctcgctccagttcccaggagcggggatgcag

SEQ ID NO: 49821 - DNA, 360 bp, Homo sapiens; identical to SEQ ID NO: 28963
  misc_feature 1..360: note = chr4:62066855-62067215
  misc_feature 1..360: note = hyper
  source 1..360: mol_type = genomic DNA

SEQ ID NO: 49822 - DNA, 71 bp, Homo sapiens; identical to SEQ ID NO: 18473
  misc_feature 1..71: note = chr4:62067440-62067511
  misc_feature 1..71: note = hyper
  source 1..71: mol_type = genomic DNA

SEQ ID NO: 49823 - DNA, 52 bp, Homo sapiens
  misc_feature 1..52: note = chr4:62068150-62068202
  misc_feature 1..52: note = hyper
  source 1..52: mol_type = genomic DNA
ttaggcggttttggctggagaaagctgccactttcgtgggtggcccgggctg

SEQ ID NO: 49824 - DNA, 116 bp, Homo sapiens; identical to SEQ ID NO: 28966
  misc_feature 1..116: note = chr4:62068237-62068353
  misc_feature 1..116: note = hyper
  source 1..116: mol_type = genomic DNA

SEQ ID NO: 49825 - DNA, 30 bp, Homo sapiens; identical to SEQ ID NO: 28967
  misc_feature 1..30: note = chr4:62068633-62068663
  misc_feature 1..30: note = hyper
  source 1..30: mol_type = genomic DNA

SEQ ID NO: 49826 - DNA, 30 bp, Homo sapiens; identical to SEQ ID NO: 28968
  misc_feature 1..30: note = chr4:66534335-66534365
  misc_feature 1..30: note = hyper
  source 1..30: mol_type = genomic DNA

SEQ ID NO: 49827 - DNA, 236 bp, Homo sapiens
  misc_feature 1..236: note = chr4:66534894-66535130
  misc_feature 1..236: note = hyper
  source 1..236: mol_type = genomic DNA
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaagg

SEQ ID NO: 49828 - DNA, 475 bp, Homo sapiens; identical to SEQ ID NO: 28970
  misc_feature 1..475: note = chr4:66535574-66536049
  misc_feature 1..475: note = hyper
  source 1..475: mol_type = genomic DNA

SEQ ID NO: 49829 - DNA, 48 bp, Homo sapiens; identical to SEQ ID NO: 28971
  misc_feature 1..48: note = chr4:66536391-66536439
  misc_feature 1..48: note = hyper
  source 1..48: mol_type = genomic DNA

SEQ ID NO: 49830 - DNA, 228 bp, Homo sapiens; identical to SEQ ID NO: 28972
  misc_feature 1..228: note = chr4:71600396-71600624
  misc_feature 1..228: note = hyper
  source 1..228: mol_type = genomic DNA

SEQ ID NO: 49831 - DNA, 241 bp, Homo sapiens; identical to SEQ ID NO: 28973
  misc_feature 1..241: note = chr4:73433899-73434140
  misc_feature 1..241: note = hyper
  source 1..241: mol_type = genomic DNA

SEQ ID NO: 49832 - DNA, 279 bp, Homo sapiens; identical to SEQ ID NO: 28974
  misc_feature 1..279: note = chr4:73434964-73435243
  misc_feature 1..279: note = hyper
  source 1..279: mol_type = genomic DNA

SEQ ID NO: 49833 - DNA, 69 bp, Homo sapiens; identical to SEQ ID NO: 28975
  misc_feature 1..69: note = chr4:74702331-74702400
  misc_feature 1..69: note = hyper
  source 1..69: mol_type = genomic DNA

SEQ ID NO: 49834 - DNA, 12 bp, Homo sapiens
  misc_feature 1..12: note = chr4:74809865-74809877
  misc_feature 1..12: note = hyper
  source 1..12: mol_type = genomic DNA
gactcgctgggt

SEQ ID NO: 49835 - DNA, 100 bp, Homo sapiens
  misc_feature 1..100: note = chr4:74809933-74810033
  misc_feature 1..100: note = hyper
  source 1..100: mol_type = genomic DNA
agggcgccgggacccatctgccgctcgccggccggaggctaccaggagcaggagcagcagcgccgcccgcagtagccggggagcgcgggggacagcgggg

SEQ ID NO: 49836 - DNA, 62 bp, Homo sapiens; identical to SEQ ID NO: 28977
  misc_feature 1..62: note = chr4:74810262-74810324
  misc_feature 1..62: note = hyper
  source 1..62: mol_type = genomic DNA

SEQ ID NO: 49837 - DNA, 234 bp, Homo sapiens; identical to SEQ ID NO: 28978
  misc_feature 1..234: note = chr4:74904177-74904411
  misc_feature 1..234: note = hyper
  source 1..234: mol_type = genomic DNA

SEQ ID NO: 49838 - DNA, 92 bp, Homo sapiens; identical to SEQ ID NO: 28979
  misc_feature 1..92: note = chr4:75230955-75231047
  misc_feature 1..92: note = hyper
  source 1..92: mol_type = genomic DNA

SEQ ID NO: 49839 - DNA, 81 bp, Homo sapiens; identical to SEQ ID NO: 28980
  misc_feature 1..81: note = chr4:76555351-76555432
  misc_feature 1..81: note = hyper
  source 1..81: mol_type = genomic DNA

SEQ ID NO: 49840 - DNA, 32 bp, Homo sapiens; identical to SEQ ID NO: 28982
  misc_feature 1..32: note = chr4:77228302-77228334
  misc_feature 1..32: note = hyper
  source 1..32: mol_type = genomic DNA

SEQ ID NO: 49841 - DNA, 30 bp, Homo sapiens; identical to SEQ ID NO: 28983
  misc_feature 1..30: note = chr4:77819543-77819573
  misc_feature 1..30: note = hyper
  source 1..30: mol_type = genomic DNA

SEQ ID NO: 49842 - DNA, 15 bp, Homo sapiens
  misc_feature 1..15: note = chr4:79472968-79472983
  misc_feature 1..15: note = hyper
  source 1..15: mol_type = genomic DNA
tgttcgcagtttact

SEQ ID NO: 49843 - DNA, 229 bp, Homo sapiens
  misc_feature 1..229: note = chr4:81106122-81106351
  misc_feature 1..229: note = hyper
  source 1..229: mol_type = genomic DNA
tttcagaagcagttgcgctgggggtggggaaagggagggaagggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaatt

SEQ ID NO: 49844 - DNA, 325 bp, Homo sapiens; identical to SEQ ID NO: 28986
  misc_feature 1..325: note = chr4:81123055-81123380
  misc_feature 1..325: note = hyper
  source 1..325: mol_type = genomic DNA

SEQ ID NO: 49845 - DNA, 232 bp, Homo sapiens; identical to SEQ ID NO: 28987
  misc_feature 1..232: note = chr4:81123381-81123613
  misc_feature 1..232: note = hyper
  source 1..232: mol_type = genomic DNA

SEQ ID NO: 49846 - DNA, 290 bp, Homo sapiens; identical to SEQ ID NO: 28988
  misc_feature 1..290: note = chr4:81123614-81123904
  misc_feature 1..290: note = hyper
  source 1..290: mol_type = genomic DNA

SEQ ID NO: 49847 - DNA, 156 bp, Homo sapiens; identical to SEQ ID NO: 18482
  misc_feature 1..156: note = chr4:81124121-81124277
  misc_feature 1..156: note = hyper
  source 1..156: mol_type = genomic DNA

SEQ ID NO: 49848 - DNA, 69 bp, Homo sapiens
  misc_feature 1..69: note = chr4:81124662-81124731
  misc_feature 1..69: note = hyper
  source 1..69: mol_type = genomic DNA
aggcacatgacctcgcataattgactcggaaaggaccccagctttccacgcgcgcgcaagcacagttaa

SEQ ID NO: 49849 - DNA, 37 bp, Homo sapiens; identical to SEQ ID NO: 28990
  misc_feature 1..37: note = chr4:81186703-81186740
  misc_feature 1..37: note = hyper
  source 1..37: mol_type = genomic DNA

SEQ ID NO: 49850 - skipped

SEQ ID NO: 49851 - DNA, 483 bp, Homo sapiens
  misc_feature 1..483: note = chr4:81187076-81187559
  misc_feature 1..483: note = hyper
  source 1..483: mol_type = genomic DNA
agaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgag

SEQ ID NO: 49852 - DNA, 209 bp, Homo sapiens
  misc_feature 1..209: note = chr4:81187589-81187798
  misc_feature 1..209: note = hyper
  source 1..209: mol_type = genomic DNA
ggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatccc

SEQ ID NO: 49853 - DNA, 517 bp, Homo sapiens; identical to SEQ ID NO: 28992
  misc_feature 1..517: note = chr4:81187799-81188316
  misc_feature 1..517: note = hyper
  source 1..517: mol_type = genomic DNA

SEQ ID NO: 49854 - skipped

SEQ ID NO: 49855 - DNA, 24 bp, Homo sapiens
  misc_feature 1..24: note = chr4:81189911-81189935
  misc_feature 1..24: note = hyper
  source 1..24: mol_type = genomic DNA
agggccctccgcacacgcaccagc

SEQ ID NO: 49856 - DNA, 405 bp, Homo sapiens; identical to SEQ ID NO: 28995
  misc_feature 1..405: note = chr4:81256834-81257239
  misc_feature 1..405: note = hyper
  source 1..405: mol_type = genomic DNA

SEQ ID NO: 49857 - DNA, 31 bp, Homo sapiens
  misc_feature 1..31: note = chr4:81951400-81951431
  misc_feature 1..31: note = hyper
  source 1..31: mol_type = genomic DNA
aggaagctatgatgacgggctgcaggtgcag

SEQ ID NO: 49858 - DNA, 41 bp, Homo sapiens
  misc_feature 1..41: note = chr4:81951460-81951501
  misc_feature 1..41: note = hyper
  source 1..41: mol_type = genomic DNA
gggaaagtaagcgagaatggtgttcacgttgtgactttgtt

SEQ ID NO: 49859 - DNA, 100 bp, Homo sapiens; identical to SEQ ID NO: 28997
  misc_feature 1..100: note = chr4:81951777-81951877
  misc_feature 1..100: note = hyper
  source 1..100: mol_type = genomic DNA

SEQ ID NO: 49860 - skipped

SEQ ID NO: 49861 - DNA, 200 bp, Homo sapiens
  misc_feature 1..200: note = chr4:81951970-81952170
  misc_feature 1..200: note = hyper
  source 1..200: mol_type = genomic DNA
ccctggaaaaggcaatcgagcgccctccggaccgctgcgcacagccccggctccgacctggcgcccaaaacagagctagtcctagtccctcgcgcggccagtttggccgggtgttcccaaaaataaagcgaggagggaaggtacagacagatcttgaaaacacccgggccacacacgccgcgacctacagctctttctca

SEQ ID NO: 49862 - DNA, 573 bp, Homo sapiens; identical to SEQ ID NO: 28999
  misc_feature 1..573: note = chr4:81952363-81952936
  misc_feature 1..573: note = hyper
  source 1..573: mol_type = genomic DNA

SEQ ID NO: 49863 - DNA, 149 bp, Homo sapiens
  misc_feature 1..149: note = chr4:82136056-82136205
  misc_feature 1..149: note = hyper
  source 1..149: mol_type = genomic DNA
cggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccag

SEQ ID NO: 49864 - DNA, 142 bp, Homo sapiens; identical to SEQ ID NO: 29002
  misc_feature 1..142: note = chr4:82136243-82136385
  misc_feature 1..142: note = hyper
  source 1..142: mol_type = genomic DNA

SEQ ID NO: 49865 - DNA, 172 bp, Homo sapiens; identical to SEQ ID NO: 18499
  misc_feature 1..172: note = chr4:82136635-82136807
  misc_feature 1..172: note = hyper
  source 1..172: mol_type = genomic DNA

SEQ ID NO: 49866 - DNA, 110 bp, Homo sapiens
  misc_feature 1..110: note = chr4:82136837-82136947
  misc_feature 1..110: note = hyper
  source 1..110: mol_type = genomic DNA
ccgaagcagctcgtcgacgcgcccctcccggactctggggccataacttacatctagtttgccagttcacgtgatgctgggggcaggggttgaatcgagtttcgagggac

SEQ ID NO: 49867 - DNA, 316 bp, Homo sapiens; identical to SEQ ID NO: 29004
  misc_feature 1..316: note = chr4:82965388-82965704
  misc_feature 1..316: note = hyper
  source 1..316: mol_type = genomic DNA

SEQ ID NO: 49868 - DNA, 36 bp, Homo sapiens; identical to SEQ ID NO: 29005
  misc_feature 1..36: note = chr4:83482690-83482726
  misc_feature 1..36: note = hyper
  source 1..36: mol_type = genomic DNA

SEQ ID NO: 49869 - DNA, 278 bp, Homo sapiens; identical to SEQ ID NO: 29006
  misc_feature 1..278: note = chr4:83483094-83483372
  misc_feature 1..278: note = hyper
  source 1..278: mol_type = genomic DNA

SEQ ID NO: 49870 - DNA, 44 bp, Homo sapiens; identical to SEQ ID NO: 29007
  misc_feature 1..44: note = chr4:83719361-83719405
  misc_feature 1..44: note = hyper
  source 1..44: mol_type = genomic DNA

SEQ ID NO: 49871 - DNA, 29 bp, Homo sapiens
  misc_feature 1..29: note = chr4:85402747-85402776
  misc_feature 1..29: note = hyper
  source 1..29: mol_type = genomic DNA
cccctctgtctaccttgcggagactattc

SEQ ID NO: 49872 - DNA, 137 bp, Homo sapiens
  misc_feature 1..137: note = chr4:85403776-85403913
  misc_feature 1..137: note = hyper
  source 1..137: mol_type = genomic DNA
ctgtggttgccttttcggtttcaaagtaataaccaagcaaggaagagagaagaccgaaaactaccccgcggaaactagcacagtgtgcctggatgtctgtgtcccgggacctcggggaagagggcccgcaccggtct

SEQ ID NO: 49873 - DNA, 189 bp, Homo sapiens; identical to SEQ ID NO: 7440
  misc_feature 1..189: note = chr4:85414148-85414337
  misc_feature 1..189: note = hyper
  source 1..189: mol_type = genomic DNA

SEQ ID NO: 49874 - DNA, 268 bp, Homo sapiens
  misc_feature 1..268: note = chr4:85414457-85414725
  misc_feature 1..268: note = hyper
  source 1..268: mol_type = genomic DNA
ggctcggacgcgtgcagtaggaggccgccgccgccgccgctgctggacttgtgcttcttcaacagctgcgtgattttctcgtcgtccgagttgggatccagaggcttattgtagtcgtcgtcctcttcctcgttctccgaggcccccttgaggcgctctgtctccgagtcctgcttcttcttggccgtggccatctcggcagcgtgcttcttcctccacttggtccggcggttctggaaccagacctgagggcggagaaaagggagga

SEQ ID NO: 49875 - DNA, 178 bp, Homo sapiens
  misc_feature 1..178: note = chr4:85414846-85415024
  misc_feature 1..178: note = hyper
  source 1..178: mol_type = genomic DNA
tctcggccgtcaaagtcagtctccgtcgccccaagttccccctgagtaactggcaccaacaaactgactgccgttgccatagcgatggtaacacaagagtattgaggttgtcagtgagcgagttctcaaaagtaaaaacaaaactcggaaacttaaaaatgagcgtccctaaaagtga

SEQ ID NO: 49876 - DNA, 432 bp, Homo sapiens
  misc_feature 1..432: note = chr4:85416904-85417336
  misc_feature 1..432: note = hyper
  source 1..432: mol_type = genomic DNA
aagtcttctccagggcgaagatctgctgtccggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctc

SEQ ID NO: 49877 - DNA, 53 bp, Homo sapiens; identical to SEQ ID NO: 7444
  misc_feature 1..53: note = chr4:85417666-85417719
  misc_feature 1..53: note = hyper
  source 1..53: mol_type = genomic DNA

SEQ ID NO: 49878 - DNA, 144 bp, Homo sapiens
  misc_feature 1..144: note = chr4:85418079-85418223
  misc_feature 1..144: note = hyper
  source 1..144: mol_type = genomic DNA
ggggacgctggactgtcttcaatgggctcacccaggccgagtgtactcgggcggcgagggcgaagaggtgaggtggggacaccccaggcggagacgtgcatgcaaatacactcacttcccgggcggtggagggctcaccgctgc

SEQ ID NO: 49879 - DNA, 106 bp, Homo sapiens; identical to SEQ ID NO: 29019
  misc_feature 1..106: note = chr4:85418264-85418370
  misc_feature 1..106: note = hyper
  source 1..106: mol_type = genomic DNA

SEQ ID NO: 49880 - DNA, 521 bp, Homo sapiens; identical to SEQ ID NO: 29021
  misc_feature 1..521: note = chr4:85419120-85419641
  misc_feature 1..521: note = hyper
  source 1..521: mol_type = genomic DNA

SEQ ID NO: 49881 - DNA, 230 bp, Homo sapiens; identical to SEQ ID NO: 29022
  misc_feature 1..230: note = chr4:85419661-85419891
  misc_feature 1..230: note = hyper
  source 1..230: mol_type = genomic DNA

SEQ ID NO: 49882 - DNA, 35 bp, Homo sapiens
  misc_feature 1..35: note = chr4:85422432-85422467
  misc_feature 1..35: note = hyper
  source 1..35: mol_type = genomic DNA
cttcggacactccaccctggcggtggtacccaacc

SEQ ID NO: 49883 - DNA, 197 bp, Homo sapiens; identical to SEQ ID NO: 29025
  misc_feature 1..197: note = chr4:85423633-85423830
  misc_feature 1..197: note = hyper
  source 1..197: mol_type = genomic DNA

SEQ ID NO: 49884 - DNA, 225 bp, Homo sapiens
  misc_feature 1..225: note = chr4:85424176-85424401
  misc_feature 1..225: note = hyper
  source 1..225: mol_type = genomic DNA
tttgcttcctataaacgccgtagagtggaaactgcacctttgccacaacttctgctgcccagcacttaaggtagagatttgggaagaattgaagcagacagcgtggaaaagcgccgtaggatcttgcgttcggcgctctcccagtggaggccaacaccaaacaagtggggaagcgaccagtgtaaacagccccatccattctaccacagaaaagatctcgaagtc

SEQ ID NO: 49885 - DNA, 24 bp, Homo sapiens
  misc_feature 1..24: note = chr4:85424483-85424507
  misc_feature 1..24: note = hyper
  source 1..24: mol_type = genomic DNA
agtgcgctccgaagggtggcttct

SEQ ID NO: 49886 - DNA, 301 bp, Homo sapiens; identical to SEQ ID NO: 29027
  misc_feature 1..301: note = chr4:85504300-85504601
  misc_feature 1..301: note = hyper
  source 1..301: mol_type = genomic DNA

SEQ ID NO: 49887 - DNA, 61 bp, Homo sapiens; identical to SEQ ID NO: 29028
  misc_feature 1..61: note = chr4:85887114-85887175
  misc_feature 1..61: note = hyper
  source 1..61: mol_type = genomic DNA

SEQ ID NO: 49888 - DNA, 127 bp, Homo sapiens; identical to SEQ ID NO: 29029
  misc_feature 1..127: note = chr4:87281168-87281295
  misc_feature 1..127: note = hyper
  source 1..127: mol_type = genomic DNA

SEQ ID NO: 49889 - DNA, 121 bp, Homo sapiens
  misc_feature 1..121: note = chr4:87515216-87515337
  misc_feature 1..121: note = hyper
  source 1..121: mol_type = genomic DNA
agcctctggctagtccgaagaacgcgaaaagccaggcccaaggcactggttgtcatggcaaccggggcgctggtctccctggcgacctcgtccctagggaggaggtggagctggatgccag

SEQ ID NO: 49890 - DNA, 684 bp, Homo sapiens
  misc_feature 1..684: note = chr4:87515367-87516051
  misc_feature 1..684: note = hyper
  source 1..684: mol_type = genomic DNA
gtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaa

SEQ ID NO: 49891 - DNA, 30 bp, Homo sapiens; identical to SEQ ID NO: 29031
  misc_feature 1..30: note = chr4:87813050-87813080
  misc_feature 1..30: note = hyper
  source 1..30: mol_type = genomic DNA

SEQ ID NO: 49892 - DNA, 126 bp, Homo sapiens
  misc_feature 1..126: note = chr4:89378338-89378464
  misc_feature 1..126: note = hyper
  source 1..126: mol_type = genomic DNA
gcctgaggcagtgggcgcgctcagtcccgggaccaggcgttctctcctctcgcctctgggcctgggaccccgcaaagcggcgatggagcggaggtcgcggaggaagtcgcggcgcaacgggcgctc

SEQ ID NO: 49893 - DNA, 128 bp, Homo sapiens
  misc_feature 1..128: note = chr4:89378497-89378625
  misc_feature 1..128: note = hyper
  source 1..128: mol_type = genomic DNA
gaagtctccgggcgcacagctctggctctttcccagcgccgcgggcctccaccgcgcgctgctccggagggtggaggtgacgcgccaactctgctgctcgccggggcgcctcgcggtcttggaacgcg

SEQ ID NO: 49894 - skipped

SEQ ID NO: 49895 - DNA, 15 bp, Homo sapiens
  misc_feature 1..15: note = chr4:90758090-90758105
  misc_feature 1..15: note = hyper
  source 1..15: mol_type = genomic DNA
agtgggaggcaaacc

SEQ ID NO: 49896 - DNA, 642 bp, Homo sapiens
  misc_feature 1..642: note = chr4:90758134-90758776
  misc_feature 1..642: note = hyper
  source 1..642: mol_type = genomic DNA
agttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcag

SEQ ID NO: 49897 - DNA, 29 bp, Homo sapiens
  misc_feature 1..29: note = chr4:90758883-90758912
  misc_feature 1..29: note = hyper
  source 1..29: mol_type = genomic DNA
atcttcaaggttttcgtttgctcttaatc

SEQ ID NO: 49898 - DNA, 56 bp, Homo sapiens; identical to SEQ ID NO: 29036
  misc_feature 1..56: note = chr4:90759319-90759375
  misc_feature 1..56: note = hyper
  source 1..56: mol_type = genomic DNA

SEQ ID NO: 49899 - DNA, 95 bp, Homo sapiens; identical to SEQ ID NO: 29037
  misc_feature 1..95: note = chr4:93225325-93225420
  misc_feature 1..95: note = hyper
  source 1..95: mol_type = genomic DNA

SEQ ID NO: 49900 - DNA, 30 bp, Homo sapiens; identical to SEQ ID NO: 29038
  misc_feature 1..30: note = chr4:93226097-93226127
  misc_feature 1..30: note = hyper
  source 1..30: mol_type = genomic DNA

SEQ ID NO: 49901 - DNA, 38 bp, Homo sapiens; identical to SEQ ID NO: 29040
  misc_feature 1..38: note = chr4:94750202-94750240
  misc_feature 1..38: note = hyper
  source 1..38: mol_type = genomic DNA

SEQ ID NO: 49902 - DNA, 30 bp, Homo sapiens; identical to SEQ ID NO: 29041
  misc_feature 1..30: note = chr4:94750621-94750651
  misc_feature 1..30: note = hyper
  source 1..30: mol_type = genomic DNA

SEQ ID NO: 49903 - DNA, 118 bp, Homo sapiens
  misc_feature 1..118: note = chr4:94750864-94750982
  misc_feature 1..118: note = hyper
  source 1..118: mol_type = genomic DNA
gccagcggccgaccccgcccgggagttgccggactcgcttctcagccccagcttctgcgggagggtactcggtgcagctggacgctctgcacttctcgactttcgaggacagcgccct

SEQ ID NO: 49904 - DNA, 279 bp, Homo sapiens
  misc_feature 1..279: note = chr4:94751140-94751419
  misc_feature 1..279: note = hyper
  source 1..279: mol_type = genomic DNA
aggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggt

SEQ ID NO: 49905 - DNA, 97 bp, Homo sapiens; identical to SEQ ID NO: 18519
  misc_feature 1..97: note = chr4:94751502-94751599
  misc_feature 1..97: note = hyper
  source 1..97: mol_type = genomic DNA

SEQ ID NO: 49906 - DNA, 20 bp, Homo sapiens
  misc_feature 1..20: note = chr4:94752906-94752926
  misc_feature 1..20: note = hyper
  source 1..20: mol_type = genomic DNA
ggaaaagctaatagtcgtgc

SEQ ID NO: 49907 - DNA, 136 bp, Homo sapiens
  misc_feature 1..136: note = chr4:94753279-94753415
  misc_feature 1..136: note = hyper
  source 1..136: mol_type = genomic DNA
taatgcactagggagcgcaggttctggtctccttaagtaagaaactgcagaaccagctttttactgaccacctgggtatctgtggctttcagcggaagccgaccaagagatgcagagaacgtccgccagctctctg

SEQ ID NO: 49908 - DNA, 30 bp, Homo sapiens; identical to SEQ ID NO: 29045
  misc_feature 1..30: note = chr4:94755600-94755630
  misc_feature 1..30: note = hyper
  source 1..30: mol_type = genomic DNA

SEQ ID NO: 49909 - DNA, 136 bp, Homo sapiens; identical to SEQ ID NO: 29047
  misc_feature 1..136: note = chr4:95678866-95679002
  misc_feature 1..136: note = hyper
  source 1..136: mol_type = genomic DNA

SEQ ID NO: 49910 - DNA, 76 bp, Homo sapiens; identical to SEQ ID NO: 29048
  misc_feature 1..76: note = chr4:95679062-95679138
  misc_feature 1..76: note = hyper
  source 1..76: mol_type = genomic DNA

SEQ ID NO: 49911 - DNA, 56 bp, Homo sapiens; identical to SEQ ID NO: 29049
  misc_feature 1..56: note = chr4:95679689-95679745
  misc_feature 1..56: note = hyper
  source 1..56: mol_type = genomic DNA

SEQ ID NO: 49912 - DNA, 56 bp, Homo sapiens; identical to SEQ ID NO: 29050
  misc_feature 1..56: note = chr4:96469013-96469069
  misc_feature 1..56: note = hyper
  source 1..56: mol_type = genomic DNA

SEQ ID NO: 49913 - DNA, 30 bp, Homo sapiens; identical to SEQ ID NO: 29051
  misc_feature 1..30: note = chr4:96469768-96469798
  misc_feature 1..30: note = hyper
  source 1..30: mol_type = genomic DNA

SEQ ID NO: 49914 - DNA, 30 bp, Homo sapiens; identical to SEQ ID NO: 29052
  misc_feature 1..30: note = chr4:96470085-96470115
  misc_feature 1..30: note = hyper
  source 1..30: mol_type = genomic DNA

SEQ ID NO: 49915 - DNA, 64 bp, Homo sapiens; identical to SEQ ID NO: 29053
  misc_feature 1..64: note = chr4:96470823-96470887
  misc_feature 1..64: note = hyper
  source 1..64: mol_type = genomic DNA

SEQ ID NO: 49916 - DNA, 73 bp, Homo sapiens; identical to SEQ ID NO: 29054
  misc_feature 1..73: note = chr4:96470888-96470961
  misc_feature 1..73: note = hyper
  source 1..73: mol_type = genomic DNA

SEQ ID NO: 49917 - DNA, 83 bp, Homo sapiens; identical to SEQ ID NO: 18524
  misc_feature 1..83: note = chr4:101111504-101111587
  misc_feature 1..83: note = hyper
  source 1..83: mol_type = genomic DNA

SEQ ID NO: 49918 - DNA, 60 bp, Homo sapiens
  misc_feature 1..60: note = chr4:101111797-101111857
  misc_feature 1..60: note = hyper
  source 1..60: mol_type = genomic DNA
aagcctgtggtagagcggacacctgttgcttccagggtagatctcgggccactgggaccg

SEQ ID NO: 49919 - DNA, 30 bp, Homo sapiens; identical to SEQ ID NO: 29058
  misc_feature 1..30: note = chr4:103997969-103997999
  misc_feature 1..30: note = hyper
  source 1..30: mol_type = genomic DNA

SEQ ID NO: 49920 - DNA, 130 bp, Homo sapiens
  misc_feature 1..130: note = chr4:107955181-107955311
  misc_feature 1..130: note = hyper
  source 1..130: mol_type = genomic DNA
aaaggatagctgaaacggttcacacttcaaagctctgggaagagttctggaactgcaaaactagcaaaactgcaaaattgtccccgtgagagggcagtagggggccaagcccgggtcttgtctctctgtc

SEQ ID NO: 49921 - DNA, 38 bp, Homo sapiens
  misc_feature 1..38: note = chr4:107956638-107956676
  misc_feature 1..38: note = hyper
  source 1..38: mol_type = genomic DNA
gagttgagtttggcccgcgaactgccgatctgtgagct

SEQ ID NO: 49922 - DNA, 113 bp, Homo sapiens; identical to SEQ ID NO: 7472
  misc_feature 1..113: note = chr4:107957249-107957362
  misc_feature 1..113: note = hyper
  source 1..113: mol_type = genomic DNA

SEQ ID NO: 49923 - DNA, 10 bp, Homo sapiens
  misc_feature 1..10: note = chr4:107957363-107957373
  misc_feature 1..10: note = hyper
  source 1..10: mol_type = genomic DNA
ttgtcccctg

SEQ ID NO: 49924 - DNA, 137 bp, Homo sapiens
  misc_feature 1..137: note = chr4:107957466-107957603
  misc_feature 1..137: note = hyper
  source 1..137: mol_type = genomic DNA
tgctctctccccagtcctctttgctttttatagcttcccacagtgaggactttttttttttttttacctccgcccccaattcaagagtgacaaagagtgaaaatttttctctcactccccaccgcttccgcccccct

SEQ ID NO: 49925 - DNA, 68 bp, Homo sapiens; identical to SEQ ID NO: 29063
  misc_feature 1..68: note = chr4:107957925-107957993
  misc_feature 1..68: note = hyper
  source 1..68: mol_type = genomic DNA

SEQ ID NO: 49926 - DNA, 112 bp, Homo sapiens; identical to SEQ ID NO: 29064
  misc_feature 1..112: note = chr4:107958393-107958505
  misc_feature 1..112: note = hyper
  source 1..112: mol_type = genomic DNA

SEQ ID NO: 49927 - DNA, 99 bp, Homo sapiens; identical to SEQ ID NO: 29065
  misc_feature 1..99: note = chr4:108853188-108853287
  misc_feature 1..99: note = hyper
  source 1..99: mol_type = genomic DNA

SEQ ID NO: 49928 - DNA, 258 bp, Homo sapiens; identical to SEQ ID NO: 29066
  misc_feature 1..258: note = chr4:109088205-109088463
  misc_feature 1..258: note = hyper
  source 1..258: mol_type = genomic DNA

SEQ ID NO: 49929 - DNA, 231 bp, Homo sapiens; identical to SEQ ID NO: 29067
  misc_feature 1..231: note = chr4:109089045-109089276
  misc_feature 1..231: note = hyper
  source 1..231: mol_type = genomic DNA

SEQ ID NO: 49930 - DNA, 30 bp, Homo sapiens; identical to SEQ ID NO: 29068
  misc_feature 1..30: note = chr4:109090379-109090409
  misc_feature 1..30: note = hyper
  source 1..30: mol_type = genomic DNA

SEQ ID NO: 49931 - DNA, 122 bp, Homo sapiens; identical to SEQ ID NO: 29069
  misc_feature 1..122: note = chr4:109092563-109092685
  misc_feature 1..122: note = hyper
  source 1..122: mol_type = genomic DNA

SEQ ID NO: 49932 - DNA, 237 bp, Homo sapiens
  misc_feature 1..237: note = chr4:109093168-109093405
  misc_feature 1..237: note = hyper
  source 1..237: mol_type = genomic DNA
aggagagacagggtagtgacccccactcacaccagaaaacccctccccccggcgattttgctgccaactcgagtcggctacagacagtccagtgagtccttaattacaaggacgagagaaaagcacggtgcccctcgagtcctctccgccccctcggtcctaacccccgcccaggctccaggtcttcccctttgtgtggcctggactctctcccagctacgactttggtgggatcca

SEQ ID NO: 49933 - DNA, 777 bp, Homo sapiens
  misc_feature 1..777: note = chr4:109093506-109094283
  misc_feature 1..777: note = hyper
  source 1..777: mol_type = genomic DNA
ctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtc

SEQ ID NO: 49934 - DNA, 55 bp, Homo sapiens; identical to SEQ ID NO: 29071
  misc_feature 1..55: note = chr4:109094529-109094584
  misc_feature 1..55: note = hyper
  source 1..55: mol_type = genomic DNA

SEQ ID NO: 49935 - DNA, 190 bp, Homo sapiens; identical to SEQ ID NO: 29072
  misc_feature 1..190: note = chr4:109683609-109683799
  misc_feature 1..190: note = hyper
  source 1..190: mol_type = genomic DNA

SEQ ID NO: 49936 - DNA, 70 bp, Homo sapiens; identical to SEQ ID NO: 7481
  misc_feature 1..70: note = chr4:109684016-109684086
  misc_feature 1..70: note = hyper
  source 1..70: mol_type = genomic DNA

SEQ ID NO: 49937 - DNA, 381 bp, Homo sapiens
  misc_feature 1..381: note = chr4:110223980-110224361
  misc_feature 1..381: note = hyper
  source 1..381: mol_type = genomic DNA
gaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatct

SEQ ID NO: 49938 - DNA, 72 bp, Homo sapiens; identical to SEQ ID NO: 29078
  misc_feature 1..72: note = chr4:111531853-111531925
  misc_feature 1..72: note = hyper
  source 1..72: mol_type = genomic DNA

SEQ ID NO: 49939 - DNA, 28 bp, Homo sapiens
  misc_feature 1..28: note = chr4:111531943-111531971
  misc_feature 1..28: note = hyper
  source 1..28: mol_type = genomic DNA
cgcgcctccccttcgtccccaggccctg

SEQ ID NO: 49940 - DNA, 77 bp, Homo sapiens; identical to SEQ ID NO: 29080
  misc_feature 1..77: note = chr4:111532245-111532322
  misc_feature 1..77: note = hyper
  source 1..77: mol_type = genomic DNA

SEQ ID NO: 49941 - DNA, 49 bp, Homo sapiens; identical to SEQ ID NO: 18540
  misc_feature 1..49: note = chr4:111532961-111533010
  misc_feature 1..49: note = hyper
  source 1..49: mol_type = genomic DNA

SEQ ID NO: 49942 - DNA, 32 bp, Homo sapiens; identical to SEQ ID NO: 29082
  misc_feature 1..32: note = chr4:111533328-111533360
  misc_feature 1..32: note = hyper
  source 1..32: mol_type = genomic DNA

SEQ ID NO: 49943 - DNA, 30 bp, Homo sapiens; identical to SEQ ID NO: 29083
  misc_feature 1..30: note = chr4:111535304-111535334
  misc_feature 1..30: note = hyper
  source 1..30: mol_type = genomic DNA

SEQ ID NO: 49944 - DNA, 40 bp, Homo sapiens
  misc_feature 1..40: note = chr4:111536248-111536288
  misc_feature 1..40: note = hyper
  source 1..40: mol_type = genomic DNA
agcgctcaaggagcacggcggcagtgcgctgaggccagtg

SEQ ID NO: 49945 - DNA, 17 bp, Homo sapiens
  misc_feature 1..17: note = chr4:111536943-111536960
  misc_feature 1..17: note = hyper
  source 1..17: mol_type = genomic DNA
gagacctaaatcctccg

SEQ ID NO: 49946 - DNA, 15 bp, Homo sapiens
  misc_feature 1..15: note = chr4:111537066-111537081
  misc_feature 1..15: note = hyper
  source 1..15: mol_type = genomic DNA
cggagaggccgggac

SEQ ID NO: 49947 - DNA, 117 bp, Homo sapiens; identical to SEQ ID NO: 29088
  misc_feature 1..117: note = chr4:111539478-111539595
  misc_feature 1..117: note = hyper
  source 1..117: mol_type = genomic DNA

SEQ ID NO: 49948 - DNA, 33 bp, Homo sapiens; identical to SEQ ID NO: 29089
  misc_feature 1..33: note = chr4:111539809-111539842
  misc_feature 1..33: note = hyper
  source 1..33: mol_type = genomic DNA

SEQ ID NO: 49949 - DNA, 13 bp, Homo sapiens
  misc_feature 1..13: note = chr4:111540186-111540199
  misc_feature 1..13: note = hyper
  source 1..13: mol_type = genomic DNA
cggggcagcaggc

SEQ ID NO: 49950 - DNA, 19 bp, Homo sapiens
  misc_feature 1..19: note = chr4:111540360-111540379
  misc_feature 1..19: note = hyper
  source 1..19: mol_type = genomic DNA
ggtacgtgctcccttaaca

SEQ ID NO: 49951 - DNA, 49 bp, Homo sapiens; identical to SEQ ID NO: 29091
  misc_feature 1..49: note = chr4:111540595-111540644
  misc_feature 1..49: note = hyper
  source 1..49: mol_type = genomic DNA

SEQ ID NO: 49952 - DNA, 30 bp, Homo sapiens; identical to SEQ ID NO: 29092
  misc_feature 1..30: note = chr4:111542950-111542980
  misc_feature 1..30: note = hyper
  source 1..30: mol_type = genomic DNA

SEQ ID NO: 49953 - DNA, 42 bp, Homo sapiens
  misc_feature 1..42: note = chr4:111543190-111543232
  misc_feature 1..42: note = hyper
  source 1..42: mol_type = genomic DNA
tgctcgcgcccttagcgccccaggagccgggccggtcgaggg

SEQ ID NO: 49954 - DNA, 211 bp, Homo sapiens
  misc_feature 1..211: note = chr4:111543450-111543661
  misc_feature 1..211: note = hyper
  source 1..211: mol_type = genomic DNA
cctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccg

SEQ ID NO: 49955 - DNA, 214 bp, Homo sapiens; identical to SEQ ID NO: 29096
  misc_feature 1..214: note = chr4:111543967-111544181
  misc_feature 1..214: note = hyper
  source 1..214: mol_type = genomic DNA

SEQ ID NO: 49956 - DNA, 83 bp, Homo sapiens; identical to SEQ ID NO: 18544
  misc_feature 1..83: note = chr4:111544298-111544381
  misc_feature 1..83: note = hyper
  source 1..83: mol_type = genomic DNA

SEQ ID NO: 49957 - DNA, 30 bp, Homo sapiens; identical to SEQ ID NO: 29098
  misc_feature 1..30: note = chr4:111549751-111549781
  misc_feature 1..30: note = hyper
  source 1..30: mol_type = genomic DNA

SEQ ID NO: 49958 - DNA, 188 bp, Homo sapiens; identical to SEQ ID NO: 29099
  misc_feature 1..188: note = chr4:111549982-111550170
  misc_feature 1..188: note = hyper
  source 1..188: mol_type = genomic DNA

SEQ ID NO: 49959 - DNA, 110 bp, Homo sapiens
  misc_feature 1..110: note = chr4:111550508-111550618
  misc_feature 1..110: note = hyper
  source 1..110: mol_type = genomic DNA
acgtagtatatgctccgcaaacattcgctgattgaatgagaggcgcgggggcggggcggcggagaggggtctgcggccgccaaggccgccagggttaacccaggtccttc

SEQ ID NO: 49960 - DNA, 15 bp, Homo sapiens
  misc_feature 1..15: note = chr4:111550834-111550849
  misc_feature 1..15: note = hyper
  source 1..15: mol_type = genomic DNA
cgcaaagccaggcgt

SEQ ID NO: 49961 - DNA, 105 bp, Homo sapiens; identical to SEQ ID NO: 18547
  misc_feature 1..105: note = chr4:111552994-111553099
  misc_feature 1..105: note = hyper
  source 1..105: mol_type = genomic DNA

SEQ ID NO: 49962 - DNA, 466 bp, Homo sapiens
  misc_feature 1..466: note = chr4:111553450-111553916
  misc_feature 1..466: note = hyper
  source 1..466: mol_type = genomic DNA
cggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgc

SEQ ID NO: 49963 - DNA, 453 bp, Homo sapiens
  misc_feature 1..453: note = chr4:111555343-111555796
  misc_feature 1..453: note = hyper
  source 1..453: mol_type = genomic DNA
ggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 49964 - DNA, 337 bp, Homo sapiens
  misc_feature 1..337: note = chr4:111557628-111557965
  misc_feature 1..337: note = hyper
  source 1..337: mol_type = genomic DNA
tgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccg

SEQ ID NO: 49965 - DNA, 394 bp, Homo sapiens
  misc_feature 1..394: note = chr4:111558049-111558443
  misc_feature 1..394: note = hyper
  source 1..394: mol_type = genomic DNA
tgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagag

SEQ ID NO: 49966 - DNA, 53 bp, Homo sapiens
  misc_feature 1..53: note = chr4:111558498-111558551
  misc_feature 1..53: note = hyper
  source 1..53: mol_type = genomic DNA
cggactcccactgtggaaaggaggaccagaagggaggatgggatggaagagaa

SEQ ID NO: 49967 - DNA, 18 bp, Homo sapiens
  misc_feature 1..18: note = chr4:111559233-111559251
  misc_feature 1..18: note = hyper
  source 1..18: mol_type = genomic DNA
tggcgaggatggtattaa

SEQ ID NO: 49968 - DNA, 30 bp, Homo sapiens; identical to SEQ ID NO: 29107
  misc_feature 1..30: note = chr4:111560186-111560216
  misc_feature 1..30: note = hyper
  source 1..30: mol_type = genomic DNA

SEQ ID NO: 49969 - DNA, 83 bp, Homo sapiens
  misc_feature 1..83: note = chr4:111560636-111560719
  misc_feature 1..83: note = hyper
  source 1..83: mol_type = genomic DNA
cctttcaggtttcagaggtttgcaaaccagggctgagaggaaggggctcgggaagctcacgttcctctcgccccccttctgtc

SEQ ID NO: 49970 - DNA, 24 bp, Homo sapiens
  misc_feature 1..24: note = chr4:111562353-111562377
  misc_feature 1..24: note = hyper
  source 1..24: mol_type = genomic DNA
atctcgcactcaaaacggagtttc

SEQ ID NO: 49971 - DNA, 85 bp, Homo sapiens
  misc_feature 1..85: note = chr4:111562491-111562576
  misc_feature 1..85: note = hyper
  source 1..85: mol_type = genomic DNA
cggtggctcaggccctttgctcggaccgggaccttacagttctaacccaggagcgttaaactctggaagactccgggccagccct

SEQ ID NO: 49972 - DNA, 42 bp, Homo sapiens
  misc_feature 1..42: note = chr4:111562648-111562690
  misc_feature 1..42: note = hyper
  source 1..42: mol_type = genomic DNA
gctatggcagtgagctttccgcgcaaacggagagctggaacc

SEQ ID NO: 49973 - DNA, 21 bp, Homo sapiens
  misc_feature 1..21: note = chr4:113430619-113430640
  misc_feature 1..21: note = hyper
  source 1..21: mol_type = genomic DNA
ctccaatttggatcccgggag

SEQ ID NO: 49974 - DNA, 25 bp, Homo sapiens
  misc_feature 1..25: note = chr4:113430672-113430697
  misc_feature 1..25: note = hyper
  source 1..25: mol_type = genomic DNA
caggctggagcgcgaagccggcgcc

SEQ ID NO: 49975 - DNA, 83 bp, Homo sapiens; identical to SEQ ID NO: 29112
  misc_feature 1..83: note = chr4:113431075-113431158
  misc_feature 1..83: note = hyper
  source 1..83: mol_type = genomic DNA

SEQ ID NO: 49976 - DNA, 111 bp, Homo sapiens
  misc_feature 1..111: note = chr4:113431723-113431834
  misc_feature 1..111: note = hyper
  source 1..111: mol_type = genomic DNA
cccaggctgggggagcgagaaaggggggtattggagccctcacgttttattggtctaacctaatttcactaattctcttttcacacatttcttttgcagattcggaggccg

SEQ ID NO: 49977 - DNA, 36 bp, Homo sapiens
  misc_feature 1..36: note = chr4:113432573-113432609
  misc_feature 1..36: note = hyper
  source 1..36: mol_type = genomic DNA
gcgccgcagcgcgctagctggcgttggaaagatcta

SEQ ID NO: 49978 - DNA, 379 bp, Homo sapiens; identical to SEQ ID NO: 18553
  misc_feature 1..379: note = chr4:113435837-113436216
  misc_feature 1..379: note = hyper
  source 1..379: mol_type = genomic DNA

SEQ ID NO: 49979 - DNA, 298 bp, Homo sapiens
  misc_feature 1..298: note = chr4:113436287-113436585
  misc_feature 1..298: note = hyper
  source 1..298: mol_type = genomic DNA
agtctacgggtcttcttgatgcgctgcaccgtctcggccgtcttggcgcctcgggagacggcccgcgcccgggaagggcgccgtttgcaatcgtgtaccagacccagcagccgtgcgggccggcagccctccgcacccgcagccacgccgccccgcgccccctgcccggcctcagccccgcgctgccgacgcgccccgcctgacgcgcccggctcctcctcctcttcttcgtcggcgctggatgacagcggggtcagggccgccaaggcgggggaggccgatccgagcagcactaaca

SEQ ID NO: 49980 - DNA, 314 bp, Homo sapiens; identical to SEQ ID NO: 29118
  misc_feature 1..314: note = chr4:113436841-113437155
  misc_feature 1..314: note = hyper
  source 1..314: mol_type = genomic DNA

SEQ ID NO: 49981 - DNA, 579 bp, Homo sapiens; identical to SEQ ID NO: 29119
  misc_feature 1..579: note = chr4:113437622-113438201
  misc_feature 1..579: note = hyper
  source 1..579: mol_type = genomic DNA

SEQ ID NO: 49982 - DNA, 198 bp, Homo sapiens; identical to SEQ ID NO: 7510
  misc_feature 1..198: note = chr4:113438506-113438704
  misc_feature 1..198: note = hyper
  source 1..198: mol_type = genomic DNA

SEQ ID NO: 49983 - DNA, 365 bp, Homo sapiens
  misc_feature 1..365: note = chr4:113441733-113442098
  misc_feature 1..365: note = hyper
  source 1..365: mol_type = genomic DNA
ctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcat

SEQ ID NO: 49984 - skipped

SEQ ID NO: 49985 - DNA, 500 bp, Homo sapiens; identical to SEQ ID NO: 29125
  misc_feature 1..500: note = chr4:113444944-113445444
  misc_feature 1..500: note = hyper
  source 1..500: mol_type = genomic DNA

SEQ ID NO: 49986 - DNA, 99 bp, Homo sapiens; identical to SEQ ID NO: 29126
  misc_feature 1..99: note = chr4:113626580-113626679
  misc_feature 1..99: note = hyper
  source 1..99: mol_type = genomic DNA

SEQ ID NO: 49987 - DNA, 53 bp, Homo sapiens; identical to SEQ ID NO: 29127
  misc_feature 1..53: note = chr4:113627418-113627471
  misc_feature 1..53: note = hyper
  source 1..53: mol_type = genomic DNA

SEQ ID NO: 49988 - DNA, 64 bp, Homo sapiens; identical to SEQ ID NO: 29128
  misc_feature 1..64: note = chr4:114900586-114900650
  misc_feature 1..64: note = hyper
  source 1..64: mol_type = genomic DNA

SEQ ID NO: 49989 - DNA, 55 bp, Homo sapiens; identical to SEQ ID NO: 29129
  misc_feature 1..55: note = chr4:115520068-115520123
  misc_feature 1..55: note = hyper
  source 1..55: mol_type = genomic DNA

SEQ ID NO: 49990 - DNA, 190 bp, Homo sapiens; identical to SEQ ID NO: 29130
  misc_feature 1..190: note = chr4:115520755-115520945
  misc_feature 1..190: note = hyper
  source 1..190: mol_type = genomic DNA

SEQ ID NO: 49991 - DNA, 51 bp, Homo sapiens; identical to SEQ ID NO: 29131
  misc_feature 1..51: note = chr4:117847235-117847286
  misc_feature 1..51: note = hyper
  source 1..51: mol_type = genomic DNA

SEQ ID NO: 49992 - DNA, 93 bp, Homo sapiens; identical to SEQ ID NO: 18560
  misc_feature 1..93: note = chr4:117847306-117847399
  misc_feature 1..93: note = hyper
  source 1..93: mol_type = genomic DNA

SEQ ID NO: 49993 - skipped

SEQ ID NO: 49994 - DNA, 21 bp, Homo sapiens
  misc_feature 1..21: note = chr4:117847469-117847490
  misc_feature 1..21: note = hyper
  source 1..21: mol_type = genomic DNA
cgggcccgctcgtcctgggac

SEQ ID NO: 49995 - DNA, 42 bp, Homo sapiens; identical to SEQ ID NO: 29134
  misc_feature 1..42: note = chr4:118955083-118955125
  misc_feature 1..42: note = hyper
  source 1..42: mol_type = genomic DNA

SEQ ID NO: 49996 - DNA, 47 bp, Homo sapiens; identical to SEQ ID NO: 29135
  misc_feature 1..47: note = chr4:118955468-118955515
  misc_feature 1..47: note = hyper
  source 1..47: mol_type = genomic DNA

SEQ ID NO: 49997 - DNA, 54 bp, Homo sapiens; identical to SEQ ID NO: 29136
  misc_feature 1..54: note = chr4:119273444-119273498
  misc_feature 1..54: note = hyper
  source 1..54: mol_type = genomic DNA

SEQ ID NO: 49998 - DNA, 66 bp, Homo sapiens; identical to SEQ ID NO: 29137
  misc_feature 1..66: note = chr4:121843230-121843296
  misc_feature 1..66: note = hyper
  source 1..66: mol_type = genomic DNA

SEQ ID NO: 49999 - DNA, 56 bp, Homo sapiens; identical to SEQ ID NO: 18563
  misc_feature 1..56: note = chr4:121844007-121844063
  misc_feature 1..56: note = hyper
  source 1..56: mol_type = genomic DNA

SEQ ID NO: 50000 - DNA, 193 bp, Homo sapiens
  misc_feature 1..193: note = chr4:121992072-121992265
  misc_feature 1..193: note = hyper
  source 1..193: mol_type = genomic DNA
gcccgcggcaaactccgaggagctgatgcggggcgggtccggggaactgccgggagctctcacgcctgggcctgggatagggtgcgggcagaaaggtgaaccgagagcgcacaatgcaacgaaaccgcactccaaattcagcagtttgcaaagtgcctccaagaaaacagctgggacctgcaatcactcgttc

SEQ ID NO: 50001 - DNA, 384 bp, Homo sapiens
  misc_feature 1..384: note = chr4:121992312-121992696
  misc_feature 1..384: note = hyper
  source 1..384: mol_type = genomic DNA
gtagcgcgggtgagagcgaaccccaactcacgcacagacaggacgagggcacgaagccgagtctcctggctggggccgtagggggcgtcacctcggtggccgctctgctctccggaagaaagtatgagccggtcccaggccacctcgctcagcccaaggaagtttctataacgatgctcgcctaccacgcagaggacaaatgaggagccagagcggttgggggtcgggccaaccgaactcccggccccggctgcgcagctcccagacgcccaccaagaactcgtgcgctgcctggacctctagcttttcgccctacacgcagacgccctctgcaaaaccccagtcccgcagactttccctagcggcgggcggagggcatgaacc

SEQ ID NO: 50002 - DNA, 280 bp, Homo sapiens; identical to SEQ ID NO: 29140
  misc_feature 1..280: note = chr4:121993436-121993716
  misc_feature 1..280: note = hyper
  source 1..280: mol_type = genomic DNA

SEQ ID NO: 50003 - skipped

SEQ ID NO: 50004 - DNA, 96 bp, Homo sapiens
  misc_feature 1..96: note = chr4:121994251-121994347
  misc_feature 1..96: note = hyper
  source 1..96: mol_type = genomic DNA
gcaaactgtgcattcatgtcccacttttcacccgaacgcctgcctatcacagccttcactcagggagcgcttccccctcggcgcagaccgagcctc

SEQ ID NO: 50005 - DNA, 154 bp, Homo sapiens
  misc_feature 1..154: note = chr4:122301962-122302116
  misc_feature 1..154: note = hyper
  source 1..154: mol_type = genomic DNA
cgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctgg

SEQ ID NO: 50006 - DNA, 92 bp, Homo sapiens
  misc_feature 1..92: note = chr4:122302246-122302338
  misc_feature 1..92: note = hyper
  source 1..92: mol_type = genomic DNA
cagcttcagtggcgccaacgccgcttccccgcaccctcagggcgagggaagacttccctggctcaccaacttgctgccgcccagcgcctttc

SEQ ID NO: 50007 - DNA, 96 bp, Homo sapiens
  misc_feature 1..96: note = chr4:122686113-122686209
  misc_feature 1..96: note = hyper
  source 1..96: mol_type = genomic DNA
cgagaggcgcccgggctggagcgccccggccgtgttggccacggagttcttcagctgcttgatgaccacgaagagcaggaggaaaagtaagaagag

SEQ ID NO: 50008 - DNA, 174 bp, Homo sapiens
  misc_feature 1..174: note = chr4:122686507-122686681
  misc_feature 1..174: note = hyper
  source 1..174: mol_type = genomic DNA
aggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaat

SEQ ID NO: 50009 - DNA, 86 bp, Homo sapiens
  misc_feature 1..86: note = chr4:122871208-122871294
  misc_feature 1..86: note = hyper
  source 1..86: mol_type = genomic DNA
gaagtgagctggtggcgctttcatcccaaaggatataccttccctccatttcctgggccgtttccattccacgcttatcttcagca

SEQ ID NO: 50010 - DNA, 239 bp, Homo sapiens; identical to SEQ ID NO: 18571
  misc_feature 1..239: note = chr4:122871334-122871573
  misc_feature 1..239: note = hyper
  source 1..239: mol_type = genomic DNA

SEQ ID NO: 50011 - DNA, 460 bp, Homo sapiens
  misc_feature 1..460: note = chr4:122872000-122872460
  misc_feature 1..460: note = hyper
  source 1..460: mol_type = genomic DNA
cccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcctccggccga

SEQ ID NO: 50012 - DNA, 497 bp, Homo sapiens; identical to SEQ ID NO: 29148
  misc_feature 1..497: note = chr4:122872667-122873164
  misc_feature 1..497: note = hyper
  source 1..497: mol_type = genomic DNA

SEQ ID NO: 50013 - DNA, 1100 bp, Homo sapiens; identical to SEQ ID NO: 29149
  misc_feature 1..1100: note = chr4:123747826-123748926
  misc_feature 1..1100: note = hyper
  source 1..1100: mol_type = genomic DNA

SEQ ID NO: 50014 - DNA, 127 bp, Homo sapiens; identical to SEQ ID NO: 29150
  misc_feature 1..127: note = chr4:124426734-124426861
  misc_feature 1..127: note = hyper
  source 1..127: mol_type = genomic DNA

SEQ ID NO: 50015 - DNA, 51 bp, Homo sapiens; identical to SEQ ID NO: 29151
  misc_feature 1..51: note = chr4:126235891-126235942
  misc_feature 1..51: note = hyper
  source 1..51: mol_type = genomic DNA

SEQ ID NO: 50016 - DNA, 30 bp, Homo sapiens; identical to SEQ ID NO: 29152
  misc_feature 1..30: note = chr4:126236943-126236973
  misc_feature 1..30: note = hyper
  source 1..30: mol_type = genomic DNA

SEQ ID NO: 50017 - DNA, 370 bp, Homo sapiens
  misc_feature 1..370: note = chr4:126237654-126238024
  misc_feature 1..370: note = hyper
  source 1..370: mol_type = genomic DNA
tactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgcca

SEQ ID NO: 50018 - DNA, 228 bp, Homo sapiens
  misc_feature 1..228: note = chr4:128544161-128544389
  misc_feature 1..228: note = hyper
  source 1..228: mol_type = genomic DNA
gctcgcgcccagcgccggagacgggctgtgtgttgggccagtggaagacaccggagaaacccagacgtggaagaccgggcagcctggacttcgcgagccctggtggggctggcggcccacagagcccccacctgccccgagctcccacagcgaggagtggccgcgccgcccgccagtgcgccgggctccgagaccggcaggggagcacgcgggcgaaggaggggccgc

SEQ ID NO: 50019 - DNA, 17 bp, Homo sapiens
  misc_feature 1..17: note = chr4:128544789-128544806
  misc_feature 1..17: note = hyper
  source 1..17: mol_type = genomic DNA
gccgttgggacctgcac

SEQ ID NO: 50020 - DNA, 91 bp, Homo sapiens
  misc_feature 1..91: note = chr4:134067790-134067881
  misc_feature 1..91: note = hyper
  source 1..91: mol_type = genomic DNA
ggaagaagaccctaccgtcactccgccggtccctggctggcgccacaaagactagaagtcggagaggcgagacctctagggggcctgggct

SEQ ID NO: 50021 - DNA, 13 bp, Homo sapiens
  misc_feature 1..13: note = chr4:134068004-134068017
  misc_feature 1..13: note = hyper
  source 1..13: mol_type = genomic DNA
cctgtaacccacg

SEQ ID NO: 50022 - DNA, 77 bp, Homo sapiens; identical to SEQ ID NO: 29158
  misc_feature 1..77: note = chr4:134068322-134068399
  misc_feature 1..77: note = hyper
  source 1..77: mol_type = genomic DNA

SEQ ID NO: 50023 - DNA, 130 bp, Homo sapiens
  misc_feature 1..130: note = chr4:134068791-134068921
  misc_feature 1..130: note = hyper
  source 1..130: mol_type = genomic DNA
ctctcagaagcacgtctcaggctactatcacgcccatggacactagccctccttaactccttgccaggaggaaatggcaacgtatctccaggtcggaaaacgactctacttttcccgcaggttgtggtgg

SEQ ID NO: 50024 - DNA, 150 bp, Homo sapiens; identical to SEQ ID NO: 29162
  misc_feature 1..150: note = chr4:134070219-134070369
  misc_feature 1..150: note = hyper
  source 1..150: mol_type = genomic DNA

SEQ ID NO: 50025 - skipped

SEQ ID NO: 50026 - DNA, 35 bp, Homo sapiens
  misc_feature 1..35: note = chr4:134070403-134070438
  misc_feature 1..35: note = hyper
  source 1..35: mol_type = genomic DNA
atgagggcgctgcgcaaaaacggagaagccgagcg

SEQ ID NO: 50027 - DNA, 596 bp, Homo sapiens
  misc_feature 1..596: note = chr4:134071052-134071648
  misc_feature 1..596: note = hyper
  source 1..596: mol_type = genomic DNA
gatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaa

SEQ ID NO: 50028 - DNA, 13 bp, Homo sapiens
  misc_feature 1..13: note = chr4:134072967-134072980
  misc_feature 1..13: note = hyper
  source 1..13: mol_type = genomic DNA
ccactgtcaacat

SEQ ID NO: 50029 - DNA, 246 bp, Homo sapiens
  misc_feature 1..246: note = chr4:134073322-134073568
  misc_feature 1..246: note = hyper
  source 1..246: mol_type = genomic DNA
tcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcct

SEQ ID NO: 50030 - DNA, 91 bp, Homo sapiens
  misc_feature 1..91: note = chr4:140201462-140201553
  misc_feature 1..91: note = hyper
  source 1..91: mol_type = genomic DNA
cctttgtagtcctcaccatcctcccctaacccatctccagctctgttgctatccctgaggtctctagagctgaccgcggcatctcagaaaa

SEQ ID NO: 50031 - DNA, 629 bp, Homo sapiens; identical to SEQ ID NO: 29170
  misc_feature 1..629: note = chr4:140655870-140656499
  misc_feature 1..629: note = hyper
  source 1..629: mol_type = genomic DNA

SEQ ID NO: 50032 - DNA, 59 bp, Homo sapiens
  misc_feature 1..59: note = chr4:140657089-140657148
  misc_feature 1..59: note = hyper
  source 1..59: mol_type = genomic DNA
ctgcggtgtgctccagcgggcgcatttcccaggccccgccacatcgtgtgtgttagtgg

SEQ ID NO: 50033 - DNA, 47 bp, Homo sapiens; identical to SEQ ID NO: 7547
  misc_feature 1..47: note = chr4:141294349-141294396
  misc_feature 1..47: note = hyper
  source 1..47: mol_type = genomic DNA

SEQ ID NO: 50034 - DNA, 218 bp, Homo sapiens; identical to SEQ ID NO: 29173
  misc_feature 1..218: note = chr4:141294633-141294851
  misc_feature 1..218: note = hyper
  source 1..218: mol_type = genomic DNA

SEQ ID NO: 50035 - DNA, 208 bp, Homo sapiens; identical to SEQ ID NO: 29174
  misc_feature 1..208: note = chr4:141295066-141295274
  misc_feature 1..208: note = hyper
  source 1..208: mol_type = genomic DNA

SEQ ID NO: 50036 - DNA, 274 bp, Homo sapiens
  misc_feature 1..274: note = chr4:141348151-141348425
  misc_feature 1..274: note = hyper
  source 1..274: mol_type = genomic DNA
ggagactgagacagccgagcctattttgatctcgtttgggtttctgtaaggagcagtcagcagagtgagcagcgcccagacgcgccccgggccccctctacaaccattgggagagcgccccgggctcaagcgtggaacggggctgcaatggcaaccgctggaataacggcctcggctcccggtggctcctcaagcccgcaggggaggccggccgggctaggcacctagctgtccccgtgctcgtccgccccagcccgggcgcagcaggtggatg

SEQ ID NO: 50037 - DNA, 54 bp, Homo sapiens
  misc_feature 1..54: note = chr4:141418867-141418921
  misc_feature 1..54: note = hyper
  source 1..54: mol_type = genomic DNA
gaaggaggaaagatgcggacagatgctggctgtgtaagagcagttcttggggtc

SEQ ID NO: 50038 - DNA, 39 bp, Homo sapiens
  misc_feature 1..39: note = chr4:141419418-141419457
  misc_feature 1..39: note = hyper
  source 1..39: mol_type = genomic DNA
gataatgccagggacggggttgagcgcgcagagccccct

SEQ ID NO: 50039 - DNA, 54 bp, Homo sapiens
  misc_feature 1..54: note = chr4:141488816-141488870
  misc_feature 1..54: note = hyper
  source 1..54: mol_type = genomic DNA
atatgaatgttttctcgccaatttgttatgaaaaccactcctctgtgtgttaca

SEQ ID NO: 50040 - DNA, 15 bp, Homo sapiens
  misc_feature 1..15: note = chr4:142053505-142053520
  misc_feature 1..15: note = hyper
  source 1..15: mol_type = genomic DNA
tggtgttggagccca

SEQ ID NO: 50041 - DNA, 505 bp, Homo sapiens
  misc_feature 1..505: note = chr4:142053734-142054239
  misc_feature 1..505: note = hyper
  source 1..505: mol_type = genomic DNA
gcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcgg

SEQ ID NO: 50042 - DNA, 214 bp, Homo sapiens
  misc_feature 1..214: note = chr4:142054460-142054674
  misc_feature 1..214: note = hyper
  source 1..214: mol_type = genomic DNA
ccgctgctgccctgcgccggttccctcaggctgcgggcgctgcgctcctgatctcgccggtggctgcgcctgggcacgcacttgccgcgggcggggcgggcttggggacagtgggagcgagcaggcagagcggagtaagcggtccgtgtgtgtgtgtctgtatgtttgtgtgtgtgtgtgtgtgtgtgtataatgtgtgcgtgcaaggaggagc

SEQ ID NO: 50043 - DNA, 169 bp, Homo sapiens
  misc_feature 1..169: note = chr4:143766930-143767099
  misc_feature 1..169: note = hyper
  source 1..169: mol_type = genomic DNA
gaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgc

SEQ ID NO: 50044 - DNA, 32 bp, Homo sapiens; identical to SEQ ID NO: 29181
  misc_feature 1..32: note = chr4:143767625-143767657
  misc_feature 1..32: note = hyper
  source 1..32: mol_type = genomic DNA

SEQ ID NO: 50045 - DNA, 358 bp, Homo sapiens; identical to SEQ ID NO: 29182
  misc_feature 1..358: note = chr4:143767920-143768278
  misc_feature 1..358: note = hyper
  source 1..358: mol_type = genomic DNA

SEQ ID NO: 50046 - DNA, 42 bp, Homo sapiens; identical to SEQ ID NO: 29183
  misc_feature 1..42: note = chr4:144480322-144480364
  misc_feature 1..42: note = hyper
  source 1..42: mol_type = genomic DNA

SEQ ID NO: 50047 - DNA, 30 bp, Homo sapiens; identical to SEQ ID NO: 29184
  misc_feature 1..30: note = chr4:144620978-144621008
  misc_feature 1..30: note = hyper
  source 1..30: mol_type = genomic DNA

SEQ ID NO: 50048 - DNA, 38 bp, Homo sapiens
  misc_feature 1..38: note = chr4:144621298-144621336
  misc_feature 1..38: note = hyper
  source 1..38: mol_type = genomic DNA
accaaaggcctgttacgcgtcaccagctccagctggga

SEQ ID NO: 50049 - DNA, 173 bp, Homo sapiens
  misc_feature 1..173: note = chr4:144622058-144622231
  misc_feature 1..173: note = hyper
  source 1..173: mol_type = genomic DNA
gctggcttctggggaccccagatacgcgcccagcgcggcgagacttagcgagggtgcagcgctgtcccctccgctcctgggcgcttcacccagcctaccttacacaccttctcgccgggagccgtggccgccgcactgctgcccgcgctgccagactccgaccagctgtctgg

SEQ ID NO: 50050 - DNA, 30 bp, Homo sapiens; identical to SEQ ID NO: 29188
  misc_feature 1..30: note = chr4:145567357-145567387
  misc_feature 1..30: note = hyper
  source 1..30: mol_type = genomic DNA

SEQ ID NO: 50051 - DNA, 127 bp, Homo sapiens; identical to SEQ ID NO: 29189
  misc_feature 1..127: note = chr4:145567810-145567937
  misc_feature 1..127: note = hyper
  source 1..127: mol_type = genomic DNA

SEQ ID NO: 50052 - DNA, 233 bp, Homo sapiens
  misc_feature 1..233: note = chr4:145568226-145568459
  misc_feature 1..233: note = hyper
  source 1..233: mol_type = genomic DNA
ataacttttctatagcgctaacgtgattccgttgtgtgttcctctggggtaagcaagtagcatttcctcccccagagtccgcggtcgggatgctgtgcaaacttgcctatctctgaaaacagacgtttctgcggtacccgcaccctgggctgggtaaatattttaaaagaatcgcgatgaacagtgtgttttggatcgaatggggcattggctgcggtgaaactgtaaattaa

SEQ ID NO: 50053 - DNA, 156 bp, Homo sapiens
  misc_feature 1..156: note = chr4:147558116-147558272
  misc_feature 1..156: note = hyper
  source 1..156: mol_type = genomic DNA
gctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggc

SEQ ID NO: 50054 - DNA, 112 bp, Homo sapiens; identical to SEQ ID NO: 18590
  misc_feature 1..112: note = chr4:147558504-147558616
  misc_feature 1..112: note = hyper
  source 1..112: mol_type = genomic DNA

SEQ ID NO: 50055 - DNA, 131 bp, Homo sapiens; identical to SEQ ID NO: 18591
  misc_feature 1..131: note = chr4:147559190-147559321
  misc_feature 1..131: note = hyper
  source 1..131: mol_type = genomic DNA

SEQ ID NO: 50056 - DNA, 18 bp, Homo sapiens
  misc_feature 1..18: note = chr4:147560915-147560933
  misc_feature 1..18: note = hyper
  source 1..18: mol_type = genomic DNA
ttgtaggcgcggcgacgg

SEQ ID NO: 50057 - DNA, 40 bp, Homo sapiens; identical to SEQ ID NO: 18592
  misc_feature 1..40: note = chr4:147562055-147562095
  misc_feature 1..40: note = hyper
  source 1..40: mol_type = genomic DNA

SEQ ID NO: 50058 - DNA, 151 bp, Homo sapiens; identical to SEQ ID NO: 29200
  misc_feature 1..151: note = chr4:147569117-147569268
  misc_feature 1..151: note = hyper
  source 1..151: mol_type = genomic DNA

SEQ ID NO: 50059 - DNA, 257 bp, Homo sapiens; identical to SEQ ID NO: 29201
  misc_feature 1..257: note = chr4:147569278-147569535
  misc_feature 1..257: note = hyper
  source 1..257: mol_type = genomic DNA

SEQ ID NO: 50060 - DNA, 30 bp, Homo sapiens; identical to SEQ ID NO: 29202
  misc_feature 1..30: note = chr4:147569897-147569927
  misc_feature 1..30: note = hyper
  source 1..30: mol_type = genomic DNA

SEQ ID NO: 50061 - DNA, 131 bp, Homo sapiens
  misc_feature 1..131: note = chr4:147576046-147576177
  misc_feature 1..131: note = hyper
  source 1..131: mol_type = genomic DNA
gcggtgacagatgagcggctgggtcaggaaggagcccagttggtggaaatgacactctttccccgctccgggtcccctcccccaccccattcgcgttttctctctcggcctctcctccctcctcgccttgc

SEQ ID NO: 50062 - DNA, 205 bp, Homo sapiens; identical to SEQ ID NO: 18594
  misc_feature 1..205: note = chr4:147576639-147576844
  misc_feature 1..205: note = hyper
  source 1..205: mol_type = genomic DNA

SEQ ID NO: 50063 - DNA, 356 bp, Homo sapiens; identical to SEQ ID NO: 29205
  misc_feature 1..356: note = chr4:148402241-148402597
  misc_feature 1..356: note = hyper
  source 1..356: mol_type = genomic DNA

SEQ ID NO: 50064 - DNA, 46 bp, Homo sapiens; identical to SEQ ID NO: 29206
  misc_feature 1..46: note = chr4:149365169-149365215
  misc_feature 1..46: note = hyper
  source 1..46: mol_type = genomic DNA

SEQ ID NO: 50065 - DNA, 139 bp, Homo sapiens; identical to SEQ ID NO: 29207
  misc_feature 1..139: note = chr4:150999450-150999589
  misc_feature 1..139: note = hyper
  source 1..139: mol_type = genomic DNA

SEQ ID NO: 50066 - DNA, 57 bp, Homo sapiens; identical to SEQ ID NO: 29208
  misc_feature 1..57: note = chr4:151000206-151000263
  misc_feature 1..57: note = hyper
  source 1..57: mol_type = genomic DNA

SEQ ID NO: 50067 - DNA, 202 bp, Homo sapiens; identical to SEQ ID NO: 29209
  misc_feature 1..202: note = chr4:154143837-154144039
  misc_feature 1..202: note = hyper
  source 1..202: mol_type = genomic DNA

SEQ ID NO: 50068 - DNA, 79 bp, Homo sapiens; identical to SEQ ID NO: 29210
  misc_feature 1..79: note = chr4:154144397-154144476
  misc_feature 1..79: note = hyper
  source 1..79: mol_type = genomic DNA

SEQ ID NO: 50069 - DNA, 195 bp, Homo sapiens; identical to SEQ ID NO: 29211
  misc_feature 1..195: note = chr4:154680759-154680954
  misc_feature 1..195: note = hyper
  source 1..195: mol_type = genomic DNA

SEQ ID NO: 50070 - DNA, 21 bp, Homo sapiens
  misc_feature 1..21: note = chr4:154681176-154681197
  misc_feature 1..21: note = hyper
  source 1..21: mol_type = genomic DNA
gggagcctcccggcacgcccc

SEQ ID NO: 50071 - DNA, 139 bp, Homo sapiens; identical to SEQ ID NO: 29213
  misc_feature 1..139: note = chr4:154681198-154681337
  misc_feature 1..139: note = hyper
  source 1..139: mol_type = genomic DNA

SEQ ID NO: 50072 - DNA, 93 bp, Homo sapiens; identical to SEQ ID NO: 29214
  misc_feature 1..93: note = chr4:154709106-154709199
  misc_feature 1..93: note = hyper
  source 1..93: mol_type = genomic DNA

SEQ ID NO: 50073 - DNA, 48 bp, Homo sapiens; identical to SEQ ID NO: 18600
  misc_feature 1..48: note = chr4:154709476-154709524
  misc_feature 1..48: note = hyper
  source 1..48: mol_type = genomic DNA

SEQ ID NO: 50074 - DNA, 169 bp, Homo sapiens
  misc_feature 1..169: note = chr4:154712003-154712172
  misc_feature 1..169: note = hyper
  source 1..169: mol_type = genomic DNA
agagctaataaagagcgtgagctctgagagatgctacgacttgggcctgggagtgggataagggccctctcgctttcacgcccccccaaccccccgccggccccggccaacccctaaatccccaacgccctccgctggggtcgcctcctccccgcagagccccttgttg

SEQ ID NO: 50075 - DNA, 117 bp, Homo sapiens
  misc_feature 1..117: note = chr4:154712594-154712711
  misc_feature 1..117: note = hyper
  source 1..117: mol_type = genomic DNA
gcccatatgagcagcgcagggatgggacactgggtgcccatcccagcgcgcctccccagactggtccctgggatgctcacacgtggcgcggcaccgcggcggcgccttcacgaaccc

SEQ ID NO: 50076 - DNA, 257 bp, Homo sapiens; identical to SEQ ID NO: 29221
  misc_feature 1..257: note = chr4:154713532-154713789
  misc_feature 1..257: note = hyper
  source 1..257: mol_type = genomic DNA

SEQ ID NO: 50077 - DNA, 159 bp, Homo sapiens
  misc_feature 1..159: note = chr4:154713790-154713949
  misc_feature 1..159: note = hyper
  source 1..159: mol_type = genomic DNA
aggggtggggggatgacctcattccttcgcctttggccctccctctacccggccccacaacgaggacgcccctgcagctggctgggccgcttcctcttgccacgcggggggacctgtgcccgcggccgtgcacctccgtgtacgcttctgctcctcgga

SEQ ID NO: 50078 - DNA, 119 bp, Homo sapiens
  misc_feature 1..119: note = chr4:155254047-155254166
  misc_feature 1..119: note = hyper
  source 1..119: mol_type = genomic DNA
cagcatttgtgtcatcggtgagagagactcactgacttccacttgatagaccaaatgttcgaaagtccaggatgggctgtgttcgcgtttctcgataacgactgtcagcaccagcaggg

SEQ ID NO: 50079 - DNA, 134 bp, Homo sapiens
  misc_feature 1..134: note = chr4:155254196-155254330
  misc_feature 1..134: note = hyper
  source 1..134: mol_type = genomic DNA
ccctgagagtcagcgtgagctcccgctgctcgcccgcgcccaggctgccgttgaggaacagcacccccagggctctgtcgatggcaaagacgcctggctgcgggctggcgatggagtaccggatgagtccgttc

SEQ ID NO: 50080 - DNA, 56 bp, Homo sapiens; identical to SEQ ID NO: 7579
  misc_feature 1..56: note = chr4:155411438-155411494
  misc_feature 1..56: note = hyper
  source 1..56: mol_type = genomic DNA

SEQ ID NO: 50081 - DNA, 164 bp, Homo sapiens
  misc_feature 1..164: note = chr4:155412279-155412443
  misc_feature 1..164: note = hyper
  source 1..164: mol_type = genomic DNA
cccctcatctacggaaagggtgaggttgaacaactgggcagaggagcccgaggccgcccacagccacacgtgcaccaagagccagagcagggagcgctgcgtcctggcgccgctgctgcctgaccgcccatggggtgtatctctcctcccggggagcagaagga

SEQ ID NO: 50082 - DNA, 185 bp, Homo sapiens; identical to SEQ ID NO: 29226
  misc_feature 1..185: note = chr4:155413374-155413559
  misc_feature 1..185: note = hyper
  source 1..185: mol_type = genomic DNA

SEQ ID NO: 50083 - DNA, 258 bp, Homo sapiens; identical to SEQ ID NO: 29227
  misc_feature 1..258: note = chr4:155548046-155548304
  misc_feature 1..258: note = hyper
  source 1..258: mol_type = genomic DNA

SEQ ID NO: 50084 - DNA, 274 bp, Homo sapiens
  misc_feature 1..274: note = chr4:155663647-155663921
  misc_feature 1..274: note = hyper
  source 1..274: mol_type = genomic DNA
atgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagt

SEQ ID NO: 50085 - DNA, 110 bp, Homo sapiens; identical to SEQ ID NO: 7583
  misc_feature 1..110: note = chr4:155664194-155664304
  misc_feature 1..110: note = hyper
  source 1..110: mol_type = genomic DNA

SEQ ID NO: 50086 - DNA, 60 bp, Homo sapiens; identical to SEQ ID NO: 18608
  misc_feature 1..60: note = chr4:155665385-155665445
  misc_feature 1..60: note = hyper
  source 1..60: mol_type = genomic DNA

SEQ ID NO: 50087 - DNA, 57 bp, Homo sapiens; identical to SEQ ID NO: 29231
  misc_feature 1..57: note = chr4:155665721-155665778
  misc_feature 1..57: note = hyper
  source 1..57: mol_type = genomic DNA

SEQ ID NO: 50088 - DNA, 159 bp, Homo sapiens; identical to SEQ ID NO: 29232
  misc_feature 1..159: note = chr4:156129228-156129387
  misc_feature 1..159: note = hyper
  source 1..159: mol_type = genomic DNA

SEQ ID NO: 50089 - skipped

SEQ ID NO: 50090 - DNA, 251 bp, Homo sapiens
  misc_feature 1..251: note = chr4:156129495-156129746
  misc_feature 1..251: note = hyper
  source 1..251: mol_type = genomic DNA
ccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctggg

SEQ ID NO: 50091 - DNA, 250 bp, Homo sapiens; identical to SEQ ID NO: 18611
  misc_feature 1..250: note = chr4:156129797-156130047
  misc_feature 1..250: note = hyper
  source 1..250: mol_type = genomic DNA

SEQ ID NO: 50092 - DNA, 29 bp, Homo sapiens
  misc_feature 1..29: note = chr4:156297387-156297416
  misc_feature 1..29: note = hyper
  source 1..29: mol_type = genomic DNA
cttcaaaataagtcacgtcttatttaaaa

SEQ ID NO: 50093 - DNA, 30 bp, Homo sapiens; identical to SEQ ID NO: 29236
  misc_feature 1..30: note = chr4:156588105-156588135
  misc_feature 1..30: note = hyper
  source 1..30: mol_type = genomic DNA

SEQ ID NO: 50094 - DNA, 227 bp, Homo sapiens; identical to SEQ ID NO: 29237
  misc_feature 1..227: note = chr4:156588456-156588683
  misc_feature 1..227: note = hyper
  source 1..227: mol_type = genomic DNA

SEQ ID NO: 50095 - DNA, 355 bp, Homo sapiens; identical to SEQ ID NO: 29238
  misc_feature 1..355: note = chr4:156588684-156589039
  misc_feature 1..355: note = hyper
  source 1..355: mol_type = genomic DNA

SEQ ID NO: 50096 - DNA, 69 bp, Homo sapiens; identical to SEQ ID NO: 29239
  misc_feature 1..69: note = chr4:156589040-156589109
  misc_feature 1..69: note = hyper
  source 1..69: mol_type = genomic DNA

SEQ ID NO: 50097 - DNA, 70 bp, Homo sapiens; identical to SEQ ID NO: 7591
  misc_feature 1..70: note = chr4:156680699-156680769
  misc_feature 1..70: note = hyper
  source 1..70: mol_type = genomic DNA

SEQ ID NO: 50098 - DNA, 200 bp, Homo sapiens; identical to SEQ ID NO: 7592
  misc_feature 1..200: note = chr4:156680770-156680970
  misc_feature 1..200: note = hyper
  source 1..200: mol_type = genomic DNA

SEQ ID NO: 50099 - DNA, 130 bp, Homo sapiens; identical to SEQ ID NO: 29243
  misc_feature 1..130: note = chr4:156681218-156681348
  misc_feature 1..130: note = hyper
  source 1..130: mol_type = genomic DNA

SEQ ID NO: 50100 - DNA, 41 bp, Homo sapiens; identical to SEQ ID NO: 29244
  misc_feature 1..41: note = chr4:157892721-157892762
  misc_feature 1..41: note = hyper
  source 1..41: mol_type = genomic DNA

SEQ ID NO: 50101 - DNA, 49 bp, Homo sapiens; identical to SEQ ID NO: 29245
  misc_feature 1..49: note = chr4:157997406-157997455
  misc_feature 1..49: note = hyper
  source 1..49: mol_type = genomic DNA

SEQ ID NO: 50102 - DNA, 30 bp, Homo sapiens; identical to SEQ ID NO: 29247
  misc_feature 1..30: note = chr4:158141957-158141987
  misc_feature 1..30: note = hyper
  source 1..30: mol_type = genomic DNA

SEQ ID NO: 50103 - DNA, 25 bp, Homo sapiens
  misc_feature 1..25: note = chr4:158142822-158142847
  misc_feature 1..25: note = hyper
  source 1..25: mol_type = genomic DNA
gctatttcctaggggcgccgatcaa

SEQ ID NO: 50104 - DNA, 24 bp, Homo sapiens
  misc_feature 1..24: note = chr4:158142999-158143023
  misc_feature 1..24: note = hyper
  source 1..24: mol_type = genomic DNA
gaaggccagcgagtgtgagtgtgt

SEQ ID NO: 50105 - DNA, 74 bp, Homo sapiens; identical to SEQ ID NO: 18617
  misc_feature 1..74: note = chr4:158143369-158143443
  misc_feature 1..74: note = hyper
  source 1..74: mol_type = genomic DNA

SEQ ID NO: 50106 - skipped

SEQ ID NO: 50107 - DNA, 30 bp, Homo sapiens; identical to SEQ ID NO: 7595
  misc_feature 1..30: note = chr4:158144242-158144272
  misc_feature 1..30: note = hyper
  source 1..30: mol_type = genomic DNA

SEQ ID NO: 50108 - DNA, 25 bp, Homo sapiens
  misc_feature 1..25: note = chr4:164252966-164252991
  misc_feature 1..25: note = hyper
  source 1..25: mol_type = genomic DNA
gcttcgggtgtctatcggggcgcag

SEQ ID NO: 50109 - DNA, 30 bp, Homo sapiens; identical to SEQ ID NO: 29254
  misc_feature 1..30: note = chr4:164253751-164253781
  misc_feature 1..30: note = hyper
  source 1..30: mol_type = genomic DNA

SEQ ID NO: 50110 - DNA, 183 bp, Homo sapiens; identical to SEQ ID NO: 29255
  misc_feature 1..183: note = chr4:164264670-164264853
  misc_feature 1..183: note = hyper
  source 1..183: mol_type = genomic DNA

SEQ ID NO: 50111 - DNA, 250 bp, Homo sapiens; identical to SEQ ID NO: 29256
  misc_feature 1..250: note = chr4:164265192-164265442
  misc_feature 1..250: note = hyper
  source 1..250: mol_type = genomic DNA

SEQ ID NO: 50112 - DNA, 297 bp, Homo sapiens; identical to SEQ ID NO: 29257
  misc_feature 1..297: note = chr4:164265443-164265740
  misc_feature 1..297: note = hyper
  source 1..297: mol_type = genomic DNA

SEQ ID NO: 50113 - DNA, 58 bp, Homo sapiens
  misc_feature 1..58: note = chr4:165304457-165304515
  misc_feature 1..58: note = hyper
  source 1..58: mol_type = genomic DNA
cagttgcagtgaacccgactcagggttgagcgcatcagcgctaaacccaagacaaagg

SEQ ID NO: 50114 - DNA, 446 bp, Homo sapiens
  misc_feature 1..446: note = chr4:165304578-165305024
  misc_feature 1..446: note = hyper
  source 1..446: mol_type = genomic DNA
cacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccgg

SEQ ID NO: 50115 - DNA, 27 bp, Homo sapiens
  misc_feature 1..27: note = chr4:165305163-165305190
  misc_feature 1..27: note = hyper
  source 1..27: mol_type = genomic DNA
ccggctctggctcggctccccagtcct

SEQ ID NO: 50116 - DNA, 492 bp, Homo sapiens; identical to SEQ ID NO: 29260
  misc_feature 1..492: note = chr4:166299918-166300410
  misc_feature 1..492: note = hyper
  source 1..492: mol_type = genomic DNA

SEQ ID NO: 50117 - DNA, 71 bp, Homo sapiens; identical to SEQ ID NO: 29261
  misc_feature 1..71: note = chr4:166793784-166793855
  misc_feature 1..71: note = hyper
  source 1..71: mol_type = genomic DNA

SEQ ID NO: 50118 - DNA, 74 bp, Homo sapiens; identical to SEQ ID NO: 18627
  misc_feature 1..74: note = chr4:166794697-166794771
  misc_feature 1..74: note = hyper
  source 1..74: mol_type = genomic DNA

SEQ ID NO: 50119 - DNA, 254 bp, Homo sapiens; identical to SEQ ID NO: 18628
  misc_feature 1..254: note = chr4:166794909-166795163
  misc_feature 1..254: note = hyper
  source 1..254: mol_type = genomic DNA

SEQ ID NO: 50120 - DNA, 32 bp, Homo sapiens; identical to SEQ ID NO: 29263
  misc_feature 1..32: note = chr4:166795606-166795638
  misc_feature 1..32: note = hyper
  source 1..32: mol_type = genomic DNA

SEQ ID NO: 50121 - DNA, 64 bp, Homo sapiens
  misc_feature 1..64: note = chr4:166796212-166796276
  misc_feature 1..64: note = hyper
  source 1..64: mol_type = genomic DNA
gtaaaggttgcatggtggttggggctaacctagcagagcggtttgtaagcggaaggcacgttag

SEQ ID NO: 50122 - DNA, 239 bp, Homo sapiens; identical to SEQ ID NO: 18630
  misc_feature 1..239: note = chr4:168155269-168155508
  misc_feature 1..239: note = hyper
  source 1..239: mol_type = genomic DNA

SEQ ID NO: 50123 - DNA, 72 bp, Homo sapiens; identical to SEQ ID NO: 29267
  misc_feature 1..72: note = chr4:168155795-168155867
  misc_feature 1..72: note = hyper
  source 1..72: mol_type = genomic DNA

SEQ ID NO: 50124 - DNA, 443 bp, Homo sapiens; identical to SEQ ID NO: 29268
  misc_feature 1..443: note = chr4:170947424-170947867
  misc_feature 1..443: note = hyper
  source 1..443: mol_type = genomic DNA

SEQ ID NO: 50125 - DNA, 552 bp, Homo sapiens; identical to SEQ ID NO: 29269
  misc_feature 1..552: note = chr4:172733596-172734148
  misc_feature 1..552: note = hyper
  source 1..552: mol_type = genomic DNA

SEQ ID NO: 50126 - DNA, 73 bp, Homo sapiens; identical to SEQ ID NO: 18632
  misc_feature 1..73: note = chr4:172734203-172734276
  misc_feature 1..73: note = hyper
  source 1..73: mol_type = genomic DNA

SEQ ID NO: 50127 - DNA, 115 bp, Homo sapiens; identical to SEQ ID NO: 404
  misc_feature 1..115: note = chr4:172734277-172734392
  misc_feature 1..115: note = hyper
  source 1..115: mol_type = genomic DNA

SEQ ID NO: 50128 - DNA, 15 bp, Homo sapiens
  misc_feature 1..15: note = chr4:172734845-172734860
  misc_feature 1..15: note = hyper
  source 1..15: mol_type = genomic DNA
gattgatgggcagag

SEQ ID NO: 50129 - DNA, 185 bp, Homo sapiens; identical to SEQ ID NO: 29274
  misc_feature 1..185: note = chr4:172735016-172735201
  misc_feature 1..185: note = hyper
  source 1..185: mol_type = genomic DNA

SEQ ID NO: 50130 - DNA, 10 bp, Homo sapiens
  misc_feature 1..10: note = chr4:174429648-174429658
  misc_feature 1..10: note = hyper
  source 1..10: mol_type = genomic DNA
cggacctctg

SEQ ID NO: 50131 - DNA, 77 bp, Homo sapiens
  misc_feature 1..77: note = chr4:174430233-174430310
  misc_feature 1..77: note = hyper
  source 1..77: mol_type = genomic DNA
tattattccacttcacgagtactaaggaggagtccagaattggtggccgtcctccctcttgttttctcatgcaaata

SEQ ID NO: 50132 - DNA, 78 bp, Homo sapiens
  misc_feature 1..78: note = chr4:174431072-174431150
  misc_feature 1..78: note = hyper
  source 1..78: mol_type = genomic DNA
ctttctggccctcatttcccctgcttctcactttagttcactgctgttttaaaaattcatatgcgggctcatttaaaa

SEQ ID NO: 50133 - DNA, 498 bp, Homo sapiens; identical to SEQ ID NO: 29278
  misc_feature 1..498: note = chr4:174437937-174438435
  misc_feature 1..498: note = hyper
  source 1..498: mol_type = genomic DNA

SEQ ID NO: 50134 - DNA, 91 bp, Homo sapiens
  misc_feature 1..91: note = chr4:174440257-174440348
  misc_feature 1..91: note = hyper
  source 1..91: mol_type = genomic DNA
cagaggaggagtaaatgcagagaaaaaatagaggaaggaataaaaaaaaaaacaaaacaaaaacacgtaacatacacgcactcaaaaccaa

SEQ ID NO: 50135 - DNA, 47 bp, Homo sapiens
  misc_feature 1..47: note = chr4:174440713-174440760
  misc_feature 1..47: note = hyper
  source 1..47: mol_type = genomic DNA
ggctgatgtcattgctctcacaagatcataaacgtaaaagagtcatc

SEQ ID NO: 50136 - DNA, 12 bp, Homo sapiens
  misc_feature 1..12: note = chr4:174443551-174443563
  misc_feature 1..12: note = hyper
  source 1..12: mol_type = genomic DNA
agatgtccctaa

SEQ ID NO: 50137 - DNA, 139 bp, Homo sapiens
  misc_feature 1..139: note = chr4:174443934-174444073
  misc_feature 1..139: note = hyper
  source 1..139: mol_type = genomic DNA
ggcccccggaaacgtgggattggtttcctctcccggagttctcccctcccccttctttctaaacatttaaaaaacacgtagtccgtctcccccaacccccattcccggtagacttaatcccaacagcaattcattgcac

SEQ ID NO: 50138 - DNA, 155 bp, Homo sapiens; identical to SEQ ID NO: 29283
  misc_feature 1..155: note = chr4:174448460-174448615
  misc_feature 1..155: note = hyper
  source 1..155: mol_type = genomic DNA

SEQ ID NO: 50139 - DNA, 38 bp, Homo sapiens; identical to SEQ ID NO: 29284
  misc_feature 1..38: note = chr4:174449624-174449662
  misc_feature 1..38: note = hyper
  source 1..38: mol_type = genomic DNA

SEQ ID NO: 50140 - DNA, 17 bp, Homo sapiens
  misc_feature 1..17: note = chr4:174449933-174449950
  misc_feature 1..17: note = hyper
  source 1..17: mol_type = genomic DNA
tgccttgaaggcctccg

SEQ ID NO: 50141 - DNA, 127 bp, Homo sapiens
  misc_feature 1..127: note = chr4:174451728-174451855
  misc_feature 1..127: note = hyper
  source 1..127: mol_type = genomic DNA
aagaaagaaagaaaacgcaggtattgcttttcgaagtgctttgtaggtaatcgaggtaagaaaatatacgcaggcagcctcttacaattttatgcaggggcgccgggagcctcgtgacgggcggtgg

SEQ ID NO: 50142 - DNA, 75 bp, Homo sapiens
  misc_feature 1..75: note = chr4:174452098-174452173
  misc_feature 1..75: note = hyper
  source 1..75: mol_type = genomic DNA
ttatttccacatccttcagggacaccagtccctacgaagaccttgggcgattttgaagtgcgggcacctcgattc

SEQ ID NO: 50143 - DNA, 61 bp, Homo sapiens; identical to SEQ ID NO: 29289
  misc_feature 1..61: note = chr4:174452696-174452757
  misc_feature 1..61: note = hyper
  source 1..61: mol_type = genomic DNA

SEQ ID NO: 50144 - DNA, 144 bp, Homo sapiens; identical to SEQ ID NO: 29292
  misc_feature 1..144: note = chr4:174459923-174460067
  misc_feature 1..144: note = hyper
  source 1..144: mol_type = genomic DNA

SEQ ID NO: 50145 - DNA, 29 bp, Homo sapiens
  misc_feature 1..29: note = chr4:175134868-175134897
  misc_feature 1..29: note = hyper
  source 1..29: mol_type = genomic DNA
cctctgggtccttaccgaaagggaaggtc

SEQ ID NO: 50146 - DNA, 38 bp, Homo sapiens
  misc_feature 1..38: note = chr4:175135672-175135710
  misc_feature 1..38: note = hyper
  source 1..38: mol_type = genomic DNA
gcggcagtgaggctgggtggtttcgcccccctcatccc

SEQ ID NO: 50147 - DNA, 131 bp, Homo sapiens; identical to SEQ ID NO: 29296
  misc_feature 1..131: note = chr4:175136030-175136161
  misc_feature 1..131: note = hyper
  source 1..131: mol_type = genomic DNA

SEQ ID NO: 50148 - DNA, 30 bp, Homo sapiens; identical to SEQ ID NO: 7627
  misc_feature 1..30: note = chr4:175137723-175137753
  misc_feature 1..30: note = hyper
  source 1..30: mol_type = genomic DNA

SEQ ID NO: 50149 - DNA, 418 bp, Homo sapiens
  misc_feature 1..418: note = chr4:175138546-175138964
  misc_feature 1..418: note = hyper
  source 1..418: mol_type = genomic DNA
ggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagcc

SEQ ID NO: 50150 - DNA, 305 bp, Homo sapiens
  misc_feature 1..305: note = chr4:175139254-175139559
  misc_feature 1..305: note = hyper
  source 1..305: mol_type = genomic DNA
tgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgcca

SEQ ID NO: 50151 - DNA, 30 bp, Homo sapiens; identical to SEQ ID NO: 29299
  misc_feature 1..30: note = chr4:175749823-175749853
  misc_feature 1..30: note = hyper
  source 1..30: mol_type = genomic DNA

SEQ ID NO: 50152 - DNA, 192 bp, Homo sapiens; identical to SEQ ID NO: 18643
  misc_feature 1..192: note = chr4:175750264-175750456
  misc_feature 1..192: note = hyper
  source 1..192: mol_type = genomic DNA

SEQ ID NO: 50153 - DNA, 15 bp, Homo sapiens
  misc_feature 1..15: note = chr4:176922653-176922668
  misc_feature 1..15: note = hyper
  source 1..15: mol_type = genomic DNA
gttcttcctcccctc

SEQ ID NO: 50154 - DNA, 50 bp, Homo sapiens; identical to SEQ ID NO: 29302
  misc_feature 1..50: note = chr4:176922729-176922779
  misc_feature 1..50: note = hyper
  source 1..50: mol_type = genomic DNA

SEQ ID NO: 50155 - DNA, 301 bp, Homo sapiens; identical to SEQ ID NO: 29303
  misc_feature 1..301: note = chr4:176922780-176923081
  misc_feature 1..301: note = hyper
  source 1..301: mol_type = genomic DNA

SEQ ID NO: 50156 - DNA, 342 bp, Homo sapiens
  misc_feature 1..342: note = chr4:176923082-176923424
  misc_feature 1..342: note = hyper
  source 1..342: mol_type = genomic DNA
ctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcct

SEQ ID NO: 50157 - DNA, 85 bp, Homo sapiens; identical to SEQ ID NO: 18647
  misc_feature 1..85: note = chr4:176923558-176923643
  misc_feature 1..85: note = hyper
  source 1..85: mol_type = genomic DNA

SEQ ID NO: 50158 - DNA, 124 bp, Homo sapiens; identical to SEQ ID NO: 2495
  misc_feature 1..124: note = chr4:176987050-176987174
  misc_feature 1..124: note = hyper
  source 1..124: mol_type = genomic DNA

SEQ ID NO: 50159 - skipped

SEQ ID NO: 50160 - DNA, 107 bp, Homo sapiens; identical to SEQ ID NO: 2497
  misc_feature 1..107: note = chr4:176987206-176987313
  misc_feature 1..107: note = hyper
  source 1..107: mol_type = genomic DNA

SEQ ID NO: 50161 - DNA, 10 bp, Homo sapiens
  misc_feature 1..10: note = chr4:176987314-176987324
  misc_feature 1..10: note = hyper
  source 1..10: mol_type = genomic DNA
agaggggctc

SEQ ID NO: 50162 - DNA, 614 bp, Homo sapiens; identical to SEQ ID NO: 29310
  misc_feature 1..614: note = chr4:177713605-177714219
  misc_feature 1..614: note = hyper
  source 1..614: mol_type = genomic DNA

SEQ ID NO: 50163 - DNA, 327 bp, Homo sapiens
  misc_feature 1..327: note = chr4:180979300-180979627
  misc_feature 1..327: note = hyper
  source 1..327: mol_type = genomic DNA
aggtgggtctggagtgtcacgtaggcaccccaactcgcgccgggggccgtggtccgcagactcccacttcattgccccggaggcctgagcccgccccgcccggctgtggctgcacctttcccgagagtcggggcagcggcggctcgaaagtggaggcagcctaaccgcgtagcgctgaaaccaccattcacaaatgcaaacccctgtcttctgtggataaacggtggcggcgcgcgtccgagcgtccccgaggggctgtggggagcccccggggagagcaggaaaggaagcggggtggcggtggctaggaagcgactgagccttctc

SEQ ID NO: 50164 - DNA, 19 bp, Homo sapiens
  misc_feature 1..19: note = chr4:180980278-180980297
  misc_feature 1..19: note = hyper
  source 1..19: mol_type = genomic DNA
gcgcctttggcgaggcggc

SEQ ID NO: 50165 - DNA, 91 bp, Homo sapiens; identical to SEQ ID NO: 7642
  misc_feature 1..91: note = chr4:183062455-183062546
  misc_feature 1..91: note = hyper
  source 1..91: mol_type = genomic DNA

SEQ ID NO: 50166 - DNA, 23 bp, Homo sapiens
  misc_feature 1..23: note = chr4:183063950-183063973
  misc_feature 1..23: note = hyper
  source 1..23: mol_type = genomic DNA
cactcactcggcagccccaagca

SEQ ID NO: 50167 - DNA, 219 bp, Homo sapiens
  misc_feature 1..219: note = chr4:183064655-183064874
  misc_feature 1..219: note = hyper
  source 1..219: mol_type = genomic DNA
ctgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgt

SEQ ID NO: 50168 - DNA, 527 bp, Homo sapiens
  misc_feature 1..527: note = chr4:183064966-183065493
  misc_feature 1..527: note = hyper
  source 1..527: mol_type = genomic DNA
atcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacct

SEQ ID NO: 50169 - DNA, 297 bp, Homo sapiens; identical to SEQ ID NO: 29316
  misc_feature 1..297: note = chr4:183369261-183369558
  misc_feature 1..297: note = hyper
  source 1..297: mol_type = genomic DNA

SEQ ID NO: 50170 - DNA, 37 bp, Homo sapiens; identical to SEQ ID NO: 29317
  misc_feature 1..37: note = chr4:183369966-183370003
  misc_feature 1..37: note = hyper
  source 1..37: mol_type = genomic DNA

SEQ ID NO: 50171 - DNA, 40 bp, Homo sapiens; identical to SEQ ID NO: 29318
  misc_feature 1..40: note = chr4:183727758-183727798
  misc_feature 1..40: note = hyper
  source 1..40: mol_type = genomic DNA

SEQ ID NO: 50172 - DNA, 30 bp, Homo sapiens; identical to SEQ ID NO: 29320
  misc_feature 1..30: note = chr4:184019532-184019562
  misc_feature 1..30: note = hyper
  source 1..30: mol_type = genomic DNA

SEQ ID NO: 50173 - skipped

SEQ ID NO: 50174 - DNA, 156 bp, Homo sapiens; identical to SEQ ID NO: 29322
  misc_feature 1..156: note = chr4:184020571-184020727
  misc_feature 1..156: note = hyper
  source 1..156: mol_type = genomic DNA

SEQ ID NO: 50175 - DNA, 75 bp, Homo sapiens; identical to SEQ ID NO: 29323
  misc_feature 1..75: note = chr4:184021203-184021278
  misc_feature 1..75: note = hyper
  source 1..75: mol_type = genomic DNA

SEQ ID NO: 50176 - DNA, 61 bp, Homo sapiens
  misc_feature 1..61: note = chr4:184718199-184718260
  misc_feature 1..61: note = hyper
  source 1..61: mol_type = genomic DNA
tcattaaccagtcagcgaatccacttgttccagcgagaggtgggaggtgggggcaggggtg

SEQ ID NO: 50177 - DNA, 63 bp, Homo sapiens
  misc_feature 1..63: note = chr4:184718352-184718415
  misc_feature 1..63: note = hyper
  source 1..63: mol_type = genomic DNA
ctcgaggcccaacacccaaaggctcacccctaggccatccgcgctccccgaccacctccctca

SEQ ID NO: 50178 - DNA, 100 bp, Homo sapiens; identical to SEQ ID NO: 29325
  misc_feature 1..100: note = chr4:184718735-184718835
  misc_feature 1..100: note = hyper
  source 1..100: mol_type = genomic DNA

SEQ ID NO: 50179 - DNA, 154 bp, Homo sapiens; identical to SEQ ID NO: 29326
  misc_feature 1..154: note = chr4:184719233-184719387
  misc_feature 1..154: note = hyper
  source 1..154: mol_type = genomic DNA

SEQ ID NO: 50180 - DNA, 74 bp, Homo sapiens; identical to SEQ ID NO: 29328
  misc_feature 1..74: note = chr4:184826583-184826657
  misc_feature 1..74: note = hyper
  source 1..74: mol_type = genomic DNA

SEQ ID NO: 50181 - DNA, 56 bp, Homo sapiens; identical to SEQ ID NO: 29330
  misc_feature 1..56: note = chr4:184827574-184827630
  misc_feature 1..56: note = hyper
  source 1..56: mol_type = genomic DNA

SEQ ID NO: 50182 - DNA, 54 bp, Homo sapiens
  misc_feature 1..54: note = chr4:185089642-185089696
  misc_feature 1..54: note = hyper
  source 1..54: mol_type = genomic DNA
gctggaagctttgcacgggggtgaaagttacaggcagacactgcccgcggggct

SEQ ID NO: 50183 - DNA, 95 bp, Homo sapiens
  misc_feature 1..95: note = chr4:185937889-185937984
  misc_feature 1..95: note = hyper
  source 1..95: mol_type = genomic DNA
caggcctggctctgcgccctgaggctcccaggtcccaccagctagaagagcgccgcctacccacccctgccaaggtctaacgaccccaagggggg

SEQ ID NO: 50184 - DNA, 267 bp, Homo sapiens
  misc_feature 1..267: note = chr4:185938230-185938497
  misc_feature 1..267: note = hyper
  source 1..267: mol_type = genomic DNA
ggcagcaagtgtgagcgaggcccgtcctgggggaggtggcctctggccgcggggccaggttgccctcagaggcgcaggcggccaagagagttcccagccgccgccgcccccctccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattga

SEQ ID NO: 50185 - DNA, 182 bp, Homo sapiens
  misc_feature 1..182: note = chr4:185938564-185938746
  misc_feature 1..182: note = hyper
  source 1..182: mol_type = genomic DNA
aaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgtctccacttgggc

SEQ ID NO: 50186 - DNA, 212 bp, Homo sapiens; identical to SEQ ID NO: 7652
  misc_feature 1..212: note = chr4:185939694-185939906
  misc_feature 1..212: note = hyper
  source 1..212: mol_type = genomic DNA

SEQ ID NO: 50187 - DNA, 44 bp, Homo sapiens; identical to SEQ ID NO: 18661
  misc_feature 1..44: note = chr4:185940294-185940338
  misc_feature 1..44: note = hyper
  source 1..44: mol_type = genomic DNA

SEQ ID NO: 50188 - DNA, 30 bp, Homo sapiens; identical to SEQ ID NO: 29337
  misc_feature 1..30: note = chr4:185941006-185941036
  misc_feature 1..30: note = hyper
  source 1..30: mol_type = genomic DNA

SEQ ID NO: 50189 - DNA, 25 bp, Homo sapiens
  misc_feature 1..25: note = chr4:185941560-185941585
  misc_feature 1..25: note = hyper
  source 1..25: mol_type = genomic DNA
ttgcagtccaaggcccgcctgggcg

SEQ ID NO: 50190 - DNA, 174 bp, Homo sapiens; identical to SEQ ID NO: 18663
  misc_feature 1..174: note = chr4:185942760-185942934
  misc_feature 1..174: note = hyper
  source 1..174: mol_type = genomic DNA

SEQ ID NO: 50191 - DNA, 225 bp, Homo sapiens; identical to SEQ ID NO: 29340
  misc_feature 1..225: note = chr4:186048748-186048973
  misc_feature 1..225: note = hyper
  source 1..225: mol_type = genomic DNA

SEQ ID NO: 50192 - DNA, 561 bp, Homo sapiens; identical to SEQ ID NO: 29341
  misc_feature 1..561: note = chr4:186049504-186050065
  misc_feature 1..561: note = hyper
  source 1..561: mol_type = genomic DNA

SEQ ID NO: 50193 - DNA, 214 bp, Homo sapiens; identical to SEQ ID NO: 29342
  misc_feature 1..214: note = chr4:186456012-186456226
  misc_feature 1..214: note = hyper
  source 1..214: mol_type = genomic DNA

SEQ ID NO: 50194 - DNA, 34 bp, Homo sapiens; identical to SEQ ID NO: 29343
  misc_feature 1..34: note = chr4:186456784-186456818
  misc_feature 1..34: note = hyper
  source 1..34: mol_type = genomic DNA

SEQ ID NO: 50195 - DNA, 163 bp, Homo sapiens; identical to SEQ ID NO: 29344
  misc_feature 1..163: note = chr4:187026723-187026886
  misc_feature 1..163: note = hyper
  source 1..163: mol_type = genomic DNA

SEQ ID NO: 50196 - DNA, 31 bp, Homo sapiens; identical to SEQ ID NO: 29345
  misc_feature 1..31: note = chr5:53156-53187
  misc_feature 1..31: note = hyper
  source 1..31: mol_type = genomic DNA

SEQ ID NO: 50197 - DNA, 116 bp, Homo sapiens; identical to SEQ ID NO: 29346
  misc_feature 1..116: note = chr5:53500-53616
  misc_feature 1..116: note = hyper
  source 1..116: mol_type = genomic DNA

SEQ ID NO: 50198-50199 - skipped (2 entries)

SEQ ID NO: 50200 - DNA, 42 bp, Homo sapiens; identical to SEQ ID NO: 29349
  misc_feature 1..42: note = chr5:54390-54432
  misc_feature 1..42: note = hyper
  source 1..42: mol_type = genomic DNA

SEQ ID NO: 50201 - DNA, 229 bp, Homo sapiens; identical to SEQ ID NO: 29350
  misc_feature 1..229: note = chr5:91895-92124
  misc_feature 1..229: note = hyper
  source 1..229: mol_type = genomic DNA

SEQ ID NO: 50202 - DNA, 52 bp, Homo sapiens
  misc_feature 1..52: note = chr5:320788-320840
  misc_feature 1..52: note = hyper
  source 1..52: mol_type = genomic DNA
cgccagtgacagcctcggccgcgttgctgaaaaccgaccttgcgggatgaag

SEQ ID NO: 50203 - DNA, 352 bp, Homo sapiens; identical to SEQ ID NO: 18670
  misc_feature 1..352: note = chr5:320982-321334
  misc_feature 1..352: note = hyper
  source 1..352: mol_type = genomic DNA

SEQ ID NO: 50204 - DNA, 30 bp, Homo sapiens; identical to SEQ ID NO: 29352
  misc_feature 1..30: note = chr5:321585-321615
  misc_feature 1..30: note = hyper
  source 1..30: mol_type = genomic DNA

SEQ ID NO: 50205 - DNA, 148 bp, Homo sapiens; identical to SEQ ID NO: 29353
  misc_feature 1..148: note = chr5:321900-322048
  misc_feature 1..148: note = hyper
  source 1..148: mol_type = genomic DNA

SEQ ID NO: 50206 - DNA, 191 bp, Homo sapiens; identical to SEQ ID NO: 29354
  misc_feature 1..191: note = chr5:322061-322252
  misc_feature 1..191: note = hyper
  source 1..191: mol_type = genomic DNA

SEQ ID NO: 50207 - DNA, 138 bp, Homo sapiens; identical to SEQ ID NO: 29355
  misc_feature 1..138: note = chr5:322265-322403
  misc_feature 1..138: note = hyper
  source 1..138: mol_type = genomic DNA

SEQ ID NO: 50208 - DNA, 30 bp, Homo sapiens; identical to SEQ ID NO: 29356
  misc_feature 1..30: note = chr5:344257-344287
  misc_feature 1..30: note = hyper
  source 1..30: mol_type = genomic DNA

SEQ ID NO: 50209 - DNA, 87 bp, Homo sapiens
  misc_feature 1..87: note = chr5:374266-374353
  misc_feature 1..87: note = hyper
  source 1..87: mol_type = genomic DNA
tgtgcccccacccgcgctgccccagcccgcggacctcggcggggagcgcccagggccagcacgggggtctcacggggcgaccccagc

SEQ ID NO: 50210 - DNA, 25 bp, Homo sapiens
  misc_feature 1..25: note = chr5:523778-523803
  misc_feature 1..25: note = hyper
  source 1..25: mol_type = genomic DNA
ctgctgggtttcatgcgggtagcac

SEQ ID NO: 50211 - DNA, 481 bp, Homo sapiens
  misc_feature 1..481: note = chr5:523856-524337
  misc_feature 1..481: note = hyper
  source 1..481: mol_type = genomic DNA
cgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgc

SEQ ID NO: 50212 - DNA, 456 bp, Homo sapiens
  misc_feature 1..456: note = chr5:524404-524860
  misc_feature 1..456: note = hyper
  source 1..456: mol_type = genomic DNA
ccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctggg

SEQ ID NO: 50213 - DNA, 32 bp, Homo sapiens; identical to SEQ ID NO: 29360
  misc_feature 1..32: note = chr5:926725-926757
  misc_feature 1..32: note = hyper
  source 1..32: mol_type = genomic DNA

SEQ ID NO: 50214 - DNA, 154 bp, Homo sapiens; identical to SEQ ID NO: 29361
  misc_feature 1..154: note = chr5:1155721-1155875
  misc_feature 1..154: note = hyper
  source 1..154: mol_type = genomic DNA

SEQ ID NO: 50215 - DNA, 55 bp, Homo sapiens; identical to SEQ ID NO: 29362
  misc_feature 1..55: note = chr5:1156350-1156405
  misc_feature 1..55: note = hyper
  source 1..55: mol_type = genomic DNA

SEQ ID NO: 50216 - DNA, 73 bp, Homo sapiens
  misc_feature 1..73: note = chr5:1294557-1294630
  misc_feature 1..73: note = hyper
  source 1..73: mol_type = genomic DNA
acgtcgtcgcccacgcggcgcagcagcagcccccacgccccgctcccccgcagtgcgtcggtcaccgtgttgg

SEQ ID NO: 50217 - DNA, 264 bp, Homo sapiens; identical to SEQ ID NO: 18674
  misc_feature 1..264: note = chr5:1294767-1295031
  misc_feature 1..264: note = hyper
  source 1..264: mol_type = genomic DNA

SEQ ID NO: 50218 - DNA, 37 bp, Homo sapiens
  misc_feature 1..37: note = chr5:1295662-1295699
  misc_feature 1..37: note = hyper
  source 1..37: mol_type = genomic DNA
tccgggcaccacgaatgccggacgtgaaggggaggac

SEQ ID NO: 50219 - DNA, 66 bp, Homo sapiens; identical to SEQ ID NO: 29365
  misc_feature 1..66: note = chr5:1444697-1444763
  misc_feature 1..66: note = hyper
  source 1..66: mol_type = genomic DNA

SEQ ID NO: 50220 - DNA, 320 bp, Homo sapiens
  misc_feature 1..320: note = chr5:1444851-1445171
  misc_feature 1..320: note = hyper
  source 1..320: mol_type = genomic DNA
cgctcctgaacgcggggcctcagaggcgagttttgggtctacacagcaaaatgtggcccgttagaaagcgtccttcctcaccgcgcccagaacaagaagcggcgctgcctggcgagtcctcgcccggcctccccgccctgcccagagcaccagcgcgcagcccgcgcccgccaccacccccaacacagacaaagcccccgcgagatggagcggcggtgtacaaaacccactccgatcggatctgggatgcgccgcacccctagtagggttaagttccacgagaagaaaccaggacccccgagtcacagccatagacaccc

SEQ ID NO: 50221 - DNA, 76 bp, Homo sapiens; identical to SEQ ID NO: 29367
  misc_feature 1..76: note = chr5:1445485-1445561
  misc_feature 1..76: note = hyper
  source 1..76: mol_type = genomic DNA

SEQ ID NO: 50222 - skipped

SEQ ID NO: 50223 - DNA, 170 bp, Homo sapiens
  misc_feature 1..170: note = chr5:1445568-1445738
  misc_feature 1..170: note = hyper
  source 1..170: mol_type = genomic DNA
ggctcttatccagtagacagggtccgccccgccccgccctcccgccgacggggtcgccctcgcgtcctggctcctcctcctcacctccccgggccgcgcccccgcccccgcctcccggacgcagatggctgggagcaagcggcggccacggctccactgtcctgcgcgtc

SEQ ID NO: 50224 - DNA, 173 bp, Homo sapiens
  misc_feature 1..173: note = chr5:1445928-1446101
  misc_feature 1..173: note = hyper
  source 1..173: mol_type = genomic DNA
gcggctgcgcgcggggaactgctgggaccccgtcgggccgacccttccctccctccccatcaggggcccctacggtggccccgcgctctggggaccacgtccctcccaccccgccgctccacgctctgaccagcgggctcgggaccccgccgaggactctgcacgcttcccgg

SEQ ID NO: 50225 - DNA, 83 bp, Homo sapiens; identical to SEQ ID NO: 18679
  misc_feature 1..83: note = chr5:1446236-1446319
  misc_feature 1..83: note = hyper
  source 1..83: mol_type = genomic DNA

SEQ ID NO: 50226 - DNA, 366 bp, Homo sapiens; identical to SEQ ID NO: 29373
  misc_feature 1..366: note = chr5:1667728-1668094
  misc_feature 1..366: note = hyper
  source 1..366: mol_type = genomic DNA

SEQ ID NO: 50227 - DNA, 467 bp, Homo sapiens; identical to SEQ ID NO: 29374
  misc_feature 1..467: note = chr5:1851534-1852001
  misc_feature 1..467: note = hyper
  source 1..467: mol_type = genomic DNA

SEQ ID NO: 50228 - DNA, 354 bp, Homo sapiens; identical to SEQ ID NO: 18682
  misc_feature 1..354: note = chr5:1875099-1875453
  misc_feature 1..354: note = hyper
  source 1..354: mol_type = genomic DNA

SEQ ID NO: 50229 - DNA, 373 bp, Homo sapiens
  misc_feature 1..373: note = chr5:1875497-1875870
  misc_feature 1..373: note = hyper
  source 1..373: mol_type = genomic DNA
ccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcg

SEQ ID NO: 50230 - DNA, 61 bp, Homo sapiens
  misc_feature 1..61: note = chr5:1876860-1876921
  misc_feature 1..61: note = hyper
  source 1..61: mol_type = genomic DNA
gatggggaggggagcccggatttctgagcgtagccacggcttggccgggccccccgagccc

SEQ ID NO: 50231 - DNA, 14 bp, Homo sapiens
  misc_feature 1..14: note = chr5:1877089-1877103
  misc_feature 1..14: note = hyper
  source 1..14: mol_type = genomic DNA
ggaaataggagagc

SEQ ID NO: 50232 - DNA, 196 bp, Homo sapiens
  misc_feature 1..196: note = chr5:1877818-1878014
  misc_feature 1..196: note = hyper
  source 1..196: mol_type = genomic DNA
tggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaa

SEQ ID NO: 50233 - DNA, 49 bp, Homo sapiens; identical to SEQ ID NO: 18685
  misc_feature 1..49: note = chr5:1878528-1878577
  misc_feature 1..49: note = hyper
  source 1..49: mol_type = genomic DNA

SEQ ID NO: 50234 - DNA, 78 bp, Homo sapiens
  misc_feature 1..78: note = chr5:1879527-1879605
  misc_feature 1..78: note = hyper
  source 1..78: mol_type = genomic DNA
ttgggacccccaagacgtcctagaaccgcagagaaggcactgtgcctgcactccagggcctcagcccccagtgacaac

SEQ ID NO: 50235 - skipped

SEQ ID NO: 50236 - DNA, 239 bp, Homo sapiens; identical to SEQ ID NO: 18687
  misc_feature 1..239: note = chr5:1882605-1882844
  misc_feature 1..239: note = hyper
  source 1..239: mol_type = genomic DNA

SEQ ID NO: 50237 - DNA, 83 bp, Homo sapiens; identical to SEQ ID NO: 29385
  misc_feature 1..83: note = chr5:1883131-1883214
  misc_feature 1..83: note = hyper
  source 1..83: mol_type = genomic DNA

SEQ ID NO: 50238 - DNA, 300 bp, Homo sapiens
  misc_feature 1..300: note = chr5:1883215-1883515
  misc_feature 1..300: note = hyper
  source 1..300: mol_type = genomic DNA
gtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcg

SEQ ID NO: 50239 - DNA, 299 bp, Homo sapiens; identical to SEQ ID NO: 18689
  misc_feature 1..299: note = chr5:1883879-1884178
  misc_feature 1..299: note = hyper
  source 1..299: mol_type = genomic DNA

SEQ ID NO: 50240 - DNA, 38 bp, Homo sapiens
  misc_feature 1..38: note = chr5:1884237-1884275
  misc_feature 1..38: note = hyper
  source 1..38: mol_type = genomic DNA
cgggccatcccgaacccgttccccgccttctgcgccat

SEQ ID NO: 50241 - DNA, 108 bp, Homo sapiens
  misc_feature 1..108: note = chr5:1884698-1884806
  misc_feature 1..108: note = hyper
  source 1..108: mol_type = genomic DNA
attcagacagtttagcgtcggtagccgcgagaaatatataaagaacacgagtcaaatgacattaataattgtttctgaattctgtattgatttcgcggcaggccgcgt

SEQ ID NO: 50242 - DNA, 241 bp, Homo sapiens
  misc_feature 1..241: note = chr5:1885458-1885699
  misc_feature 1..241: note = hyper
  source 1..241: mol_type = genomic DNA
accaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccagga

SEQ ID NO: 50243 - DNA, 163 bp, Homo sapiens
  misc_feature 1..163: note = chr5:1886379-1886542
  misc_feature 1..163: note = hyper
  source 1..163: mol_type = genomic DNA
ggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggttt

SEQ ID NO: 50244 - DNA, 231 bp, Homo sapiens
  misc_feature 1..231: note = chr5:1886581-1886812
  misc_feature 1..231: note = hyper
  source 1..231: mol_type = genomic DNA
cgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactcc

SEQ ID NO: 50245 - DNA, 288 bp, Homo sapiens
  misc_feature 1..288: note = chr5:1887737-1888025
  misc_feature 1..288: note = hyper
  source 1..288: mol_type = genomic DNA
cctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggt

SEQ ID NO: 50246 - DNA, 245 bp, Homo sapiens
  misc_feature 1..245: note = chr5:1931754-1931999
  misc_feature 1..245: note = hyper
  source 1..245: mol_type = genomic DNA
tttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctg

SEQ ID NO: 50247 - DNA, 138 bp, Homo sapiens; identical to SEQ ID NO: 29400
  misc_feature 1..138: note = chr5:1952723-1952861
  misc_feature 1..138: note = hyper
  source 1..138: mol_type = genomic DNA

SEQ ID NO: 50248 - DNA, 281 bp, Homo sapiens
  misc_feature 1..281: note = chr5:2038424-2038705
  misc_feature 1..281: note = hyper
  source 1..281: mol_type = genomic DNA
tgcactgttgaaaagcggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagcc

SEQ ID NO: 50249 - DNA, 13 bp, Homo sapiens
  misc_feature 1..13: note = chr5:2038850-2038863
  misc_feature 1..13: note = hyper
  source 1..13: mol_type = genomic DNA
tcaggatctgacc

SEQ ID NO: 50250 - DNA, 15 bp, Homo sapiens
  misc_feature 1..15: note = chr5:2038947-2038962
  misc_feature 1..15: note = hyper
  source 1..15: mol_type = genomic DNA
cgctggctccagcca

SEQ ID NO: 50251 - DNA, 32 bp, Homo sapiens
  misc_feature 1..32: note = chr5:2738816-2738848
  misc_feature 1..32: note = hyper
  source 1..32: mol_type = genomic DNA
ctcaccacccccagccgcacgcttgggcctcc

SEQ ID NO: 50252 - DNA, 252 bp, Homo sapiens; identical to SEQ ID NO: 29405
  misc_feature 1..252: note = chr5:2739551-2739803
  misc_feature 1..252: note = hyper
  source 1..252: mol_type = genomic DNA

SEQ ID NO: 50253 - DNA, 17 bp, Homo sapiens
  misc_feature 1..17: note = chr5:2739860-2739877
  misc_feature 1..17: note = hyper
  source 1..17: mol_type = genomic DNA
cgggcctgaggctgagg

SEQ ID NO: 50254 - DNA, 31 bp, Homo sapiens; identical to SEQ ID NO: 18698
  misc_feature 1..31: note = chr5:2743713-2743744
  misc_feature 1..31: note = hyper
  source 1..31: mol_type = genomic DNA

SEQ ID NO: 50255 - DNA, 62 bp, Homo sapiens; identical to SEQ ID NO: 29411
  misc_feature 1..62: note = chr5:2747745-2747807
  misc_feature 1..62: note = hyper
  source 1..62: mol_type = genomic DNA

SEQ ID NO: 50256 - DNA, 82 bp, Homo sapiens
  misc_feature 1..82: note = chr5:2748292-2748374
  misc_feature 1..82: note = hyper
  source 1..82: mol_type = genomic DNA
ctttggcttccatctcgccctccgccctcactctgctaattctgggtcccaggagtggccccctggatcttcttcccggacc

SEQ ID NO: 50257 - DNA, 31 bp, Homo sapiens
  misc_feature 1..31: note = chr5:2748459-2748490
  misc_feature 1..31: note = hyper
  source 1..31: mol_type = genomic DNA
tttcttgggctcgtagccgccgcccggggac

SEQ ID NO: 50258 - DNA, 231 bp, Homo sapiens; identical to SEQ ID NO: 29413
  misc_feature 1..231: note = chr5:2748549-2748780
  misc_feature 1..231: note = hyper
  source 1..231: mol_type = genomic DNA

SEQ ID NO: 50259 - DNA, 33 bp, Homo sapiens
  misc_feature 1..33: note = chr5:2749180-2749213
  misc_feature 1..33: note = hyper
  source 1..33: mol_type = genomic DNA
gcacggtgggtggcacgaggggacagcgcaggc

SEQ ID NO: 50260 - DNA, 88 bp, Homo sapiens
  misc_feature 1..88: note = chr5:2751894-2751982
  misc_feature 1..88: note = hyper
  source 1..88: mol_type = genomic DNA
ccgcccgctgcagcctccgggccgcggccgggggaggggcagagagacgggagggaggcgggggagggcggaggcgacggaggcgggc

SEQ ID NO: 50261 - DNA, 322 bp, Homo sapiens; identical to SEQ ID NO: 29417
  misc_feature 1..322: note = chr5:2752120-2752442
  misc_feature 1..322: note = hyper
  source 1..322: mol_type = genomic DNA

SEQ ID NO: 50262 - DNA, 483 bp, Homo sapiens
  misc_feature 1..483: note = chr5:2752508-2752991
  misc_feature 1..483: note = hyper
  source 1..483: mol_type = genomic DNA
cggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctc

SEQ ID NO: 50263 - skipped

SEQ ID NO: 50264 - DNA, 294 bp, Homo sapiens
  misc_feature 1..294: note = chr5:2753078-2753372
  misc_feature 1..294: note = hyper
  source 1..294: mol_type = genomic DNA
aagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacact

SEQ ID NO: 50265 - DNA, 30 bp, Homo sapiens; identical to SEQ ID NO: 7713
  misc_feature 1..30: note = chr5:2754590-2754620
  misc_feature 1..30: note = hyper
  source 1..30: mol_type = genomic DNA

SEQ ID NO: 50266 - skipped

SEQ ID NO: 50267 - DNA, 211 bp, Homo sapiens
  misc_feature 1..211: note = chr5:2756388-2756599
  misc_feature 1..211: note = hyper
  source 1..211: mol_type = genomic DNA
gccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgccc

SEQ ID NO: 50268 - DNA, 155 bp, Homo sapiens
  misc_feature 1..155: note = chr5:2757427-2757582
  misc_feature 1..155: note = hyper
  source 1..155: mol_type = genomic DNA
ttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggtt

SEQ ID NO: 50269 - DNA, 64 bp, Homo sapiens; identical to SEQ ID NO: 29422
  misc_feature 1..64: note = chr5:3122140-3122204
  misc_feature 1..64: note = hyper
  source 1..64: mol_type = genomic DNA

SEQ ID NO: 50270 - DNA, 163 bp, Homo sapiens; identical to SEQ ID NO: 29423
  misc_feature 1..163: note = chr5:3197731-3197894
  misc_feature 1..163: note = hyper
  source 1..163: mol_type = genomic DNA

SEQ ID NO: 50271 - DNA, 24 bp, Homo sapiens
  misc_feature 1..24: note = chr5:3197991-3198015
  misc_feature 1..24: note = hyper
  source 1..24: mol_type = genomic DNA
cgcccggcacgagctccgtgacga

SEQ ID NO: 50272 - DNA, 55 bp, Homo sapiens
  misc_feature 1..55: note = chr5:3590350-3590405
  misc_feature 1..55: note = hyper
  source 1..55: mol_type = genomic DNA
gatgcaaacacaacacggagaggggatgtctcctgtctagagattccagggcagt

SEQ ID NO: 50273 - DNA, 100 bp, Homo sapiens; identical to SEQ ID NO: 29426
  misc_feature 1..100: note = chr5:3590803-3590903
  misc_feature 1..100: note = hyper
  source 1..100: mol_type = genomic DNA

SEQ ID NO: 50274 - DNA, 231 bp, Homo sapiens
  misc_feature 1..231: note = chr5:3591123-3591354
  misc_feature 1..231: note = hyper
  source 1..231: mol_type = genomic DNA
ttacgtgtgtgcacacgcatgtaattcacttccttcgacactggggacggcgtcgtagcggcactccaggccaggccactgcggtccattcctctgccctgcgtttgtgggaaatacgggcccagtgccgcagctttagggcctgggtcgcccttggtccgcccgccgcgttcccgggtggtgtccccacgctgctgaggacctggttccgcgatgcttgccgcggggggc

SEQ ID NO: 50275 - DNA, 60 bp, Homo sapiens
  misc_feature 1..60: note = chr5:3591388-3591448
  misc_feature 1..60: note = hyper
  source 1..60: mol_type = genomic DNA
gcttctgggcgtttccttctggggtttccttggagcggctcgagtcgactcctcccgcct

SEQ ID NO: 50276 - DNA, 86 bp, Homo sapiens
  misc_feature 1..86: note = chr5:3592642-3592728
  misc_feature 1..86: note = hyper
  source 1..86: mol_type = genomic DNA
cgacccctagacctggttttgtcaggctcctcgtctttgtctctggcacagtgaccagggggcagccaccgggtgcggccagctcc

SEQ ID NO: 50277 - DNA, 203 bp, Homo sapiens
  misc_feature 1..203: note = chr5:3594047-3594250
  misc_feature 1..203: note = hyper
  source 1..203: mol_type = genomic DNA
gaggaggttgaagatcggaaatctgtcttagggttagaaggtgtctggtggtaggctggggaacaggaaaaagctgcagttaggggcttcccggatttgtgtcaccaagaatccactccccaccaaccctcggcgtccccacaaacccagcccggaatctatgtaaaagcaggaaaggaaccctggaggttgtaggcggatcc

SEQ ID NO: 50278 - DNA, 15 bp, Homo sapiens
  misc_feature 1..15: note = chr5:3594777-3594792
  misc_feature 1..15: note = hyper
  source 1..15: mol_type = genomic DNA
cggagctctccagcc

SEQ ID NO: 50279 - DNA, 191 bp, Homo sapiens
  misc_feature 1..191: note = chr5:3595178-3595369
  misc_feature 1..191: note = hyper
  source 1..191: mol_type = genomic DNA
tttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggc

SEQ ID NO: 50280 - DNA, 66 bp, Homo sapiens
  misc_feature 1..66: note = chr5:3595991-3596057
  misc_feature 1..66: note = hyper
  source 1..66: mol_type = genomic DNA
gcgcgcgattgcggatccgggcgcagccgggagccgggcgcctgcgagcaccgggcagaggagccg

SEQ ID NO: 50281 - DNA, 52 bp, Homo sapiens
  misc_feature 1..52: note = chr5:3596880-3596932
  misc_feature 1..52: note = hyper
  source 1..52: mol_type = genomic DNA
tagcaggacttcccttcctggccgcgggttccactcgcgcggcctctttagt

SEQ ID NO: 50282 - skipped

SEQ ID NO: 50283 - DNA, 81 bp, Homo sapiens; identical to SEQ ID NO: 29437
  misc_feature 1..81: note = chr5:3599364-3599445
  misc_feature 1..81: note = hyper
  source 1..81: mol_type = genomic DNA

SEQ ID NO: 50284 - DNA, 106 bp, Homo sapiens; identical to SEQ ID NO: 29438
  misc_feature 1..106: note = chr5:3599502-3599608
  misc_feature 1..106: note = hyper
  source 1..106: mol_type = genomic DNA

SEQ ID NO: 50285 - DNA, 85 bp, Homo sapiens; identical to SEQ ID NO: 29439
  misc_feature 1..85: note = chr5:3600390-3600475
  misc_feature 1..85: note = hyper
  source 1..85: mol_type = genomic DNA

SEQ ID NO: 50286 - DNA, 21 bp, Homo sapiens
  misc_feature 1..21: note = chr5:3600732-3600753
  misc_feature 1..21: note = hyper
  source 1..21: mol_type = genomic DNA
cgtccccaggccagattcgcc

SEQ ID NO: 50287 - DNA, 137 bp, Homo sapiens; identical to SEQ ID NO: 29441
  misc_feature 1..137: note = chr5:3601025-3601162
  misc_feature 1..137: note = hyper
  source 1..137: mol_type = genomic DNA

SEQ ID NO: 50288 - DNA, 167 bp, Homo sapiens; identical to SEQ ID NO: 29443
  misc_feature 1..167: note = chr5:3606268-3606435
  misc_feature 1..167: note = hyper
  source 1..167: mol_type = genomic DNA

SEQ ID NO: 50289 - DNA, 191 bp, Homo sapiens; identical to SEQ ID NO: 29444
  misc_feature 1..191: note = chr5:3606711-3606902
  misc_feature 1..191: note = hyper
  source 1..191: mol_type = genomic DNA

SEQ ID NO: 50290 - DNA, 45 bp, Homo sapiens; identical to SEQ ID NO: 29445
  misc_feature 1..45: note = chr5:3607103-3607148
  misc_feature 1..45: note = hyper
  source 1..45: mol_type = genomic DNA

SEQ ID NO: 50291 - DNA, 100 bp, Homo sapiens; identical to SEQ ID NO: 18713
  misc_feature 1..100: note = chr5:5139900-5140000
  misc_feature 1..100: note = hyper
  source 1..100: mol_type = genomic DNA

SEQ ID NO: 50292 - DNA, 139 bp, Homo sapiens
  misc_feature 1..139: note = chr5:5140031-5140170
  misc_feature 1..139: note = hyper
  source 1..139: mol_type = genomic DNA
cgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgg

SEQ ID NO: 50293 - DNA, 231 bp, Homo sapiens
  misc_feature 1..231: note = chr5:5140225-5140456
  misc_feature 1..231: note = hyper
  source 1..231: mol_type = genomic DNA
tccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccgg

SEQ ID NO: 50294 - DNA, 103 bp, Homo sapiens; identical to SEQ ID NO: 18716
  misc_feature 1..103: note = chr5:5140527-5140630
  misc_feature 1..103: note = hyper
  source 1..103: mol_type = genomic DNA

SEQ ID NO: 50295 - DNA, 192 bp, Homo sapiens; identical to SEQ ID NO: 18717
  misc_feature 1..192: note = chr5:6448738-6448930
  misc_feature 1..192: note = hyper
  source 1..192: mol_type = genomic DNA

SEQ ID NO: 50296 - DNA, 272 bp, Homo sapiens; identical to SEQ ID NO: 18718
  misc_feature 1..272: note = chr5:6583189-6583461
  misc_feature 1..272: note = hyper
  source 1..272: mol_type = genomic DNA

SEQ ID NO: 50297 - DNA, 139 bp, Homo sapiens
  misc_feature 1..139: note = chr5:6583579-6583718
  misc_feature 1..139: note = hyper
  source 1..139: mol_type = genomic DNA
gcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtg

SEQ ID NO: 50298 - DNA, 150 bp, Homo sapiens
  misc_feature 1..150: note = chr5:6687127-6687277
  misc_feature 1..150: note = hyper
  source 1..150: mol_type = genomic DNA
cgcttcctaataaaacggcattccaggttctagaaagcatttcggtaaaacaggctcagaaacaccagattcaagagaataaccattatatgtgaatacatttaaaaatagatcacacactctaacaactgaaatgtacagaaaagatga

SEQ ID NO: 50299 - DNA, 17 bp, Homo sapiens
  misc_feature 1..17: note = chr5:6687431-6687448
  misc_feature 1..17: note = hyper
  source 1..17: mol_type = genomic DNA
accgcctgtatctgaaa

SEQ ID NO: 50300 - DNA, 30 bp, Homo sapiens; identical to SEQ ID NO: 29453
  misc_feature 1..30: note = chr5:7394911-7394941
  misc_feature 1..30: note = hyper
  source 1..30: mol_type = genomic DNA

SEQ ID NO: 50301 - DNA, 102 bp, Homo sapiens
  misc_feature 1..102: note = chr5:7395538-7395640
  misc_feature 1..102: note = hyper
  source 1..102: mol_type = genomic DNA
caccgcggggaggcgggaagggtgggaaatcctctccagctccccaaaagagtgaaaaggagggagaccccgctgtcctctgacccgcgtactaaaggaggg

SEQ ID NO: 50302 - DNA, 134 bp, Homo sapiens; identical to SEQ ID NO: 29456
  misc_feature 1..134: note = chr5:7395952-7396086
  misc_feature 1..134: note = hyper
  source 1..134: mol_type = genomic DNA

SEQ ID NO: 50303 - DNA, 211 bp, Homo sapiens; identical to SEQ ID NO: 29457
  misc_feature 1..211: note = chr5:7396534-7396745
  misc_feature 1..211: note = hyper
  source 1..211: mol_type = genomic DNA

SEQ ID NO: 50304 - DNA, 16 bp, Homo sapiens
  misc_feature 1..16: note = chr5:7396962-7396978
  misc_feature 1..16: note = hyper
  source 1..16: mol_type = genomic DNA
ggaataggtcttcccc

SEQ ID NO: 50305 - DNA, 56 bp, Homo sapiens; identical to SEQ ID NO: 29459
  misc_feature 1..56: note = chr5:7396979-7397035
  misc_feature 1..56: note = hyper
  source 1..56: mol_type = genomic DNA

SEQ ID NO: 50306 - DNA, 30 bp, Homo sapiens; identical to SEQ ID NO: 29460
  misc_feature 1..30: note = chr5:7850282-7850312
  misc_feature 1..30: note = hyper
  source 1..30: mol_type = genomic DNA

SEQ ID NO: 50307 - DNA, 100 bp, Homo sapiens; identical to SEQ ID NO: 29461
  misc_feature 1..100: note = chr5:7850518-7850618
  misc_feature 1..100: note = hyper
  source 1..100: mol_type = genomic DNA

SEQ ID NO: 50308 - DNA, 93 bp, Homo sapiens
  misc_feature 1..93: note = chr5:7850922-7851015
  misc_feature 1..93: note = hyper
  source 1..93: mol_type = genomic DNA
gcccagccgcccagccgcccagccgcccagccttccggtctccgcgcccagtccgcggtcctcacccgcgccgggcggtagtagtagctgtgc

SEQ ID NO: 50309 - DNA, 178 bp, Homo sapiens
  misc_feature 1..178: note = chr5:7851121-7851299
  misc_feature 1..178: note = hyper
  source 1..178: mol_type = genomic DNA
cgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgca

SEQ ID NO: 50310 - DNA, 150 bp, Homo sapiens; identical to SEQ ID NO: 29463
  misc_feature 1..150: note = chr5:9544685-9544835
  misc_feature 1..150: note = hyper
  source 1..150: mol_type = genomic DNA

SEQ ID NO: 50311 - DNA, 43 bp, Homo sapiens; identical to SEQ ID NO: 29464
  misc_feature 1..43: note = chr5:9545077-9545120
  misc_feature 1..43: note = hyper
  source 1..43: mol_type = genomic DNA

SEQ ID NO: 50312 - DNA, 76 bp, Homo sapiens; identical to SEQ ID NO: 29465
  misc_feature 1..76: note = chr5:9545555-9545631
  misc_feature 1..76: note = hyper
  source 1..76: mol_type = genomic DNA

SEQ ID NO: 50313 - DNA, 48 bp, Homo sapiens
  misc_feature 1..48: note = chr5:9546564-9546612
  misc_feature 1..48: note = hyper
  source 1..48: mol_type = genomic DNA
gacgtggctgcaccccggaggggggcgccggccgagacctgagacgtg

SEQ ID NO: 50314 - DNA, 40 bp, Homo sapiens
  misc_feature 1..40: note = chr5:9546648-9546688
  misc_feature 1..40: note = hyper
  source 1..40: mol_type = genomic DNA
gcggttccctcggctaaatctggcccgggggatggggggc

SEQ ID NO: 50315 - DNA, 97 bp, Homo sapiens; identical to SEQ ID NO: 29467
  misc_feature 1..97: note = chr5:10307612-10307709
  misc_feature 1..97: note = hyper
  source 1..97: mol_type = genomic DNA

SEQ ID NO: 50316 - DNA, 158 bp, Homo sapiens
  misc_feature 1..158: note = chr5:10333530-10333688
  misc_feature 1..158: note = hyper
  source 1..158: mol_type = genomic DNA
ctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacggga

SEQ ID NO: 50317 - DNA, 134 bp, Homo sapiens; identical to SEQ ID NO: 29469
  misc_feature 1..134: note = chr5:10442381-10442515
  misc_feature 1..134: note = hyper
  source 1..134: mol_type = genomic DNA

SEQ ID NO: 50318 - DNA, 30 bp, Homo sapiens; identical to SEQ ID NO: 29470
  misc_feature 1..30: note = chr5:10563541-10563571
  misc_feature 1..30: note = hyper
  source 1..30: mol_type = genomic DNA

SEQ ID NO: 50319 - DNA, 70 bp, Homo sapiens; identical to SEQ ID NO: 29471
  misc_feature 1..70: note = chr5:10564589-10564659
  misc_feature 1..70: note = hyper
  source 1..70: mol_type = genomic DNA

SEQ ID NO: 50320 - DNA, 221 bp, Homo sapiens; identical to SEQ ID NO: 18726
  misc_feature 1..221: note = chr5:10564800-10565021
  misc_feature 1..221: note = hyper
  source 1..221: mol_type = genomic DNA

SEQ ID NO: 50321 - DNA, 113 bp, Homo sapiens
  misc_feature 1..113: note = chr5:10565607-10565720
  misc_feature 1..113: note = hyper
  source 1..113: mol_type = genomic DNA
cggggctccccagagtcagggcatagggagagccccagagccgcgggcatccacccgggtagggcaggaggcgtggaggcaggcacaggctatcctttcgttatgaccagatt

SEQ ID NO: 50322 - DNA, 225 bp, Homo sapiens
  misc_feature 1..225: note = chr5:11385363-11385588
  misc_feature 1..225: note = hyper
  source 1..225: mol_type = genomic DNA
cacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 50323 - DNA, 180 bp, Homo sapiens; identical to SEQ ID NO: 7749
  misc_feature 1..180: note = chr5:11903545-11903725
  misc_feature 1..180: note = hyper
  source 1..180: mol_type = genomic DNA

SEQ ID NO: 50324 - DNA, 49 bp, Homo sapiens
  misc_feature 1..49: note = chr5:11904696-11904745
  misc_feature 1..49: note = hyper
  source 1..49: mol_type = genomic DNA
acgcacgccctggacctgagatgggtggatgctccggagctaggcgaaa

SEQ ID NO: 50325 - DNA, 30 bp, Homo sapiens; identical to SEQ ID NO: 7754
  misc_feature 1..30: note = chr5:11904962-11904992
  misc_feature 1..30: note = hyper
  source 1..30: mol_type = genomic DNA

SEQ ID NO: 50326 - DNA, 30 bp, Homo sapiens; identical to SEQ ID NO: 29482
  misc_feature 1..30: note = chr5:14142742-14142772
  misc_feature 1..30: note = hyper
  source 1..30: mol_type = genomic DNA

SEQ ID NO: 50327 - DNA, 30 bp, Homo sapiens; identical to SEQ ID NO: 29483
  misc_feature 1..30: note = chr5:15499838-15499868
  misc_feature 1..30: note = hyper
  source 1..30: mol_type = genomic DNA

SEQ ID NO: 50328 - DNA, 119 bp, Homo sapiens; identical to SEQ ID NO: 29484
  misc_feature 1..119: note = chr5:15500570-15500689
  misc_feature 1..119: note = hyper
  source 1..119: mol_type = genomic DNA

SEQ ID NO: 50329 - DNA, 13 bp, Homo sapiens
  misc_feature 1..13: note = chr5:15500735-15500748
  misc_feature 1..13: note = hyper
  source 1..13: mol_type = genomic DNA
cgccgcagctatg

SEQ ID NO: 50330 - DNA, 367 bp, Homo sapiens
  misc_feature 1..367: note = chr5:15500927-15501294
  misc_feature 1..367: note = hyper
  source 1..367: mol_type = genomic DNA
ccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctct

SEQ ID NO: 50331 - DNA, 12 bp, Homo sapiens
  misc_feature 1..12: note = chr5:16179141-16179153
  misc_feature 1..12: note = hyper
  source 1..12: mol_type = genomic DNA
ccttacctgctc

SEQ ID NO: 50332 - DNA, 141 bp, Homo sapiens; identical to SEQ ID NO: 29488
  misc_feature 1..141: note = chr5:16179266-16179407
  misc_feature 1..141: note = hyper
  source 1..141: mol_type = genomic DNA

SEQ ID NO: 50333 - DNA, 61 bp, Homo sapiens; identical to SEQ ID NO: 18733
  misc_feature 1..61: note = chr5:16180260-16180321
  misc_feature 1..61: note = hyper
  source 1..61: mol_type = genomic DNA

SEQ ID NO: 50334 - DNA, 399 bp, Homo sapiens; identical to SEQ ID NO: 29491
  misc_feature 1..399: note = chr5:16180371-16180770
  misc_feature 1..399: note = hyper
  source 1..399: mol_type = genomic DNA

SEQ ID NO: 50335 - DNA, 30 bp, Homo sapiens; identical to SEQ ID NO: 29492
  misc_feature 1..30: note = chr5:16934552-16934582
  misc_feature 1..30: note = hyper
  source 1..30: mol_type = genomic DNA

SEQ ID NO: 50336 - DNA, 159 bp, Homo sapiens; identical to SEQ ID NO: 29493
  misc_feature 1..159: note = chr5:16935883-16936042
  misc_feature 1..159: note = hyper
  source 1..159: mol_type = genomic DNA

SEQ ID NO: 50337 - DNA, 37 bp, Homo sapiens; identical to SEQ ID NO: 29494
  misc_feature 1..37: note = chr5:16936738-16936775
  misc_feature 1..37: note = hyper
  source 1..37: mol_type = genomic DNA

SEQ ID NO: 50338 - DNA, 333 bp, Homo sapiens; identical to SEQ ID NO: 29495
  misc_feature 1..333: note = chr5:17216805-17217138
  misc_feature 1..333: note = hyper
  source 1..333: mol_type = genomic DNA

SEQ ID NO: 50339 - DNA, 184 bp, Homo sapiens; identical to SEQ ID NO: 29496
  misc_feature 1..184: note = chr5:17217681-17217865
  misc_feature 1..184: note = hyper
  source 1..184: mol_type = genomic DNA

SEQ ID NO: 50340 - DNA, 204 bp, Homo sapiens
  misc_feature 1..204: note = chr5:17217991-17218195
  misc_feature 1..204: note = hyper
  source 1..204: mol_type = genomic DNA
cgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctg

SEQ ID NO: 50341 - DNA, 709 bp, Homo sapiens
  misc_feature 1..709: note = chr5:17218225-17218934
  misc_feature 1..709: note = hyper
  source 1..709: mol_type = genomic DNA
cgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaac

SEQ ID NO: 50342 - DNA, 201 bp, Homo sapiens
  misc_feature 1..201: note = chr5:17219018-17219219
  misc_feature 1..201: note = hyper
  source 1..201: mol_type = genomic DNA
tcggtggacagcccttgcccatgtaattctcactctgctgaaattagcacagcacacatgggtgcattttttaggaccttgtacaggttgacaacacctctgtctcccccgcggccactcgcactgtggggcgggctaaaacccaacactagcgtcgaaatggccttctgctatagggttgtggaccgaccccccaccccc

SEQ ID NO: 50343 - DNA, 152 bp, Homo sapiens; identical to SEQ ID NO: 29499
  misc_feature 1..152: note = chr5:22853104-22853256
  misc_feature 1..152: note = hyper
  source 1..152: mol_type = genomic DNA

SEQ ID NO: 50344 - DNA, 30 bp, Homo sapiens; identical to SEQ ID NO: 29500
  misc_feature 1..30: note = chr5:22853539-22853569
  misc_feature 1..30: note = hyper
  source 1..30: mol_type = genomic DNA

SEQ ID NO: 50345 - DNA, 54 bp, Homo sapiens
  misc_feature 1..54: note = chr5:31193883-31193937
  misc_feature 1..54: note = hyper
  source 1..54: mol_type = genomic DNA
ccgcgacagcaagaacggcagagccggcgaccgcggcggcggcggcggcggagg

SEQ ID NO: 50346 - DNA, 79 bp, Homo sapiens
  misc_feature 1..79: note = chr5:31193989-31194068
  misc_feature 1..79: note = hyper
  source 1..79: mol_type = genomic DNA
agaggtgggttcgggctccgttggctatgcatacatctccctttttttttttttaattctgtagcgttgatagaagcca

SEQ ID NO: 50347 - DNA, 15 bp, Homo sapiens
  misc_feature 1..15: note = chr5:31194276-31194291
  misc_feature 1..15: note = hyper
  source 1..15: mol_type = genomic DNA
gggggcaccgggaag

SEQ ID NO: 50348 - DNA, 64 bp, Homo sapiens
  misc_feature 1..64: note = chr5:31194311-31194375
  misc_feature 1..64: note = hyper
  source 1..64: mol_type = genomic DNA
cgctgcctttctctacgccggcagaggctgccaggggagctctggcatttgcaaagttggctgg

SEQ ID NO: 50349 - DNA, 43 bp, Homo sapiens
  misc_feature 1..43: note = chr5:31639641-31639684
  misc_feature 1..43: note = hyper
  source 1..43: mol_type = genomic DNA
gtttagctacaaatccgggtgcgggaatcccagccctggcagg

SEQ ID NO: 50350 - DNA, 35 bp, Homo sapiens; identical to SEQ ID NO: 29505
  misc_feature 1..35: note = chr5:31854940-31854975
  misc_feature 1..35: note = hyper
  source 1..35: mol_type = genomic DNA

SEQ ID NO: 50351 - DNA, 270 bp, Homo sapiens; identical to SEQ ID NO: 7769
  misc_feature 1..270: note = chr5:31855221-31855491
  misc_feature 1..270: note = hyper
  source 1..270: mol_type = genomic DNA

SEQ ID NO: 50352 - DNA, 139 bp, Homo sapiens
  misc_feature 1..139: note = chr5:32710192-32710331
  misc_feature 1..139: note = hyper
  source 1..139: mol_type = genomic DNA
agttccattttgacccgccccgccgcgcggcggactcccgcgatgctcctctggtcacggacttctccagagccgcttccctccggtctccaccgctgctgtggctatggccagtgggaggactgggtctccgaggcag

SEQ ID NO: 50353 - DNA, 311 bp, Homo sapiens
  misc_feature 1..311: note = chr5:32710470-32710781
  misc_feature 1..311: note = hyper
  source 1..311: mol_type = genomic DNA
agtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctg

SEQ ID NO: 50354 - DNA, 73 bp, Homo sapiens
  misc_feature 1..73: note = chr5:32711753-32711826
  misc_feature 1..73: note = hyper
  source 1..73: mol_type = genomic DNA
tctattttgttaaagcgcccaagggggcgcagggaccttggagagaagagtggggaggaaagaggaagggtgg

SEQ ID NO: 50355 - DNA, 273 bp, Homo sapiens; identical to SEQ ID NO: 18746
  misc_feature 1..273: note = chr5:32712491-32712764
  misc_feature 1..273: note = hyper
  source 1..273: mol_type = genomic DNA

SEQ ID NO: 50356 - DNA, 29 bp, Homo sapiens
  misc_feature 1..29: note = chr5:33892054-33892083
  misc_feature 1..29: note = hyper
  source 1..29: mol_type = genomic DNA
gggtgcatggtcaggcgcgagaaggcagc

SEQ ID NO: 50357 - DNA, 298 bp, Homo sapiens; identical to SEQ ID NO: 18748
  misc_feature 1..298: note = chr5:33892115-33892413
  misc_feature 1..298: note = hyper
  source 1..298: mol_type = genomic DNA

SEQ ID NO: 50358 - DNA, 113 bp, Homo sapiens
  misc_feature 1..113: note = chr5:33892443-33892556
  misc_feature 1..113: note = hyper
  source 1..113: mol_type = genomic DNA
caggccagccccccggcgtgcttaaatacaagctcaaaatgaggagaacagagttgaggcagaggggggccccactccctccatccttccgcgctcagcgctgccccctcccc

SEQ ID NO: 50359 - DNA, 26 bp, Homo sapiens
  misc_feature 1..26: note = chr5:33936336-33936362
  misc_feature 1..26: note = hyper
  source 1..26: mol_type = genomic DNA
acccactgacctccaggaagctgagc

SEQ ID NO: 50360 - DNA, 123 bp, Homo sapiens; identical to SEQ ID NO: 18751
  misc_feature 1..123: note = chr5:33936363-33936486
  misc_feature 1..123: note = hyper
  source 1..123: mol_type = genomic DNA

SEQ ID NO: 50361 - DNA, 83 bp, Homo sapiens
  misc_feature 1..83: note = chr5:33936516-33936599
  misc_feature 1..83: note = hyper
  source 1..83: mol_type = genomic DNA
gaccgcgggacacggagaggggaagtctgcgttgtacataaggacctagggactccgagcttggcctgagaacccttggacgc

SEQ ID NO: 50362 - DNA, 27 bp, Homo sapiens
  misc_feature 1..27: note = chr5:33936663-33936690
  misc_feature 1..27: note = hyper
  source 1..27: mol_type = genomic DNA
ctgcgtccagggcgttcgctgcgcgcc

SEQ ID NO: 50363 - DNA, 37 bp, Homo sapiens; identical to SEQ ID NO: 29517
  misc_feature 1..37: note = chr5:34655873-34655910
  misc_feature 1..37: note = hyper
  source 1..37: mol_type = genomic DNA

SEQ ID NO: 50364 - DNA, 41 bp, Homo sapiens; identical to SEQ ID NO: 29519
  misc_feature 1..41: note = chr5:35230049-35230090
  misc_feature 1..41: note = hyper
  source 1..41: mol_type = genomic DNA

SEQ ID NO: 50365 - DNA, 30 bp, Homo sapiens; identical to SEQ ID NO: 29520
  misc_feature 1..30: note = chr5:36607079-36607109
  misc_feature 1..30: note = hyper
  source 1..30: mol_type = genomic DNA

SEQ ID NO: 50366 - DNA, 133 bp, Homo sapiens; identical to SEQ ID NO: 7780
  misc_feature 1..133: note = chr5:36690192-36690325
  misc_feature 1..133: note = hyper
  source 1..133: mol_type = genomic DNA

SEQ ID NO: 50367 - DNA, 30 bp, Homo sapiens; identical to SEQ ID NO: 29522
  misc_feature 1..30: note = chr5:37371493-37371523
  misc_feature 1..30: note = hyper
  source 1..30: mol_type = genomic DNA

SEQ ID NO: 50368 - DNA, 69 bp, Homo sapiens
  misc_feature 1..69: note = chr5:37834615-37834684
  misc_feature 1..69: note = hyper
  source 1..69: mol_type = genomic DNA
cgcaccccttgcccacgggtcggtaggccacacagccatcaggctggcttggggtacgtgcggggctgg

SEQ ID NO: 50369 - DNA, 23 bp, Homo sapiens
  misc_feature 1..23: note = chr5:37834714-37834737
  misc_feature 1..23: note = hyper
  source 1..23: mol_type = genomic DNA
gcggcccccccgcggggagggaa

SEQ ID NO: 50370 - DNA, 556 bp, Homo sapiens
  misc_feature 1..556: note = chr5:37837992-37838548
  misc_feature 1..556: note = hyper
  source 1..556: mol_type = genomic DNA
ctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaa

SEQ ID NO: 50371 - DNA, 72 bp, Homo sapiens
  misc_feature 1..72: note = chr5:37838885-37838957
  misc_feature 1..72: note = hyper
  source 1..72: mol_type = genomic DNA
gagaaaaaggggtcattaaaataataacctcaatggcctagtggagtctcaagaatacgttcgagacagaga

SEQ ID NO: 50372 - DNA, 499 bp, Homo sapiens; identical to SEQ ID NO: 29525
  misc_feature 1..499: note = chr5:37839237-37839736
  misc_feature 1..499: note = hyper
  source 1..499: mol_type = genomic DNA

SEQ ID NO: 50373 - DNA, 95 bp, Homo sapiens; identical to SEQ ID NO: 18757
  misc_feature 1..95: note = chr5:37840125-37840220
  misc_feature 1..95: note = hyper
  source 1..95: mol_type = genomic DNA

SEQ ID NO: 50374 - DNA, 96 bp, Homo sapiens; identical to SEQ ID NO: 2551
  misc_feature 1..96: note = chr5:37840267-37840363
  misc_feature 1..96: note = hyper
  source 1..96: mol_type = genomic DNA

SEQ ID NO: 50375 - DNA, 41 bp, Homo sapiens
  misc_feature 1..41: note = chr5:38257444-38257485
  misc_feature 1..41: note = hyper
  source 1..41: mol_type = genomic DNA
tgtgaagagccaggacgcccaccgagtcctggcagcgttgc

SEQ ID NO: 50376 - DNA, 236 bp, Homo sapiens
  misc_feature 1..236: note = chr5:38257606-38257842
  misc_feature 1..236: note = hyper
  source 1..236: mol_type = genomic DNA
ttattccctcttggtttatttattgtatctgctttctcttctcgctggtttggaggtcagaacgccagtatgcaacgggacttgtgtcccaggcagggtctcccctctccaggcactaccgcgaaatctggcaaaaggtacattttactgagtcctagggcagcaaattcagcggcggagaaagagtctttctccattcaggagacaacccaggaagcccgatcccgggatcagag

SEQ ID NO: 50377 - DNA, 496 bp, Homo sapiens; identical to SEQ ID NO: 7793
  misc_feature 1..496: note = chr5:38258174-38258670
  misc_feature 1..496: note = hyper
  source 1..496: mol_type = genomic DNA

SEQ ID NO: 50378 - DNA, 287 bp, Homo sapiens; identical to SEQ ID NO: 29534
  misc_feature 1..287: note = chr5:38258671-38258958
  misc_feature 1..287: note = hyper
  source 1..287: mol_type = genomic DNA

SEQ ID NO: 50379 - DNA, 111 bp, Homo sapiens; identical to SEQ ID NO: 29535
  misc_feature 1..111: note = chr5:38556250-38556361
  misc_feature 1..111: note = hyper
  source 1..111: mol_type = genomic DNA

SEQ ID NO: 50380 - DNA, 24 bp, Homo sapiens
  misc_feature 1..24: note = chr5:38556411-38556435
  misc_feature 1..24: note = hyper
  source 1..24: mol_type = genomic DNA
cgcccacccgcccccaggactcac

SEQ ID NO: 50381 - DNA, 238 bp, Homo sapiens; identical to SEQ ID NO: 29537
  misc_feature 1..238: note = chr5:38556436-38556674
  misc_feature 1..238: note = hyper
  source 1..238: mol_type = genomic DNA

SEQ ID NO: 50382 - DNA, 134 bp, Homo sapiens; identical to SEQ ID NO: 29538
  misc_feature 1..134: note = chr5:38556773-38556907
  misc_feature 1..134: note = hyper
  source 1..134: mol_type = genomic DNA

SEQ ID NO: 50383 - DNA, 560 bp, Homo sapiens; identical to SEQ ID NO: 29541
  misc_feature 1..560: note = chr5:39425003-39425563
  misc_feature 1..560: note = hyper
  source 1..560: mol_type = genomic DNA

SEQ ID NO: 50384 - DNA, 70 bp, Homo sapiens; identical to SEQ ID NO: 29542
  misc_feature 1..70: note = chr5:40680557-40680627
  misc_feature 1..70: note = hyper
  source 1..70: mol_type = genomic DNA

SEQ ID NO: 50385 - DNA, 309 bp, Homo sapiens
  misc_feature 1..309: note = chr5:40681367-40681676
  misc_feature 1..309: note = hyper
  source 1..309: mol_type = genomic DNA
gtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctcctt

SEQ ID NO: 50386 - DNA, 14 bp, Homo sapiens
  misc_feature 1..14: note = chr5:40682069-40682083
  misc_feature 1..14: note = hyper
  source 1..14: mol_type = genomic DNA
gcctttaggtcggg

SEQ ID NO: 50387 - DNA, 34 bp, Homo sapiens; identical to SEQ ID NO: 29546
  misc_feature 1..34: note = chr5:41510835-41510869
  misc_feature 1..34: note = hyper
  source 1..34: mol_type = genomic DNA

SEQ ID NO: 50388 - DNA, 38 bp, Homo sapiens; identical to SEQ ID NO: 29547
  misc_feature 1..38: note = chr5:42423455-42423493
  misc_feature 1..38: note = hyper
  source 1..38: mol_type = genomic DNA

SEQ ID NO: 50389 - DNA, 30 bp, Homo sapiens; identical to SEQ ID NO: 29548
  misc_feature 1..30: note = chr5:42423828-42423858
  misc_feature 1..30: note = hyper
  source 1..30: mol_type = genomic DNA

SEQ ID NO: 50390 - DNA, 150 bp, Homo sapiens; identical to SEQ ID NO: 18764
  misc_feature 1..150: note = chr5:42424672-42424822
  misc_feature 1..150: note = hyper
  source 1..150: mol_type = genomic DNA

SEQ ID NO: 50391 - DNA, 99 bp, Homo sapiens; identical to SEQ ID NO: 18765
  misc_feature 1..99: note = chr5:42425060-42425159
  misc_feature 1..99: note = hyper
  source 1..99: mol_type = genomic DNA

SEQ ID NO: 50392 - DNA, 88 bp, Homo sapiens; identical to SEQ ID NO: 29550
  misc_feature 1..88: note = chr5:42950080-42950168
  misc_feature 1..88: note = hyper
  source 1..88: mol_type = genomic DNA

SEQ ID NO: 50393 - DNA, 40 bp, Homo sapiens; identical to SEQ ID NO: 18766
  misc_feature 1..40: note = chr5:42991785-42991825
  misc_feature 1..40: note = hyper
  source 1..40: mol_type = genomic DNA

SEQ ID NO: 50394 - DNA, 91 bp, Homo sapiens
  misc_feature 1..91: note = chr5:42992934-42993025
  misc_feature 1..91: note = hyper
  source 1..91: mol_type = genomic DNA
accccgcagattcgtctgtcgttggcttgttggtcctaacaagtttcgatttcagggtgcctgcgtttctttttcttttctcttcttttcc

SEQ ID NO: 50395 - DNA, 24 bp, Homo sapiens
  misc_feature 1..24: note = chr5:42994670-42994694
  misc_feature 1..24: note = hyper
  source 1..24: mol_type = genomic DNA
gctctgcttctaatgcggagctgg

SEQ ID NO: 50396 - DNA, 118 bp, Homo sapiens; identical to SEQ ID NO: 18768
  misc_feature 1..118: note = chr5:43007818-43007936
  misc_feature 1..118: note = hyper
  source 1..118: mol_type = genomic DNA

SEQ ID NO: 50397 - DNA, 236 bp, Homo sapiens; identical to SEQ ID NO: 18769
  misc_feature 1..236: note = chr5:43007966-43008202
  misc_feature 1..236: note = hyper
  source 1..236: mol_type = genomic DNA

SEQ ID NO: 50398 - DNA, 199 bp, Homo sapiens; identical to SEQ ID NO: 7810
  misc_feature 1..199: note = chr5:43008737-43008936
  misc_feature 1..199: note = hyper
  source 1..199: mol_type = genomic DNA

SEQ ID NO: 50399 - DNA, 228 bp, Homo sapiens
  misc_feature 1..228: note = chr5:43019010-43019238
  misc_feature 1..228: note = hyper
  source 1..228: mol_type = genomic DNA
atgcgattttttttaggtttaccgatgatcagtttagcagtgcctgggagctcttataccaagtttgttttcgcaatattgagtcccaccttagctaagcttgtgtgtattttaaactcccatggaagtcaggaaatgtccgcaaacgcgatttctggttaccaagctccgtttggcaatagcaagtcctgccgaacgcgactttttcctcttgtggaccaagtctga

SEQ ID NO: 50400 - DNA, 159 bp, Homo sapiens
  misc_feature 1..159: note = chr5:43019650-43019809
  misc_feature 1..159: note = hyper
  source 1..159: mol_type = genomic DNA
ccggggagccgagctcggtctcagtctccctgctgtcaggtgccaggttgtgtctggtggctctccttcgtatgcggagctgatggttttgcatcagcgcttttgccagtagagccgactagcgttttctcagttacggcaccgttcttagcgcccagt

SEQ ID NO: 50401 - skipped

SEQ ID NO: 50402 - DNA, 64 bp, Homo sapiens
  misc_feature 1..64: note = chr5:43040964-43041028
  misc_feature 1..64: note = hyper
  source 1..64: mol_type = genomic DNA
aaaagtgacagcactgagaacctaaggaccccgcgaacgggaaatgtcacgttgggtgcagcaa

SEQ ID NO: 50403 - DNA, 32 bp, Homo sapiens; identical to SEQ ID NO: 29567
  misc_feature 1..32: note = chr5:43043256-43043288
  misc_feature 1..32: note = hyper
  source 1..32: mol_type = genomic DNA

SEQ ID NO: 50404 - DNA, 267 bp, Homo sapiens; identical to SEQ ID NO: 29568
  misc_feature 1..267: note = chr5:43191854-43192121
  misc_feature 1..267: note = hyper
  source 1..267: mol_type = genomic DNA

SEQ ID NO: 50405 - DNA, 682 bp, Homo sapiens; identical to SEQ ID NO: 29569
  misc_feature 1..682: note = chr5:43192458-43193140
  misc_feature 1..682: note = hyper
  source 1..682: mol_type = genomic DNA

SEQ ID NO: 50406 - DNA, 33 bp, Homo sapiens; identical to SEQ ID NO: 18776
  misc_feature 1..33: note = chr5:43396969-43397002
  misc_feature 1..33: note = hyper
  source 1..33: mol_type = genomic DNA

SEQ ID NO: 50407 - DNA, 160 bp, Homo sapiens; identical to SEQ ID NO: 29571
  misc_feature 1..160: note = chr5:43397305-43397465
  misc_feature 1..160: note = hyper
  source 1..160: mol_type = genomic DNA

SEQ ID NO: 50408 - DNA, 369 bp, Homo sapiens; identical to SEQ ID NO: 29572
  misc_feature 1..369: note = chr5:44388243-44388612
  misc_feature 1..369: note = hyper
  source 1..369: mol_type = genomic DNA

SEQ ID NO: 50409 - DNA, 65 bp, Homo sapiens; identical to SEQ ID NO: 29573
  misc_feature 1..65: note = chr5:44388856-44388921
  misc_feature 1..65: note = hyper
  source 1..65: mol_type = genomic DNA

SEQ ID NO: 50410 - DNA, 174 bp, Homo sapiens; identical to SEQ ID NO: 29574
  misc_feature 1..174: note = chr5:44389326-44389500
  misc_feature 1..174: note = hyper
  source 1..174: mol_type = genomic DNA

SEQ ID NO: 50411 - DNA, 502 bp, Homo sapiens
  misc_feature 1..502: note = chr5:44389852-44390354
  misc_feature 1..502: note = hyper
  source 1..502: mol_type = genomic DNA
acggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcaggttataaactggtcagaacgagcacagaaaaggaagacataattagtgtcctttcctcctctgctgccagcttccaaggaggtctcctctttaatgaatcactgatttctcgcttccgttgctgaagtaaaaagttcacactttggccctctctgccttttaagctcagggagatttatcgtcacccttaaaagttgcctctctcggcgcaaatgaaatcagggacccaaataaccgatttctaattgct

SEQ ID NO: 50412 - DNA, 43 bp, Homo sapiens
  misc_feature 1..43: note = chr5:45695143-45695186
  misc_feature 1..43: note = hyper
  source 1..43: mol_type = genomic DNA
tttggtgagacctcacgtcagggactatccaagtgcaaattgc

SEQ ID NO: 50413 - DNA, 75 bp, Homo sapiens; identical to SEQ ID NO: 18781
  misc_feature 1..75: note = chr5:45695533-45695608
  misc_feature 1..75: note = hyper
  source 1..75: mol_type = genomic DNA

SEQ ID NO: 50414 - DNA, 24 bp, Homo sapiens
  misc_feature 1..24: note = chr5:45695648-45695672
  misc_feature 1..24: note = hyper
  source 1..24: mol_type = genomic DNA
cgccggcagcgccaccccccgccc

SEQ ID NO: 50415 - DNA, 17 bp, Homo sapiens
  misc_feature 1..17: note = chr5:45695947-45695964
  misc_feature 1..17: note = hyper
  source 1..17: mol_type = genomic DNA
tcttcgaagccccccgc

SEQ ID NO: 50416 - DNA, 23 bp, Homo sapiens
  misc_feature 1..23: note = chr5:45696313-45696336
  misc_feature 1..23: note = hyper
  source 1..23: mol_type = genomic DNA
tcgcggcggcggcggcggcggcg

SEQ ID NO: 50417 - DNA, 16 bp, Homo sapiens
  misc_feature 1..16: note = chr5:45696439-45696455
  misc_feature 1..16: note = hyper
  source 1..16: mol_type = genomic DNA
tgaagctgaggctgcc

SEQ ID NO: 50418 - skipped

SEQ ID NO: 50419 - DNA, 57 bp, Homo sapiens; identical to SEQ ID NO: 29582
  misc_feature 1..57: note = chr5:45696466-45696523
  misc_feature 1..57: note = hyper
  source 1..57: mol_type = genomic DNA

SEQ ID NO: 50420 - DNA, 293 bp, Homo sapiens; identical to SEQ ID NO: 18783
  misc_feature 1..293: note = chr5:49736685-49736978
  misc_feature 1..293: note = hyper
  source 1..293: mol_type = genomic DNA

SEQ ID NO: 50421 - DNA, 201 bp, Homo sapiens; identical to SEQ ID NO: 29584
  misc_feature 1..201: note = chr5:49737098-49737299
  misc_feature 1..201: note = hyper
  source 1..201: mol_type = genomic DNA

SEQ ID NO: 50422 - DNA, 84 bp, Homo sapiens; identical to SEQ ID NO: 18785
  misc_feature 1..84: note = chr5:50263484-50263568
  misc_feature 1..84: note = hyper
  source 1..84: mol_type = genomic DNA

SEQ ID NO: 50423 - DNA, 111 bp, Homo sapiens; identical to SEQ ID NO: 29586
  misc_feature 1..111: note = chr5:50264180-50264291
  misc_feature 1..111: note = hyper
  source 1..111: mol_type = genomic DNA

SEQ ID NO: 50424 - DNA, 217 bp, Homo sapiens
  misc_feature 1..217: note = chr5:50264603-50264820
  misc_feature 1..217: note = hyper
  source 1..217: mol_type = genomic DNA
taaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcaca

SEQ ID NO: 50425 - DNA, 96 bp, Homo sapiens; identical to SEQ ID NO: 29588
  misc_feature 1..96: note = chr5:50265070-50265166
  misc_feature 1..96: note = hyper
  source 1..96: mol_type = genomic DNA

SEQ ID NO: 50426 - DNA, 135 bp, Homo sapiens
  misc_feature 1..135: note = chr5:50265190-50265325
  misc_feature 1..135: note = hyper
  source 1..135: mol_type = genomic DNA
cgggcgagagcaaggagcctcccggccacacagccacaggcgctgcggaacccagcccggactctccccggctggagtgtgcgaagggcttcccgcccaggggcccagggtggtcttagtgaaaaagggatggcg

SEQ ID NO: 50427 - DNA, 243 bp, Homo sapiens; identical to SEQ ID NO: 18787
  misc_feature 1..243: note = chr5:50265429-50265672
  misc_feature 1..243: note = hyper
  source 1..243: mol_type = genomic DNA

SEQ ID NO: 50428 - skipped

SEQ ID NO: 50429 - DNA, 32 bp, Homo sapiens; identical to SEQ ID NO: 29592
  misc_feature 1..32: note = chr5:50678159-50678191
  misc_feature 1..32: note = hyper
  source 1..32: mol_type = genomic DNA

SEQ ID NO: 50430 - DNA, 286 bp, Homo sapiens; identical to SEQ ID NO: 29593
  misc_feature 1..286: note = chr5:50683270-50683556
  misc_feature 1..286: note = hyper
  source 1..286: mol_type = genomic DNA

SEQ ID NO: 50431 - DNA, 143 bp, Homo sapiens; identical to SEQ ID NO: 29594
  misc_feature 1..143: note = chr5:50685653-50685796
  misc_feature 1..143: note = hyper
  source 1..143: mol_type = genomic DNA

SEQ ID NO: 50432 - DNA, 229 bp, Homo sapiens; identical to SEQ ID NO: 7833
  misc_feature 1..229: note = chr5:50685846-50686075
  misc_feature 1..229: note = hyper
  source 1..229: mol_type = genomic DNA

SEQ ID NO: 50433 - DNA, 63 bp, Homo sapiens; identical to SEQ ID NO: 29596
  misc_feature 1..63: note = chr5:50694717-50694780
  misc_feature 1..63: note = hyper
  source 1..63: mol_type = genomic DNA

SEQ ID NO: 50434 - DNA, 190 bp, Homo sapiens; identical to SEQ ID NO: 29597
  misc_feature 1..190: note = chr5:50695051-50695241
  misc_feature 1..190: note = hyper
  source 1..190: mol_type = genomic DNA

SEQ ID NO: 50435 - DNA, 343 bp, Homo sapiens; identical to SEQ ID NO: 29599
  misc_feature 1..343: note = chr5:52776466-52776809
  misc_feature 1..343: note = hyper
  source 1..343: mol_type = genomic DNA

SEQ ID NO: 50436 - DNA, 30 bp, Homo sapiens; identical to SEQ ID NO: 29600
  misc_feature 1..30: note = chr5:52778616-52778646
  misc_feature 1..30: note = hyper
  source 1..30: mol_type = genomic DNA

SEQ ID NO: 50437 - DNA, 267 bp, Homo sapiens
  misc_feature 1..267: note = chr5:54179796-54180063
  misc_feature 1..267: note = hyper
  source 1..267: mol_type = genomic DNA
cagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcg

SEQ ID NO: 50438 - DNA, 44 bp, Homo sapiens; identical to SEQ ID NO: 29602
  misc_feature 1..44: note = chr5:54472206-54472250
  misc_feature 1..44: note = hyper
  source 1..44: mol_type = genomic DNA

SEQ ID NO: 50439 - DNA, 30 bp, Homo sapiens; identical to SEQ ID NO: 29603
  misc_feature 1..30: note = chr5:54472512-54472542
  misc_feature 1..30: note = hyper
  source 1..30: mol_type = genomic DNA

SEQ ID NO: 50440 - DNA, 37 bp, Homo sapiens; identical to SEQ ID NO: 18791
  misc_feature 1..37: note = chr5:54516334-54516371
  misc_feature 1..37: note = hyper
  source 1..37: mol_type = genomic DNA

SEQ ID NO: 50441 - DNA, 43 bp, Homo sapiens; identical to SEQ ID NO: 29607
  misc_feature 1..43: note = chr5:54519598-54519641
  misc_feature 1..43: note = hyper
  source 1..43: mol_type = genomic DNA

SEQ ID NO: 50442 - DNA, 293 bp, Homo sapiens; identical to SEQ ID NO: 18792
  misc_feature 1..293: note = chr5:54527343-54527636
  misc_feature 1..293: note = hyper
  source 1..293: mol_type = genomic DNA

SEQ ID NO: 50443 - DNA, 379 bp, Homo sapiens
  misc_feature 1..379: note = chr5:57877892-57878271
  misc_feature 1..379: note = hyper
  source 1..379: mol_type = genomic DNA
gcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtg

SEQ ID NO: 50444 - DNA, 165 bp, Homo sapiens; identical to SEQ ID NO: 18794
  misc_feature 1..165: note = chr5:57878375-57878540
  misc_feature 1..165: note = hyper
  source 1..165: mol_type = genomic DNA

SEQ ID NO: 50445 - DNA, 16 bp, Homo sapiens
  misc_feature 1..16: note = chr5:57878937-57878953
  misc_feature 1..16: note = hyper
  source 1..16: mol_type = genomic DNA
gtgcagagtgtggagc

SEQ ID NO: 50446 - DNA, 236 bp, Homo sapiens; identical to SEQ ID NO: 29611
  misc_feature 1..236: note = chr5:57878954-57879190
  misc_feature 1..236: note = hyper
  source 1..236: mol_type = genomic DNA

SEQ ID NO: 50447 - DNA, 204 bp, Homo sapiens; identical to SEQ ID NO: 29612
  misc_feature 1..204: note = chr5:58335149-58335353
  misc_feature 1..204: note = hyper
  source 1..204: mol_type = genomic DNA

SEQ ID NO: 50448 - DNA, 305 bp, Homo sapiens; identical to SEQ ID NO: 29613
  misc_feature 1..305: note = chr5:58335572-58335877
  misc_feature 1..305: note = hyper
  source 1..305: mol_type = genomic DNA

SEQ ID NO: 50449 - DNA, 30 bp, Homo sapiens; identical to SEQ ID NO: 29614
  misc_feature 1..30: note = chr5:59188418-59188448
  misc_feature 1..30: note = hyper
  source 1..30: mol_type = genomic DNA

SEQ ID NO: 50450 - DNA, 90 bp, Homo sapiens
  misc_feature 1..90: note = chr5:59188965-59189055
  misc_feature 1..90: note = hyper
  source 1..90: mol_type = genomic DNA
gaatgggggagggggcgctctccactcaccgcctgagtccctggaacgaggagggccaggacatcctggatttcttcaggccgggccggt

SEQ ID NO: 50451 - DNA, 292 bp, Homo sapiens; identical to SEQ ID NO: 18798
  misc_feature 1..292: note = chr5:59189206-59189498
  misc_feature 1..292: note = hyper
  source 1..292: mol_type = genomic DNA

SEQ ID NO: 50452 - DNA, 33 bp, Homo sapiens
  misc_feature 1..33: note = chr5:59189830-59189863
  misc_feature 1..33: note = hyper
  source 1..33: mol_type = genomic DNA
aagcagcagcaacggcggcggcggcagtggtag

SEQ ID NO: 50453 - DNA, 81 bp, Homo sapiens; identical to SEQ ID NO: 18799
  misc_feature 1..81: note = chr5:59189948-59190029
  misc_feature 1..81: note = hyper
  source 1..81: mol_type = genomic DNA

SEQ ID NO: 50454 - DNA, 30 bp, Homo sapiens; identical to SEQ ID NO: 29619
  misc_feature 1..30: note = chr5:63257323-63257353
  misc_feature 1..30: note = hyper
  source 1..30: mol_type = genomic DNA

SEQ ID NO: 50455 - DNA, 171 bp, Homo sapiens; identical to SEQ ID NO: 29621
  misc_feature 1..171: note = chr5:63461448-63461619
  misc_feature 1..171: note = hyper
  source 1..171: mol_type = genomic DNA

SEQ ID NO: 50456 - DNA, 205 bp, Homo sapiens; identical to SEQ ID NO: 29622
  misc_feature 1..205: note = chr5:63461914-63462119
  misc_feature 1..205: note = hyper
  source 1..205: mol_type = genomic DNA

SEQ ID NO: 50457 - DNA, 199 bp, Homo sapiens
  misc_feature 1..199: note = chr5:63801808-63802007
  misc_feature 1..199: note = hyper
  source 1..199: mol_type = genomic DNA
caacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaag

SEQ ID NO: 50458 - DNA, 31 bp, Homo sapiens
  misc_feature 1..31: note = chr5:63802514-63802545
  misc_feature 1..31: note = hyper
  source 1..31: mol_type = genomic DNA
cagatcagcaagcccccgctgcagagcggag

SEQ ID NO: 50459 - DNA, 38 bp, Homo sapiens; identical to SEQ ID NO: 18801
  misc_feature 1..38: note = chr5:63986450-63986488
  misc_feature 1..38: note = hyper
  source 1..38: mol_type = genomic DNA

SEQ ID NO: 50460 - DNA, 155 bp, Homo sapiens
  misc_feature 1..155: note = chr5:63986807-63986962
  misc_feature 1..155: note = hyper
  source 1..155: mol_type = genomic DNA
agagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgct

SEQ ID NO: 50461 - DNA, 30 bp, Homo sapiens; identical to SEQ ID NO: 29628
  misc_feature 1..30: note = chr5:65891802-65891832
  misc_feature 1..30: note = hyper
  source 1..30: mol_type = genomic DNA

SEQ ID NO: 50462 - DNA, 56 bp, Homo sapiens; identical to SEQ ID NO: 29629
  misc_feature 1..56: note = chr5:65893398-65893454
  misc_feature 1..56: note = hyper
  source 1..56: mol_type = genomic DNA

SEQ ID NO: 50463 - DNA, 291 bp, Homo sapiens; identical to SEQ ID NO: 29630
  misc_feature 1..291: note = chr5:67583945-67584236
  misc_feature 1..291: note = hyper
  source 1..291: mol_type = genomic DNA

SEQ ID NO: 50464 - DNA, 44 bp, Homo sapiens
  misc_feature 1..44: note = chr5:71014676-71014720
  misc_feature 1..44: note = hyper
  source 1..44: mol_type = genomic DNA
gcaaggcagggctggcgaggtggatgttgcagctgtcaccactg

SEQ ID NO: 50465 - DNA, 84 bp, Homo sapiens
  misc_feature 1..84: note = chr5:71014895-71014979
  misc_feature 1..84: note = hyper
  source 1..84: mol_type = genomic DNA
tctgcgctctagcccatctgtgcgcagagcctcgttcccaggcgcctggaacccggcgggcattgacgtcaagcgccggcggag

SEQ ID NO: 50466 - DNA, 149 bp, Homo sapiens
  misc_feature 1..149: note = chr5:71015031-71015180
  misc_feature 1..149: note = hyper
  source 1..149: mol_type = genomic DNA
cgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgcta

SEQ ID NO: 50467 - DNA, 40 bp, Homo sapiens; identical to SEQ ID NO: 29633
  misc_feature 1..40: note = chr5:71015825-71015865
  misc_feature 1..40: note = hyper
  source 1..40: mol_type = genomic DNA

SEQ ID NO: 50468 - DNA, 30 bp, Homo sapiens; identical to SEQ ID NO: 29634
  misc_feature 1..30: note = chr5:71402862-71402892
  misc_feature 1..30: note = hyper
  source 1..30: mol_type = genomic DNA

SEQ ID NO: 50469 - DNA, 444 bp, Homo sapiens
  misc_feature 1..444: note = chr5:71403122-71403566
  misc_feature 1..444: note = hyper
  source 1..444: mol_type = genomic DNA
gtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagag

SEQ ID NO: 50470 - DNA, 77 bp, Homo sapiens; identical to SEQ ID NO: 29637
  misc_feature 1..77: note = chr5:71404665-71404742
  misc_feature 1..77: note = hyper
  source 1..77: mol_type = genomic DNA

SEQ ID NO: 50471 - DNA, 112 bp, Homo sapiens; identical to SEQ ID NO: 29638
  misc_feature 1..112: note = chr5:71404743-71404855
  misc_feature 1..112: note = hyper
  source 1..112: mol_type = genomic DNA

SEQ ID NO: 50472 - DNA, 19 bp, Homo sapiens
  misc_feature 1..19: note = chr5:72415904-72415923
  misc_feature 1..19: note = hyper
  source 1..19: mol_type = genomic DNA
tggccaaggccaaggcggc

SEQ ID NO: 50473 - DNA, 143 bp, Homo sapiens; identical to SEQ ID NO: 29640
  misc_feature 1..143: note = chr5:72416022-72416165
  misc_feature 1..143: note = hyper
  source 1..143: mol_type = genomic DNA

SEQ ID NO: 50474 - DNA, 207 bp, Homo sapiens; identical to SEQ ID NO: 29641
  misc_feature 1..207: note = chr5:72497943-72498150
  misc_feature 1..207: note = hyper
  source 1..207: mol_type = genomic DNA

SEQ ID NO: 50475 - DNA, 97 bp, Homo sapiens; identical to SEQ ID NO: 29642
  misc_feature 1..97: note = chr5:72512278-72512375
  misc_feature 1..97: note = hyper
  source 1..97: mol_type = genomic DNA

SEQ ID NO: 50476 - DNA, 29 bp, Homo sapiens
  misc_feature 1..29: note = chr5:72526037-72526066
  misc_feature 1..29: note = hyper
  source 1..29: mol_type = genomic DNA
gctactgctagccctcgccccagactgtc

SEQ ID NO: 50477 - DNA, 18 bp, Homo sapiens
  misc_feature 1..18: note = chr5:72526395-72526413
  misc_feature 1..18: note = hyper
  source 1..18: mol_type = genomic DNA
gtgggcccaatgctccgg

SEQ ID NO: 50478 - DNA, 27 bp, Homo sapiens
  misc_feature 1..27: note = chr5:72526643-72526670
  misc_feature 1..27: note = hyper
  source 1..27: mol_type = genomic DNA
gttagggggctgcgctagcagggacat

SEQ ID NO: 50479 - DNA, 114 bp, Homo sapiens; identical to SEQ ID NO: 29646
  misc_feature 1..114: note = chr5:72528189-72528303
  misc_feature 1..114: note = hyper
  source 1..114: mol_type = genomic DNA

SEQ ID NO: 50480 - DNA, 30 bp, Homo sapiens; identical to SEQ ID NO: 29647
  misc_feature 1..30: note = chr5:72528599-72528629
  misc_feature 1..30: note = hyper
  source 1..30: mol_type = genomic DNA

SEQ ID NO: 50481 - DNA, 191 bp, Homo sapiens
  misc_feature 1..191: note = chr5:72529098-72529289
  misc_feature 1..191: note = hyper
  source 1..191: mol_type = genomic DNA
ccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggg

SEQ ID NO: 50482 - DNA, 27 bp, Homo sapiens
  misc_feature 1..27: note = chr5:72530609-72530636
  misc_feature 1..27: note = hyper
  source 1..27: mol_type = genomic DNA
agttgggaggaccgtggggatgtagat

SEQ ID NO: 50483 - DNA, 26 bp, Homo sapiens
  misc_feature 1..26: note = chr5:72594776-72594802
  misc_feature 1..26: note = hyper
  source 1..26: mol_type = genomic DNA
aaaaggcaccgggcacggaggtttaa

SEQ ID NO: 50484 - DNA, 483 bp, Homo sapiens
  misc_feature 1..483: note = chr5:72595059-72595542
  misc_feature 1..483: note = hyper
  source 1..483: mol_type = genomic DNA
ggcttcccagtcaccctgcggcgacgcttctccctcccgggaatgacaccttcgctcgctttcacacagccaagccgttggagaggcagaaacagtgggtcccgagcccgcaggagaagttcccatcccgcccctctagccctcgggcgttggcagtggagtaacaaagacgctgccgcgccgttgaccccgaagaagctctgatgaaaaggagggcgggccgcgggataggagtttctacaattagttttttctgcctttacgttcccaagaagaagccgaggaagtagaaaggagagagatctgggaaaggcaagatccagaaatcaggagccattatgtttctcattttggagaaaaactgtaaaacagctcggcctcttgtccaccttgccccgaaggcaagtctggatatgaaaagaaaaaggcgggcaacggaggagatttatttttcattttaactttcctctcccaggcttcctc

SEQ ID NO: 50485 - DNA, 30 bp, Homo sapiens; identical to SEQ ID NO: 7871
  misc_feature 1..30: note = chr5:72596861-72596891
  misc_feature 1..30: note = hyper
  source 1..30: mol_type = genomic DNA

SEQ ID NO: 50486 - DNA, 72 bp, Homo sapiens; identical to SEQ ID NO: 7872
  misc_feature 1..72: note = chr5:72598030-72598102
  misc_feature 1..72: note = hyper
  source 1..72: mol_type = genomic DNA

SEQ ID NO: 50487 - DNA, 20 bp, Homo sapiens
  misc_feature 1..20: note = chr5:72599059-72599079
  misc_feature 1..20: note = hyper
  source 1..20: mol_type = genomic DNA
cgaatgcagcgcccgggagt

SEQ ID NO: 50488 - DNA, 25 bp, Homo sapiens
  misc_feature 1..25: note = chr5:72599833-72599858
  misc_feature 1..25: note = hyper
  source 1..25: mol_type = genomic DNA
ttctcctcaccgttaataactggca

SEQ ID NO: 50489 - DNA, 30 bp, Homo sapiens; identical to SEQ ID NO: 7875
  misc_feature 1..30: note = chr5:72608427-72608457
  misc_feature 1..30: note = hyper
  source 1..30: mol_type = genomic DNA

SEQ ID NO: 50490 - DNA, 44 bp, Homo sapiens
  misc_feature 1..44: note = chr5:72716058-72716102
  misc_feature 1..44: note = hyper
  source 1..44: mol_type = genomic DNA
atgtcccctaaagcacgggaagcttcgtgttttatgtttgggct

SEQ ID NO: 50491 - DNA, 30 bp, Homo sapiens; identical to SEQ ID NO: 29666
  misc_feature 1..30: note = chr5:72731806-72731836
  misc_feature 1..30: note = hyper
  source 1..30: mol_type = genomic DNA

SEQ ID NO: 50492 - DNA, 26 bp, Homo sapiens
  misc_feature 1..26: note = chr5:72732884-72732910
  misc_feature 1..26: note = hyper
  source 1..26: mol_type = genomic DNA
gtgcccgaggtttctctgcccttctc

SEQ ID NO: 50493 - DNA, 81 bp, Homo sapiens
  misc_feature 1..81: note = chr5:72733012-72733093
  misc_feature 1..81: note = hyper
  source 1..81: mol_type = genomic DNA
gctcgccacagccggcgggaggcggggaagggagcagcccgggtggcttggagaacactgaacctttaattgggctataaa

SEQ ID NO: 50494 - DNA, 30 bp, Homo sapiens; identical to SEQ ID NO: 7879
  misc_feature 1..30: note = chr5:72733558-72733588
  misc_feature 1..30: note = hyper
  source 1..30: mol_type = genomic DNA

SEQ ID NO: 50495 - DNA, 26 bp, Homo sapiens
  misc_feature 1..26: note = chr5:72740121-72740147
  misc_feature 1..26: note = hyper
  source 1..26: mol_type = genomic DNA
cccgcgctcctggctcgcccatccag

SEQ ID NO: 50496 - DNA, 155 bp, Homo sapiens
  misc_feature 1..155: note = chr5:72740184-72740339
  misc_feature 1..155: note = hyper
  source 1..155: mol_type = genomic DNA
ccacacctctcgcagctcatacctcacccgccccgcggccctgcttcccccagtctcatcctctcgggagcaggcccgcagggtctgcaaggccaagaacggaaccccaaacgcagagggtggggaggtgagcggcaggacgcaaaactcggaat

SEQ ID NO: 50497 - DNA, 232 bp, Homo sapiens; identical to SEQ ID NO: 7881
  misc_feature 1..232: note = chr5:72742850-72743082
  misc_feature 1..232: note = hyper
  source 1..232: mol_type = genomic DNA

SEQ ID NO: 50498 - DNA, 1092 bp, Homo sapiens; identical to SEQ ID NO: 29672
  misc_feature 1..1092: note = chr5:72743389-72744481
  misc_feature 1..1092: note = hyper
  source 1..1092: mol_type = genomic DNA

SEQ ID NO: 50499 - DNA, 485 bp, Homo sapiens; identical to SEQ ID NO: 29673
  misc_feature 1..485: note = chr5:72744697-72745182
  misc_feature 1..485: note = hyper
  source 1..485: mol_type = genomic DNA

SEQ ID NO: 50500 - DNA, 161 bp, Homo sapiens; identical to SEQ ID NO: 29675
  misc_feature 1..161: note = chr5:72746992-72747153
  misc_feature 1..161: note = hyper
  source 1..161: mol_type = genomic DNA

SEQ ID NO: 50501 - DNA, 34 bp, Homo sapiens; identical to SEQ ID NO: 29676
  misc_feature 1..34: note = chr5:72747486-72747520
  misc_feature 1..34: note = hyper
  source 1..34: mol_type = genomic DNA

SEQ ID NO: 50502 - DNA, 67 bp, Homo sapiens; identical to SEQ ID NO: 29677
  misc_feature 1..67: note = chr5:74161713-74161780
  misc_feature 1..67: note = hyper
  source 1..67: mol_type = genomic DNA

SEQ ID NO: 50503 - DNA, 87 bp, Homo sapiens; identical to SEQ ID NO: 29678
  misc_feature 1..87: note = chr5:74162506-74162593
  misc_feature 1..87: note = hyper
  source 1..87: mol_type = genomic DNA

SEQ ID NO: 50504 - DNA, 30 bp, Homo sapiens; identical to SEQ ID NO: 29679
  misc_feature 1..30: note = chr5:74348254-74348284
  misc_feature 1..30: note = hyper
  source 1..30: mol_type = genomic DNA

SEQ ID NO: 50505 - DNA, 57 bp, Homo sapiens; identical to SEQ ID NO: 29680
  misc_feature 1..57: note = chr5:74349876-74349933
  misc_feature 1..57: note = hyper
  source 1..57: mol_type = genomic DNA

SEQ ID NO: 50506 - DNA, 264 bp, Homo sapiens
  misc_feature 1..264: note = chr5:75378033-75378297
  misc_feature 1..264: note = hyper
  source 1..264: mol_type = genomic DNA
cgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 50507 - DNA, 30 bp, Homo sapiens; identical to SEQ ID NO: 29682
  misc_feature 1..30: note = chr5:75378559-75378589
  misc_feature 1..30: note = hyper
  source 1..30: mol_type = genomic DNA

SEQ ID NO: 50508 - DNA, 689 bp, Homo sapiens; identical to SEQ ID NO: 29683
  misc_feature 1..689: note = chr5:75379005-75379694
  misc_feature 1..689: note = hyper
  source 1..689: mol_type = genomic DNA

SEQ ID NO: 50509 - DNA, 96 bp, Homo sapiens; identical to SEQ ID NO: 18826
  misc_feature 1..96: note = chr5:75380067-75380163
  misc_feature 1..96: note = hyper
  source 1..96: mol_type = genomic DNA

SEQ ID NO: 50510 - DNA, 431 bp, Homo sapiens
  misc_feature 1..431: note = chr5:75380193-75380624
  misc_feature 1..431: note = hyper
  source 1..431: mol_type = genomic DNA
ttctcttagtgggcttttccccttccgcctgggttctagaactgggaagacttttctccagagcgtcgcggggagcgccccgggctgggcccacggggactgcggaatacggggatgaacttggcttggggcagccagcaccccacggcagatgaacaatcgggagcagatctgtgggcgtgcggggaccttaggcggcgcgcgggggcggggggaggggctgagccacgggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcgg

SEQ ID NO: 50511 - DNA, 48 bp, Homo sapiens; identical to SEQ ID NO: 29685
  misc_feature 1..48: note = chr5:75699645-75699693
  misc_feature 1..48: note = hyper
  source 1..48: mol_type = genomic DNA

SEQ ID NO: 50512 - DNA, 30 bp, Homo sapiens; identical to SEQ ID NO: 29686
  misc_feature 1..30: note = chr5:75700119-75700149
  misc_feature 1..30: note = hyper
  source 1..30: mol_type = genomic DNA

SEQ ID NO: 50513 - DNA, 79 bp, Homo sapiens
  misc_feature 1..79: note = chr5:76011206-76011285
  misc_feature 1..79: note = hyper
  source 1..79: mol_type = genomic DNA
aagggaagagctccgcgaggccgcgcgggggggaagcgggagaagccgctcttcctattccactcgcagtctgcgtgtg

SEQ ID NO: 50514 - DNA, 17 bp, Homo sapiens
  misc_feature 1..17: note = chr5:76011337-76011354
  misc_feature 1..17: note = hyper
  source 1..17: mol_type = genomic DNA
gacgtataaaagttcaa

SEQ ID NO: 50515 - DNA, 30 bp, Homo sapiens; identical to SEQ ID NO: 29688
  misc_feature 1..30: note = chr5:76115162-76115192
  misc_feature 1..30: note = hyper
  source 1..30: mol_type = genomic DNA

SEQ ID NO: 50516 - DNA, 114 bp, Homo sapiens; identical to SEQ ID NO: 29689
  misc_feature 1..114: note = chr5:76115495-76115609
  misc_feature 1..114: note = hyper
  source 1..114: mol_type = genomic DNA

SEQ ID NO: 50517 - DNA, 26 bp, Homo sapiens
  misc_feature 1..26: note = chr5:76250409-76250435
  misc_feature 1..26: note = hyper
  source 1..26: mol_type = genomic DNA
cttggttagaaggcccgccccacacg

SEQ ID NO: 50518 - DNA, 394 bp, Homo sapiens; identical to SEQ ID NO: 29694
  misc_feature 1..394: note = chr5:76476379-76476773
  misc_feature 1..394: note = hyper
  source 1..394: mol_type = genomic DNA

SEQ ID NO: 50519 - DNA, 30 bp, Homo sapiens; identical to SEQ ID NO: 29695
  misc_feature 1..30: note = chr5:76506145-76506175
  misc_feature 1..30: note = hyper
  source 1..30: mol_type = genomic DNA

SEQ ID NO: 50520 - DNA, 253 bp, Homo sapiens; identical to SEQ ID NO: 29696
  misc_feature 1..253: note = chr5:76506506-76506759
  misc_feature 1..253: note = hyper
  source 1..253: mol_type = genomic DNA

SEQ ID NO: 50521 - DNA, 275 bp, Homo sapiens; identical to SEQ ID NO: 18830
  misc_feature 1..275: note = chr5:76506760-76507035
  misc_feature 1..275: note = hyper
  source 1..275: mol_type = genomic DNA

SEQ ID NO: 50522 - DNA, 88 bp, Homo sapiens
  misc_feature 1..88: note = chr5:76507114-76507202
  misc_feature 1..88: note = hyper
  source 1..88: mol_type = genomic DNA
cgtgggggccgtccgccccgtcggcggggctcgcacgggtagggggctccggcggagttgggtgaccgtgaggcggttggtttggaga

SEQ ID NO: 50523 - DNA, 64 bp, Homo sapiens; identical to SEQ ID NO: 29700
  misc_feature 1..64: note = chr5:76924416-76924480
  misc_feature 1..64: note = hyper
  source 1..64: mol_type = genomic DNA

SEQ ID NO: 50524 - DNA, 167 bp, Homo sapiens; identical to SEQ ID NO: 29701
  misc_feature 1..167: note = chr5:76924754-76924921
  misc_feature 1..167: note = hyper
  source 1..167: mol_type = genomic DNA

SEQ ID NO: 50525 - DNA, 107 bp, Homo sapiens
  misc_feature 1..107: note = chr5:76925454-76925561
  misc_feature 1..107: note = hyper
  source 1..107: mol_type = genomic DNA
gtgacctaggtgcaccgtgtctgtgcgcgcgcgtgtgtagcgtctgagcgtgagcgagagtgcgagtgtgtgtgtttctgcccacaaaccagtccattggtgtctga

SEQ ID NO: 50526 - DNA, 742 bp, Homo sapiens
  misc_feature 1..742: note = chr5:76925690-76926432
  misc_feature 1..742: note = hyper
  source 1..742: mol_type = genomic DNA
gtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaatcaggcggaggggaggcctcgcgggctggggcttggggtgagcccgagcgagtggaggagagaggcgaggacgaaacgagacggggcgaaggccggggcgggacggggcagggcgccggggtccgggtgcgcgccggaagggcctcggggcggcccccggggcggtgctgggggcggagcgggccggggcgcggctgcattaagtgaagctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcgg

SEQ ID NO: 50527 - DNA, 128 bp, Homo sapiens; identical to SEQ ID NO: 29703
  misc_feature 1..128: note = chr5:76926728-76926856
  misc_feature 1..128: note = hyper
  source 1..128: mol_type = genomic DNA

SEQ ID NO: 50528 - DNA, 54 bp, Homo sapiens
  misc_feature 1..54: note = chr5:76928397-76928451
  misc_feature 1..54: note = hyper
  source 1..54: mol_type = genomic DNA
caggcaagcgtagacgcactctacgcttaccagtgtgaacggtgttgcagtcta

SEQ ID NO: 50529 - DNA, 10 bp, Homo sapiens
  misc_feature 1..10: note = chr5:76928678-76928688
  misc_feature 1..10: note = hyper
  source 1..10: mol_type = genomic DNA
caattgagct

SEQ ID NO: 50530 - DNA, 34 bp, Homo sapiens; identical to SEQ ID NO: 18837
  misc_feature 1..34: note = chr5:76928906-76928940
  misc_feature 1..34: note = hyper
  source 1..34: mol_type = genomic DNA

SEQ ID NO: 50531 - DNA, 20 bp, Homo sapiens
  misc_feature 1..20: note = chr5:76932282-76932302
  misc_feature 1..20: note = hyper
  source 1..20: mol_type = genomic DNA
tatttgtcaataatgcgagc

SEQ ID NO: 50532 - DNA, 210 bp, Homo sapiens; identical to SEQ ID NO: 18839
  misc_feature 1..210: note = chr5:76932332-76932542
  misc_feature 1..210: note = hyper
  source 1..210: mol_type = genomic DNA

SEQ ID NO: 50533 - DNA, 55 bp, Homo sapiens; identical to SEQ ID NO: 29707
  misc_feature 1..55: note = chr5:76933464-76933519
  misc_feature 1..55: note = hyper
  source 1..55: mol_type = genomic DNA

SEQ ID NO: 50534 - DNA, 133 bp, Homo sapiens
  misc_feature 1..133: note = chr5:76934040-76934173
  misc_feature 1..133: note = hyper
  source 1..133: mol_type = genomic DNA
cctaacaaattatcacggggtatatcgcctttcgaaaaaaaaaaaaaggcgggggaggggggaagagaaaaataagaaaaacaaaaagtaacaacattccccaactcctttcttggatctacatattccatag

SEQ ID NO: 50535 - DNA, 150 bp, Homo sapiens
  misc_feature 1..150: note = chr5:76934870-76935020
  misc_feature 1..150: note = hyper
  source 1..150: mol_type = genomic DNA
ctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcg

SEQ ID NO: 50536 - skipped

SEQ ID NO: 50537 - DNA, 39 bp, Homo sapiens
  misc_feature 1..39: note = chr5:76939774-76939813
  misc_feature 1..39: note = hyper
  source 1..39: mol_type = genomic DNA
gggtgcaagggccggtcccttgctcgttttttctcccat

SEQ ID NO: 50538 - DNA, 35 bp, Homo sapiens
  misc_feature 1..35: note = chr5:76940374-76940409
  misc_feature 1..35: note = hyper
  source 1..35: mol_type = genomic DNA
cgctccccgcccggctcctacgtcccaatcctttt

SEQ ID NO: 50539 - DNA, 344 bp, Homo sapiens
  misc_feature 1..344: note = chr5:76940857-76941201
  misc_feature 1..344: note = hyper
  source 1..344: mol_type = genomic DNA
ccctcgtcccctccccgcaacccgagtgcggctaattccgggcgtctatattcactcaattagagaaatctacagagaagatcgatcttccatctgcagacatgccagcttaacaaattagattcttgtttcgtgcaggtgatttggtgacagttggggaattagaagtaataagttgttgtgtttgagcccgggcccccgccccccgcccgcgcccctccccgcccgggggcccctcggccgcgcccgccgcccgggcaccccctaccgcaccccccagccggcccgcgccgccgccgccgtcgccgcatcccccgccgtaattagtgctgctgccctccatg

SEQ ID NO: 50540 - DNA, 172 bp, Homo sapiens; identical to SEQ ID NO: 18845
  misc_feature 1..172: note = chr5:76941326-76941498
  misc_feature 1..172: note = hyper
  source 1..172: mol_type = genomic DNA

SEQ ID NO: 50541 - DNA, 389 bp, Homo sapiens; identical to SEQ ID NO: 7912
  misc_feature 1..389: note = chr5:76941512-76941901
  misc_feature 1..389: note = hyper
  source 1..389: mol_type = genomic DNA

SEQ ID NO: 50542 - DNA, 37 bp, Homo sapiens
  misc_feature 1..37: note = chr5:77147526-77147563
  misc_feature 1..37: note = hyper
  source 1..37: mol_type = genomic DNA
gtgtgcgtgtgtgcacgcgcgagaagtgcgtgtgtag

SEQ ID NO: 50543 - DNA, 105 bp, Homo sapiens; identical to SEQ ID NO: 18848
  misc_feature 1..105: note = chr5:77148393-77148498
  misc_feature 1..105: note = hyper
  source 1..105: mol_type = genomic DNA

SEQ ID NO: 50544 - DNA, 25 bp, Homo sapiens
  misc_feature 1..25: note = chr5:77269309-77269334
  misc_feature 1..25: note = hyper
  source 1..25: mol_type = genomic DNA
ccttactcctcgcaggcttcaacct

SEQ ID NO: 50545 - DNA, 47 bp, Homo sapiens
  misc_feature 1..47: note = chr5:78407604-78407651
  misc_feature 1..47: note = hyper
  source 1..47: mol_type = genomic DNA
taaagaggcaggctgcggactcggagcagctcggggctgcgcagcgg

SEQ ID NO: 50546 - DNA, 11 bp, Homo sapiens
  misc_feature 1..11: note = chr5:78408181-78408192
  misc_feature 1..11: note = hyper
  source 1..11: mol_type = genomic DNA
gatatcccgtc

SEQ ID NO: 50547 - DNA, 16 bp, Homo sapiens
  misc_feature 1..16: note = chr5:79330913-79330929
  misc_feature 1..16: note = hyper
  source 1..16: mol_type = genomic DNA
ctttctctccagcccc

SEQ ID NO: 50548 - DNA, 205 bp, Homo sapiens; identical to SEQ ID NO: 29728
  misc_feature 1..205: note = chr5:79330930-79331135
  misc_feature 1..205: note = hyper
  source 1..205: mol_type = genomic DNA

SEQ ID NO: 50549 - DNA, 108 bp, Homo sapiens; identical to SEQ ID NO: 7923
  misc_feature 1..108: note = chr5:79331229-79331337
  misc_feature 1..108: note = hyper
  source 1..108: mol_type = genomic DNA

SEQ ID NO: 50550 - skipped

SEQ ID NO: 50551 - DNA, 63 bp, Homo sapiens
  misc_feature 1..63: note = chr5:79864835-79864898
  misc_feature 1..63: note = hyper
  source 1..63: mol_type = genomic DNA
ctggcagcgtctccacggtccccgccgacccctggaaccaggcgcgtttcctcagtttttcct

SEQ ID NO: 50552 - DNA, 367 bp, Homo sapiens; identical to SEQ ID NO: 18854
  misc_feature 1..367: note = chr5:79865078-79865445
  misc_feature 1..367: note = hyper
  source 1..367: mol_type = genomic DNA

SEQ ID NO: 50553 - DNA, 140 bp, Homo sapiens; identical to SEQ ID NO: 29732
  misc_feature 1..140: note = chr5:79865522-79865662
  misc_feature 1..140: note = hyper
  source 1..140: mol_type = genomic DNA

SEQ ID NO: 50554 - DNA, 46 bp, Homo sapiens
  misc_feature 1..46: note = chr5:79866414-79866460
  misc_feature 1..46: note = hyper
  source 1..46: mol_type = genomic DNA
cccattgagggaagcacgcacccctacgtcacgggctttggctcct

SEQ ID NO: 50555 - DNA, 41 bp, Homo sapiens; identical to SEQ ID NO: 18856
  misc_feature 1..41: note = chr5:80255775-80255816
  misc_feature 1..41: note = hyper
  source 1..41: mol_type = genomic DNA

SEQ ID NO: 50556 - DNA, 58 bp, Homo sapiens; identical to SEQ ID NO: 7929
  misc_feature 1..58: note = chr5:80256312-80256370
  misc_feature 1..58: note = hyper
  source 1..58: mol_type = genomic DNA

SEQ ID NO: 50557 - DNA, 138 bp, Homo sapiens; identical to SEQ ID NO: 29736
  misc_feature 1..138: note = chr5:80256428-80256566
  misc_feature 1..138: note = hyper
  source 1..138: mol_type = genomic DNA

SEQ ID NO: 50558 - DNA, 59 bp, Homo sapiens; identical to SEQ ID NO: 29737
  misc_feature 1..59: note = chr5:80256887-80256946
  misc_feature 1..59: note = hyper
  source 1..59: mol_type = genomic DNA

SEQ ID NO: 50559 - DNA, 60 bp, Homo sapiens; identical to SEQ ID NO: 18859
  misc_feature 1..60: note = chr5:80689735-80689795
  misc_feature 1..60: note = hyper
  source 1..60: mol_type = genomic DNA

SEQ ID NO: 50560 - DNA, 239 bp, Homo sapiens
  misc_feature 1..239: note = chr5:80689879-80690118
  misc_feature 1..239: note = hyper
  source 1..239: mol_type = genomic DNA
cgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcga

SEQ ID NO: 50561 - DNA, 30 bp, Homo sapiens; identical to SEQ ID NO: 7933
  misc_feature 1..30: note = chr5:81075100-81075130
  misc_feature 1..30: note = hyper
  source 1..30: mol_type = genomic DNA

SEQ ID NO: 50562 - DNA, 258 bp, Homo sapiens
  misc_feature 1..258: note = chr5:82767171-82767429
  misc_feature 1..258: note = hyper
  source 1..258: mol_type = genomic DNA
ccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttag

SEQ ID NO: 50563 - DNA, 17 bp, Homo sapiens
  misc_feature 1..17: note = chr5:82767793-82767810
  misc_feature 1..17: note = hyper
  source 1..17: mol_type = genomic DNA
agcgctgcagtgaattt

SEQ ID NO: 50564 - DNA, 675 bp, Homo sapiens
  misc_feature 1..675: note = chr5:82768217-82768892
  misc_feature 1..675: note = hyper
  source 1..675: mol_type = genomic DNA
ttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaacttt

SEQ ID NO: 50565 - DNA, 308 bp, Homo sapiens
  misc_feature 1..308: note = chr5:82769061-82769369
  misc_feature 1..308: note = hyper
  source 1..308: mol_type = genomic DNA
ggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccac

SEQ ID NO: 50566 - DNA, 293 bp, Homo sapiens; identical to SEQ ID NO: 29743
  misc_feature 1..293: note = chr5:82769910-82770203
  misc_feature 1..293: note = hyper
  source 1..293: mol_type = genomic DNA

SEQ ID NO: 50567 - DNA, 112 bp, Homo sapiens; identical to SEQ ID NO: 29744
  misc_feature 1..112: note = chr5:83017828-83017940
  misc_feature 1..112: note = hyper
  source 1..112: mol_type = genomic DNA

SEQ ID NO: 50568 - DNA, 206 bp, Homo sapiens
  misc_feature 1..206: note = chr5:83678989-83679195
  misc_feature 1..206: note = hyper
  source 1..206: mol_type = genomic DNA
gaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgc

SEQ ID NO: 50569 - DNA, 56 bp, Homo sapiens; identical to SEQ ID NO: 29746
  misc_feature 1..56: note = chr5:83679587-83679643
  misc_feature 1..56: note = hyper
  source 1..56: mol_type = genomic DNA

SEQ ID NO: 50570 - DNA, 37 bp, Homo sapiens
  misc_feature 1..37: note = chr5:83679644-83679681
  misc_feature 1..37: note = hyper
  source 1..37: mol_type = genomic DNA
ccagagcaccgcacccgggggcggacggccctgcagc

SEQ ID NO: 50571 - DNA, 29 bp, Homo sapiens
  misc_feature 1..29: note = chr5:83680340-83680369
  misc_feature 1..29: note = hyper
  source 1..29: mol_type = genomic DNA
attcttggagagggcgagagtggtgacta

SEQ ID NO: 50572 - DNA, 131 bp, Homo sapiens; identical to SEQ ID NO: 29748
  misc_feature 1..131: note = chr5:87436611-87436742
  misc_feature 1..131: note = hyper
  source 1..131: mol_type = genomic DNA

SEQ ID NO: 50573 - DNA, 30 bp, Homo sapiens; identical to SEQ ID NO: 29749
  misc_feature 1..30: note = chr5:87955350-87955380
  misc_feature 1..30: note = hyper
  source 1..30: mol_type = genomic DNA

SEQ ID NO: 50574 - DNA, 101 bp, Homo sapiens; identical to SEQ ID NO: 29751
  misc_feature 1..101: note = chr5:87955839-87955940
  misc_feature 1..101: note = hyper
  source 1..101: mol_type = genomic DNA

SEQ ID NO: 50575 - DNA, 41 bp, Homo sapiens
  misc_feature 1..41: note = chr5:87956158-87956199
  misc_feature 1..41: note = hyper
  source 1..41: mol_type = genomic DNA
gcccagagtggcaagcgctcaccaacgccggccaccgagca

SEQ ID NO: 50576 - DNA, 236 bp, Homo sapiens
  misc_feature 1..236: note = chr5:87956964-87957200
  misc_feature 1..236: note = hyper
  source 1..236: mol_type = genomic DNA
gcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaacc

SEQ ID NO: 50577 - DNA, 221 bp, Homo sapiens; identical to SEQ ID NO: 29754
  misc_feature 1..221: note = chr5:87962639-87962860
  misc_feature 1..221: note = hyper
  source 1..221: mol_type = genomic DNA

SEQ ID NO: 50578 - DNA, 22 bp, Homo sapiens
  misc_feature 1..22: note = chr5:87968077-87968099
  misc_feature 1..22: note = hyper
  source 1..22: mol_type = genomic DNA
agcaaaccgcaaagacctagct

SEQ ID NO: 50579 - DNA, 62 bp, Homo sapiens
  misc_feature 1..62: note = chr5:87968858-87968920
  misc_feature 1..62: note = hyper
  source 1..62: mol_type = genomic DNA
atccaaagtcacagcacggccgcagcacacaaacaggcttctttcggcgtctccaaaaaaaa

SEQ ID NO: 50580 - DNA, 73 bp, Homo sapiens; identical to SEQ ID NO: 472
  misc_feature 1..73: note = chr5:87970041-87970114
  misc_feature 1..73: note = hyper
  source 1..73: mol_type = genomic DNA

SEQ ID NO: 50581 - DNA, 78 bp, Homo sapiens; identical to SEQ ID NO: 18870
  misc_feature 1..78: note = chr5:87970115-87970193
  misc_feature 1..78: note = hyper
  source 1..78: mol_type = genomic DNA

SEQ ID NO: 50582 - DNA, 46 bp, Homo sapiens
  misc_feature 1..46: note = chr5:87970872-87970918
  misc_feature 1..46: note = hyper
  source 1..46: mol_type = genomic DNA
gcaaaacaccaggccaaatccggcaaggcggcggctacagaatggc

SEQ ID NO: 50583 - DNA, 387 bp, Homo sapiens; identical to SEQ ID NO: 29761
  misc_feature 1..387: note = chr5:87971517-87971904
  misc_feature 1..387: note = hyper
  source 1..387: mol_type = genomic DNA

SEQ ID NO: 50584 - DNA, 18 bp, Homo sapiens
  misc_feature 1..18: note = chr5:87972106-87972124
  misc_feature 1..18: note = hyper
  source 1..18: mol_type = genomic DNA
gcataatcagggctccgc

SEQ ID NO: 50585 - DNA, 20 bp, Homo sapiens
  misc_feature 1..20: note = chr5:87974084-87974104
  misc_feature 1..20: note = hyper
  source 1..20: mol_type = genomic DNA
aatctcccttattggcgcat

SEQ ID NO: 50586 - DNA, 211 bp, Homo sapiens
  misc_feature 1..211: note = chr5:87974307-87974518
  misc_feature 1..211: note = hyper
  source 1..211: mol_type = genomic DNA
ccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagc

SEQ ID NO: 50587 - DNA, 30 bp, Homo sapiens; identical to SEQ ID NO: 29764
  misc_feature 1..30: note = chr5:87976608-87976638
  misc_feature 1..30: note = hyper
  source 1..30: mol_type = genomic DNA

SEQ ID NO: 50588 - DNA, 31 bp, Homo sapiens; identical to SEQ ID NO: 18875
  misc_feature 1..31: note = chr5:87979725-87979756
  misc_feature 1..31: note = hyper
  source 1..31: mol_type = genomic DNA

SEQ ID NO: 50589 - DNA, 73 bp, Homo sapiens; identical to SEQ ID NO: 18876
  misc_feature 1..73: note = chr5:87979912-87979985
  misc_feature 1..73: note = hyper
  source 1..73: mol_type = genomic DNA

SEQ ID NO: 50590 - DNA, 156 bp, Homo sapiens; identical to SEQ ID NO: 29767
  misc_feature 1..156: note = chr5:87980430-87980586
  misc_feature 1..156: note = hyper
  source 1..156: mol_type = genomic DNA

SEQ ID NO: 50591 - DNA, 308 bp, Homo sapiens
  misc_feature 1..308: note = chr5:87980646-87980954
  misc_feature 1..308: note = hyper
  source 1..308: mol_type = genomic DNA
tttagaggcaaaagcttgcttattcagaggagagagggagggggagagggagaaaggaggcgggagggaggagagacgggggagagagaagtaaaagggggatggaggatgaagaggaggtggagaatcagaaggtagtgcgggcgttgttagagaaggaggaggaagaggaggaggaggaggagggatgggaggggtagggtggagtaaccaaagatgggctgggatgggacggcgaggaataaattgctccccacccagctgcggtgcgacgcccccagcgtcccaggggagccggtgcgtcagct

SEQ ID NO: 50592 - DNA, 30 bp, Homo sapiens; identical to SEQ ID NO: 29769
  misc_feature 1..30: note = chr5:87983365-87983395
  misc_feature 1..30: note = hyper
  source 1..30: mol_type = genomic DNA

SEQ ID NO: 50593 - DNA, 30 bp, Homo sapiens; identical to SEQ ID NO: 29770
  misc_feature 1..30: note = chr5:87984984-87985014
  misc_feature 1..30: note = hyper
  source 1..30: mol_type = genomic DNA

SEQ ID NO: 50594 - DNA, 179 bp, Homo sapiens; identical to SEQ ID NO: 29771
  misc_feature 1..179: note = chr5:87985348-87985527
  misc_feature 1..179: note = hyper
  source 1..179: mol_type = genomic DNA

SEQ ID NO: 50595 - DNA, 90 bp, Homo sapiens
  misc_feature 1..90: note = chr5:87985954-87986044
  misc_feature 1..90: note = hyper
  source 1..90: mol_type = genomic DNA
aagattttttctcaaaagaattaagagctctagaggcgcctcttccactcactagggcaccatgtcaaagggactcgtcatggcgattta

SEQ ID NO: 50596 - DNA, 63 bp, Homo sapiens; identical to SEQ ID NO: 29773
  misc_feature 1..63: note = chr5:87986310-87986373
  misc_feature 1..63: note = hyper
  source 1..63: mol_type = genomic DNA

SEQ ID NO: 50597 - DNA, 108 bp, Homo sapiens; identical to SEQ ID NO: 29774
  misc_feature 1..108: note = chr5:87988193-87988301
  misc_feature 1..108: note = hyper
  source 1..108: mol_type = genomic DNA

SEQ ID NO: 50598 - DNA, 67 bp, Homo sapiens
  misc_feature 1..67: note = chr5:87988584-87988651
  misc_feature 1..67: note = hyper
  source 1..67: mol_type = genomic DNA
ccgtcccctcctttctcggccggagacgttaagagttcccggtgaatgacaccgtccagggtcagaa

SEQ ID NO: 50599 - DNA, 90 bp, Homo sapiens
  misc_feature 1..90: note = chr5:87990318-87990408
  misc_feature 1..90: note = hyper
  source 1..90: mol_type = genomic DNA
gaacccgaaaagcctcgcgttttttctcttgtgttttcctcacttttctttttctcaaactgcaaaattttagtgcctgaatggcgaatg

SEQ ID NO: 50600 - DNA, 30 bp, Homo sapiens; identical to SEQ ID NO: 29777
  misc_feature 1..30: note = chr5:87991432-87991462
  misc_feature 1..30: note = hyper
  source 1..30: mol_type = genomic DNA

SEQ ID NO: 50601 - DNA, 121 bp, Homo sapiens; identical to SEQ ID NO: 29778
  misc_feature 1..121: note = chr5:88179851-88179972
  misc_feature 1..121: note = hyper
  source 1..121: mol_type = genomic DNA

SEQ ID NO: 50602 - DNA, 76 bp, Homo sapiens; identical to SEQ ID NO: 29779
  misc_feature 1..76: note = chr5:88180270-88180346
  misc_feature 1..76: note = hyper
  source 1..76: mol_type = genomic DNA

SEQ ID NO: 50603 - DNA, 534 bp, Homo sapiens; identical to SEQ ID NO: 29780
  misc_feature 1..534: note = chr5:88184853-88185387
  misc_feature 1..534: note = hyper
  source 1..534: mol_type = genomic DNA

SEQ ID NO: 50604 - DNA, 82 bp, Homo sapiens; identical to SEQ ID NO: 18880
  misc_feature 1..82: note = chr5:88185388-88185470
  misc_feature 1..82: note = hyper
  source 1..82: mol_type = genomic DNA

SEQ ID NO: 50605 - DNA, 333 bp, Homo sapiens; identical to SEQ ID NO: 18881
  misc_feature 1..333: note = chr5:89854523-89854856
  misc_feature 1..333: note = hyper
  source 1..333: mol_type = genomic DNA

SEQ ID NO: 50606 - DNA, 67 bp, Homo sapiens
  misc_feature 1..67: note = chr5:89854902-89854969
  misc_feature 1..67: note = hyper
  source 1..67: mol_type = genomic DNA
ggggcatagctgcccgcgtcggttctgtccaaggctgcggttttgcagggagcgttaggttcctgca

SEQ ID NO: 50607 - DNA, 29 bp, Homo sapiens
  misc_feature 1..29: note = chr5:92915099-92915128
  misc_feature 1..29: note = hyper
  source 1..29: mol_type = genomic DNA
cgctagggtcacgccgggtcccaggggcc

SEQ ID NO: 50608 - DNA, 57 bp, Homo sapiens; identical to SEQ ID NO: 29784
  misc_feature 1..57: note = chr5:92915510-92915567
  misc_feature 1..57: note = hyper
  source 1..57: mol_type = genomic DNA

SEQ ID NO: 50609 - DNA, 328 bp, Homo sapiens; identical to SEQ ID NO: 29785
  misc_feature 1..328: note = chr5:92915837-92916165
  misc_feature 1..328: note = hyper
  source 1..328: mol_type = genomic DNA

SEQ ID NO: 50610 - DNA, 24 bp, Homo sapiens
  misc_feature 1..24: note = chr5:92940177-92940201
  misc_feature 1..24: note = hyper
  source 1..24: mol_type = genomic DNA
ggggtgggccggggccggctgcga

SEQ ID NO: 50611 - DNA, 52 bp, Homo sapiens; identical to SEQ ID NO: 29787
  misc_feature 1..52: note = chr5:94620527-94620579
  misc_feature 1..52: note = hyper
  source 1..52: mol_type = genomic DNA

SEQ ID NO: 50612 - DNA, 277 bp, Homo sapiens; identical to SEQ ID NO: 29788
  misc_feature 1..277: note = chr5:94620857-94621134
  misc_feature 1..277: note = hyper
  source 1..277: mol_type = genomic DNA

SEQ ID NO: 50613 - DNA, 95 bp, Homo sapiens
  misc_feature 1..95: note = chr5:94955586-94955681
  misc_feature 1..95: note = hyper
  source 1..95: mol_type = genomic DNA
ctgctgtgctttacacgtaaatagagaatggatgaggttctcagcgcccaggggtccgcggcttccgcgagggtagcgtcgggggccgctgcaga

SEQ ID NO: 50614 - DNA, 1016 bp, Homo sapiens
  misc_feature 1..1016: note = chr5:94955919-94956935
  misc_feature 1..1016: note = hyper
  source 1..1016: mol_type = genomic DNA
actttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgc

SEQ ID NO: 50615 - DNA, 242 bp, Homo sapiens
  misc_feature 1..242: note = chr5:94957000-94957242
  misc_feature 1..242: note = hyper
  source 1..242: mol_type = genomic DNA
cgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccg

SEQ ID NO: 50616 - DNA, 53 bp, Homo sapiens; identical to SEQ ID NO: 29790
  misc_feature 1..53: note = chr5:95067679-95067732
  misc_feature 1..53: note = hyper
  source 1..53: mol_type = genomic DNA

SEQ ID NO: 50617 - DNA, 480 bp, Homo sapiens
  misc_feature 1..480: note = chr5:100236202-100236682
  misc_feature 1..480: note = hyper
  source 1..480: mol_type = genomic DNA
tcacaagcttttccacgaacctttcatcctggagaaaaaggaaagtgctcagggagcctagctgccctcgcattgttcctggcagctccaactccttgcacagtcttggtctctcaggagaccaaggcagtcaggacgctacagggcacgggtgtaagcgcgacgttcgcggccagccctctgccttgccccactgtaattgcgggttttgattaagaaggaggagccagttgccgactgagctttgaaagtgactttgggtggggggtgggggtggggtgggggtggaaggaggggagggaccaaaagagcctgagtcctgcaataaaggtttccccctatcttctcactcattctttccccctcgccgccggcgctctggcagcaggggataaccccggtgcgcgcctctcttcctgtttggtttactcaagcgcctgccccaacgccttctcagtcaagctgggaggaaactgcttc

SEQ ID NO: 50618 - DNA, 256 bp, Homo sapiens
  misc_feature 1..256: note = chr5:100236757-100237013
  misc_feature 1..256: note = hyper
  source 1..256: mol_type = genomic DNA
aacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgag

SEQ ID NO: 50619 - DNA, 150 bp, Homo sapiens; identical to SEQ ID NO: 29794
  misc_feature 1..150: note = chr5:100237567-100237717
  misc_feature 1..150: note = hyper
  source 1..150: mol_type = genomic DNA

SEQ ID NO: 50620 - DNA, 115 bp, Homo sapiens; identical to SEQ ID NO: 29795
  misc_feature 1..115: note = chr5:100238283-100238398
  misc_feature 1..115: note = hyper
  source 1..115: mol_type = genomic DNA

SEQ ID NO: 50621 - DNA, 201 bp, Homo sapiens
  misc_feature 1..201: note = chr5:100238681-100238882
  misc_feature 1..201: note = hyper
  source 1..201: mol_type = genomic DNA
ggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgcc

SEQ ID NO: 50622 - DNA, 521 bp, Homo sapiens; identical to SEQ ID NO: 29800
  misc_feature 1..521: note = chr5:100239203-100239724
  misc_feature 1..521: note = hyper
  source 1..521: mol_type = genomic DNA

SEQ ID NO: 50623 - DNA, 30 bp, Homo sapiens; identical to SEQ ID NO: 29801
  misc_feature 1..30: note = chr5:100240068-100240098
  misc_feature 1..30: note = hyper
  source 1..30: mol_type = genomic DNA

SEQ ID NO: 50624 - DNA, 44 bp, Homo sapiens; identical to SEQ ID NO: 29802
  misc_feature 1..44: note = chr5:101631539-101631583
  misc_feature 1..44: note = hyper
  source 1..44: mol_type = genomic DNA

SEQ ID NO: 50625 - DNA, 30 bp, Homo sapiens; identical to SEQ ID NO: 29803
  misc_feature 1..30: note = chr5:101632034-101632064
  misc_feature 1..30: note = hyper
  source 1..30: mol_type = genomic DNA

SEQ ID NO: 50626 - DNA, 141 bp, Homo sapiens; identical to SEQ ID NO: 7974
  misc_feature 1..141: note = chr5:107005171-107005312
  misc_feature 1..141: note = hyper
  source 1..141: mol_type = genomic DNA

SEQ ID NO: 50627 - DNA, 83 bp, Homo sapiens; identical to SEQ ID NO: 29805
  misc_feature 1..83: note = chr5:107005635-107005718
  misc_feature 1..83: note = hyper
  source 1..83: mol_type = genomic DNA

SEQ ID NO: 50628 - DNA, 155 bp, Homo sapiens; identical to SEQ ID NO: 29807
  misc_feature 1..155: note = chr5:107006762-107006917
  misc_feature 1..155: note = hyper
  source 1..155: mol_type = genomic DNA

SEQ ID NO: 50629 - DNA, 34 bp, Homo sapiens; identical to SEQ ID NO: 29808
  misc_feature 1..34: note = chr5:107007264-107007298
  misc_feature 1..34: note = hyper
  source 1..34: mol_type = genomic DNA

SEQ ID NO: 50630 - DNA, 554 bp, Homo sapiens; identical to SEQ ID NO: 29809
  misc_feature 1..554: note = chr5:110408656-110409210
  misc_feature 1..554: note = hyper
  source 1..554: mol_type = genomic DNA

SEQ ID NO: 50631 - DNA, 174 bp, Homo sapiens; identical to SEQ ID NO: 29810
  misc_feature 1..174: note = chr5:110559554-110559728
  misc_feature 1..174: note = hyper
  source 1..174: mol_type = genomic DNA

SEQ ID NO: 50632 - DNA, 80 bp, Homo sapiens; identical to SEQ ID NO: 29811
  misc_feature 1..80: note = chr5:110560039-110560119
  misc_feature 1..80: note = hyper
  source 1..80: mol_type = genomic DNA

SEQ ID NO: 50633 - DNA, 414 bp, Homo sapiens; identical to SEQ ID NO: 29812
  misc_feature 1..414: note = chr5:110560138-110560552
  misc_feature 1..414: note = hyper
  source 1..414: mol_type = genomic DNA

SEQ ID NO: 50634 - DNA, 58 bp, Homo sapiens; identical to SEQ ID NO: 29813
  misc_feature 1..58: note = chr5:111754705-111754763
  misc_feature 1..58: note = hyper
  source 1..58: mol_type = genomic DNA

SEQ ID NO: 50635 - DNA, 30 bp, Homo sapiens; identical to SEQ ID NO: 29814
  misc_feature 1..30: note = chr5:112629248-112629278
  misc_feature 1..30: note = hyper
  source 1..30: mol_type = genomic DNA

SEQ ID NO: 50636 - DNA, 62 bp, Homo sapiens; identical to SEQ ID NO: 18898
  misc_feature 1..62: note = chr5:112629674-112629736
  misc_feature 1..62: note = hyper
  source 1..62: mol_type = genomic DNA

SEQ ID NO: 50637 - DNA, 119 bp, Homo sapiens; identical to SEQ ID NO: 29816
  misc_feature 1..119: note = chr5:112630330-112630449
  misc_feature 1..119: note = hyper
  source 1..119: mol_type = genomic DNA

SEQ ID NO: 50638 - DNA, 34 bp, Homo sapiens; identical to SEQ ID NO: 7978
  misc_feature 1..34: note = chr5:112824097-112824131
  misc_feature 1..34: note = hyper
  source 1..34: mol_type = genomic DNA

SEQ ID NO: 50639 - DNA, 315 bp, Homo sapiens; identical to SEQ ID NO: 29821
  misc_feature 1..315: note = chr5:113696418-113696733
  misc_feature 1..315: note = hyper
  source 1..315: mol_type = genomic DNA

SEQ ID NO: 50640 - DNA, 277 bp, Homo sapiens; identical to SEQ ID NO: 29822
  misc_feature 1..277: note = chr5:113696955-113697232
  misc_feature 1..277: note = hyper
  source 1..277: mol_type = genomic DNA

SEQ ID NO: 50641 - DNA, 265 bp, Homo sapiens; identical to SEQ ID NO: 29823
  misc_feature 1..265: note = chr5:113697471-113697736
  misc_feature 1..265: note = hyper
  source 1..265: mol_type = genomic DNA

SEQ ID NO: 50642 - DNA, 140 bp, Homo sapiens; identical to SEQ ID NO: 29824
  misc_feature 1..140: note = chr5:113698000-113698140
  misc_feature 1..140: note = hyper
  source 1..140: mol_type = genomic DNA

SEQ ID NO: 50643 - DNA, 13 bp, Homo sapiens
  misc_feature 1..13: note = chr5:113698141-113698154
  misc_feature 1..13: note = hyper
  source 1..13: mol_type = genomic DNA
cacctcctcgccg

SEQ ID NO: 50644 - DNA, 181 bp, Homo sapiens
  misc_feature 1..181: note = chr5:113698386-113698567
  misc_feature 1..181: note = hyper
  source 1..181: mol_type = genomic DNA
accaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgca

SEQ ID NO: 50645 - DNA, 61 bp, Homo sapiens
  misc_feature 1..61: note = chr5:113698783-113698844
  misc_feature 1..61: note = hyper
  source 1..61: mol_type = genomic DNA
cagtggcaccaagtccagcaaaaagaaaaaccagaacatcggctacaagctgggccaccgg

SEQ ID NO: 50646 - DNA, 57 bp, Homo sapiens
  misc_feature 1..57: note = chr5:113698951-113699008
  misc_feature 1..57: note = hyper
  source 1..57: mol_type = genomic DNA
cgacaaggtacaggcttgaaccccagcccacgctaccggagtcgggcactgggtggt

SEQ ID NO: 50647 - DNA, 156 bp, Homo sapiens; identical to SEQ ID NO: 7987
  misc_feature 1..156: note = chr5:113699401-113699557
  misc_feature 1..156: note = hyper
  source 1..156: mol_type = genomic DNA

SEQ ID NO: 50648 - DNA, 216 bp, Homo sapiens; identical to SEQ ID NO: 29832
  misc_feature 1..216: note = chr5:114515900-114516116
  misc_feature 1..216: note = hyper
  source 1..216: mol_type = genomic DNA

SEQ ID NO: 50649 - DNA, 104 bp, Homo sapiens
  misc_feature 1..104: note = chr5:115151163-115151267
  misc_feature 1..104: note = hyper
  source 1..104: mol_type = genomic DNA
gggggctgaaaaaaacgacggtcgaatatttaatctgcgaaacttggcagtggatttgaataaacccacagtcggggaagttagttaaattggtttgggaaagg

SEQ ID NO: 50650 - DNA, 39 bp, Homo sapiens; identical to SEQ ID NO: 18908
  misc_feature 1..39: note = chr5:115152638-115152677
  misc_feature 1..39: note = hyper
  source 1..39: mol_type = genomic DNA

SEQ ID NO: 50651 - skipped

SEQ ID NO: 50652 - DNA, 292 bp, Homo sapiens
  misc_feature 1..292: note = chr5:115298204-115298496
  misc_feature 1..292: note = hyper
  source 1..292: mol_type = genomic DNA
cgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcc

SEQ ID NO: 50653 - DNA, 204 bp, Homo sapiens; identical to SEQ ID NO: 18910
  misc_feature 1..204: note = chr5:115298781-115298985
  misc_feature 1..204: note = hyper
  source 1..204: mol_type = genomic DNA

SEQ ID NO: 50654 - DNA, 61 bp, Homo sapiens
  misc_feature 1..61: note = chr5:115299041-115299102
  misc_feature 1..61: note = hyper
  source 1..61: mol_type = genomic DNA
cccccgcccctgcgtcccggtgcaggctgcgggtccagctgactaccgtgtccaggtgcgc

SEQ ID NO: 50655 - DNA, 30 bp, Homo sapiens; identical to SEQ ID NO: 29841
  misc_feature 1..30: note = chr5:115908915-115908945
  misc_feature 1..30: note = hyper
  source 1..30: mol_type = genomic DNA

SEQ ID NO: 50656 - DNA, 42 bp, Homo sapiens; identical to SEQ ID NO: 29842
  misc_feature 1..42: note = chr5:115911133-115911175
  misc_feature 1..42: note = hyper
  source 1..42: mol_type = genomic DNA

SEQ ID NO: 50657 - DNA, 30 bp, Homo sapiens; identical to SEQ ID NO: 7998
  misc_feature 1..30: note = chr5:115911931-115911961
  misc_feature 1..30: note = hyper
  source 1..30: mol_type = genomic DNA

SEQ ID NO: 50658 - DNA, 19 bp, Homo sapiens
  misc_feature 1..19: note = chr5:119799986-119800005
  misc_feature 1..19: note = hyper
  source 1..19: mol_type = genomic DNA
gtctcgggagttgatggca

SEQ ID NO: 50659 - DNA, 57 bp, Homo sapiens; identical to SEQ ID NO: 29845
  misc_feature 1..57: note = chr5:119800264-119800321
  misc_feature 1..57: note = hyper
  source 1..57: mol_type = genomic DNA

SEQ ID NO: 50660 - DNA, 753 bp, Homo sapiens
  misc_feature 1..753: note = chr5:119800546-119801299
  misc_feature 1..753: note = hyper
  source 1..753: mol_type = genomic DNA
aactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctggg

SEQ ID NO: 50661 - DNA, 61 bp, Homo sapiens
  misc_feature 1..61: note = chr5:119801445-119801506
  misc_feature 1..61: note = hyper
  source 1..61: mol_type = genomic DNA
tagaacttcgaaggtggcggtggctgcagcgggaaaaggggtggggcgtagtctaggtcca

SEQ ID NO: 50662 - DNA, 505 bp, Homo sapiens; identical to SEQ ID NO: 29847
  misc_feature 1..505: note = chr5:121412800-121413305
  misc_feature 1..505: note = hyper
  source 1..505: mol_type = genomic DNA

SEQ ID NO: 50663 - DNA, 221 bp, Homo sapiens
  misc_feature 1..221: note = chr5:121413590-121413811
  misc_feature 1..221: note = hyper
  source 1..221: mol_type = genomic DNA
ctgctgttggccggcggcgggaggggcgcagtgcactagcgcgcagagctgcaaaggcccgagcaggagcacggtccaggcgaagcgcatcactccttttgccagattgaccccgctcgaggaggacgtggctcacagaaaataaaaacggggctcaaatcacgtgagggaaggagaaatcttcaaccaaggaggcgagcggagcacgggtatctcagtct

SEQ ID NO: 50664 - DNA, 159 bp, Homo sapiens; identical to SEQ ID NO: 29849
  misc_feature 1..159: note = chr5:121647435-121647594
  misc_feature 1..159: note = hyper
  source 1..159: mol_type = genomic DNA

SEQ ID NO: 50665 - DNA, 494 bp, Homo sapiens; identical to SEQ ID NO: 29850
  misc_feature 1..494: note = chr5:121647801-121648295
  misc_feature 1..494: note = hyper
  source 1..494: mol_type = genomic DNA

SEQ ID NO: 50666 - DNA, 201 bp, Homo sapiens; identical to SEQ ID NO: 29851
  misc_feature 1..201: note = chr5:121648762-121648963
  misc_feature 1..201: note = hyper
  source 1..201: mol_type = genomic DNA

SEQ ID NO: 50667 - DNA, 23 bp, Homo sapiens
  misc_feature 1..23: note = chr5:122422292-122422315
  misc_feature 1..23: note = hyper
  source 1..23: mol_type = genomic DNA
agctctgcgggcatcccggaagc

SEQ ID NO: 50668 - DNA, 183 bp, Homo sapiens
  misc_feature 1..183: note = chr5:122422651-122422834
  misc_feature 1..183: note = hyper
  source 1..183: mol_type = genomic DNA
ctctcccatgatagcccctctggcgtcagtctggaccgagtggctacaggttggactagggtaggcagaagatgcacttggcaccttaccgaacggtatttgaatccgtctccattactcattaatggcgtgaccttaggcaacccatctaaactttccgaacctcagcggtccccatctaca

SEQ ID NO: 50669 - DNA, 187 bp, Homo sapiens; identical to SEQ ID NO: 29855
  misc_feature 1..187: note = chr5:122423874-122424061
  misc_feature 1..187: note = hyper
  source 1..187: mol_type = genomic DNA

SEQ ID NO: 50670 - DNA, 252 bp, Homo sapiens; identical to SEQ ID NO: 29856
  misc_feature 1..252: note = chr5:122424436-122424688
  misc_feature 1..252: note = hyper
  source 1..252: mol_type = genomic DNA

SEQ ID NO: 50671 - DNA, 217 bp, Homo sapiens
  misc_feature 1..217: note = chr5:122424911-122425128
  misc_feature 1..217: note = hyper
  source 1..217: mol_type = genomic DNA
acccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcat

SEQ ID NO: 50672 - DNA, 164 bp, Homo sapiens; identical to SEQ ID NO: 18921
  misc_feature 1..164: note = chr5:122425168-122425332
  misc_feature 1..164: note = hyper
  source 1..164: mol_type = genomic DNA

SEQ ID NO: 50673 - DNA, 79 bp, Homo sapiens; identical to SEQ ID NO: 8010
  misc_feature 1..79: note = chr5:122425562-122425641
  misc_feature 1..79: note = hyper
  source 1..79: mol_type = genomic DNA

SEQ ID NO: 50674 - DNA, 192 bp, Homo sapiens; identical to SEQ ID NO: 29859
  misc_feature 1..192: note = chr5:122425701-122425893
  misc_feature 1..192: note = hyper
  source 1..192: mol_type = genomic DNA

SEQ ID NO: 50675 - DNA, 304 bp, Homo sapiens; identical to SEQ ID NO: 29860
  misc_feature 1..304: note = chr5:122426110-122426414
  misc_feature 1..304: note = hyper
  source 1..304: mol_type = genomic DNA

SEQ ID NO: 50676 - DNA, 53 bp, Homo sapiens; identical to SEQ ID NO: 29861
  misc_feature 1..53: note = chr5:122426796-122426849
  misc_feature 1..53: note = hyper
  source 1..53: mol_type = genomic DNA

SEQ ID NO: 50677 - DNA, 117 bp, Homo sapiens; identical to SEQ ID NO: 29862
  misc_feature 1..117: note = chr5:122430742-122430859
  misc_feature 1..117: note = hyper
  source 1..117: mol_type = genomic DNA

SEQ ID NO: 50678 - DNA, 54 bp, Homo sapiens
  misc_feature 1..54: note = chr5:122431064-122431118
  misc_feature 1..54: note = hyper
  source 1..54: mol_type = genomic DNA
atctagcctatagctcgagaaggcagtggggggaccgcaggctggagccccggg

SEQ ID NO: 50679 - skipped

SEQ ID NO: 50680 - DNA, 75 bp, Homo sapiens; identical to SEQ ID NO: 29864
  misc_feature 1..75: note = chr5:122434453-122434528
  misc_feature 1..75: note = hyper
  source 1..75: mol_type = genomic DNA

SEQ ID NO: 50681 - DNA, 112 bp, Homo sapiens; identical to SEQ ID NO: 29865
  misc_feature 1..112: note = chr5:122434605-122434717
  misc_feature 1..112: note = hyper
  source 1..112: mol_type = genomic DNA

SEQ ID NO: 50682 - DNA, 401 bp, Homo sapiens; identical to SEQ ID NO: 29866
  misc_feature 1..401: note = chr5:124083481-124083882
  misc_feature 1..401: note = hyper
  source 1..401: mol_type = genomic DNA

SEQ ID NO: 50683 - DNA, 59 bp, Homo sapiens; identical to SEQ ID NO: 29867
  misc_feature 1..59: note = chr5:124084195-124084254
  misc_feature 1..59: note = hyper
  source 1..59: mol_type = genomic DNA

SEQ ID NO: 50684 - DNA, 112 bp, Homo sapiens; identical to SEQ ID NO: 29868
  misc_feature 1..112: note = chr5:124084771-124084883
  misc_feature 1..112: note = hyper
  source 1..112: mol_type = genomic DNA

SEQ ID NO: 50685 - DNA, 334 bp, Homo sapiens; identical to SEQ ID NO: 29869
  misc_feature 1..334: note = chr5:125930586-125930920
  misc_feature 1..334: note = hyper
  source 1..334: mol_type = genomic DNA

SEQ ID NO: 50686 - DNA, 97 bp, Homo sapiens; identical to SEQ ID NO: 29870
  misc_feature 1..97: note = chr5:126366983-126367080
  misc_feature 1..97: note = hyper
  source 1..97: mol_type = genomic DNA

SEQ ID NO: 50687 - DNA, 30 bp, Homo sapiens; identical to SEQ ID NO: 29872
  misc_feature 1..30: note = chr5:127537200-127537230
  misc_feature 1..30: note = hyper
  source 1..30: mol_type = genomic DNA

SEQ ID NO: 50688 - DNA, 73 bp, Homo sapiens
  misc_feature 1..73: note = chr5:127872869-127872942
  misc_feature 1..73: note = hyper
  source 1..73: mol_type = genomic DNA
gaaggaaaagggggacgcgctcctgggggtctttggatattctggcaaagggggctgcagctctaggctccag

SEQ ID NO: 50689 - DNA, 190 bp, Homo sapiens
  misc_feature 1..190: note = chr5:127872990-127873180
  misc_feature 1..190: note = hyper
  source 1..190: mol_type = genomic DNA
tcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggc

SEQ ID NO: 50690 - DNA, 96 bp, Homo sapiens
  misc_feature 1..96: note = chr5:127873710-127873806
  misc_feature 1..96: note = hyper
  source 1..96: mol_type = genomic DNA
cgctccgaagacggatattggaaagctgcaaaagtcaccagaaagaaacaggcaagcaaacaaaagtcgcccccagaagaagaggagggttccctc

SEQ ID NO: 50691 - DNA, 467 bp, Homo sapiens
  misc_feature 1..467: note = chr5:127873981-127874448
  misc_feature 1..467: note = hyper
  source 1..467: mol_type = genomic DNA
cggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgt

SEQ ID NO: 50692 - DNA, 119 bp, Homo sapiens
  misc_feature 1..119: note = chr5:127874839-127874958
  misc_feature 1..119: note = hyper
  source 1..119: mol_type = genomic DNA
ggctgggagtttccagattgaaatgcgccctccaccaccaagagggagctcacgcggccgcggggggccgaggcagccagccggcgccgcggtcctggggagtccgtgcaggggtgtgc

SEQ ID NO: 50693 - DNA, 25 bp, Homo sapiens
  misc_feature 1..25: note = chr5:128300655-128300680
  misc_feature 1..25: note = hyper
  source 1..25: mol_type = genomic DNA
tggatgacctttgtgcgacactgtt

SEQ ID NO: 50694 - DNA, 246 bp, Homo sapiens; identical to SEQ ID NO: 29879
  misc_feature 1..246: note = chr5:128301033-128301279
  misc_feature 1..246: note = hyper
  source 1..246: mol_type = genomic DNA

SEQ ID NO: 50695 - DNA, 392 bp, Homo sapiens
  misc_feature 1..392: note = chr5:128795689-128796081
  misc_feature 1..392: note = hyper
  source 1..392: mol_type = genomic DNA
cagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgc

SEQ ID NO: 50696 - DNA, 277 bp, Homo sapiens
  misc_feature 1..277: note = chr5:128796244-128796521
  misc_feature 1..277: note = hyper
  source 1..277: mol_type = genomic DNA
gcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtcttt

SEQ ID NO: 50697 - DNA, 131 bp, Homo sapiens
  misc_feature 1..131: note = chr5:128796736-128796867
  misc_feature 1..131: note = hyper
  source 1..131: mol_type = genomic DNA
ttgtgctactggaaccgcggcactttaagccccgcacttctgtctgccccgcccgcagagctgcagttcgcccccgaccgcgaggagtgggaagtcgtgtttcctgcgctctggcgccgggagccggtgga

SEQ ID NO: 50698 - DNA, 359 bp, Homo sapiens; identical to SEQ ID NO: 18938
  misc_feature 1..359: note = chr5:128796985-128797344
  misc_feature 1..359: note = hyper
  source 1..359: mol_type = genomic DNA

SEQ ID NO: 50699 - DNA, 84 bp, Homo sapiens; identical to SEQ ID NO: 18939
  misc_feature 1..84: note = chr5:128797386-128797470
  misc_feature 1..84: note = hyper
  source 1..84: mol_type = genomic DNA

SEQ ID NO: 50700 - DNA, 137 bp, Homo sapiens; identical to SEQ ID NO: 29883
  misc_feature 1..137: note = chr5:129240373-129240510
  misc_feature 1..137: note = hyper
  source 1..137: mol_type = genomic DNA

SEQ ID NO: 50701 - DNA, 65 bp, Homo sapiens; identical to SEQ ID NO: 29884
  misc_feature 1..65: note = chr5:129240766-129240831
  misc_feature 1..65: note = hyper
  source 1..65: mol_type = genomic DNA

SEQ ID NO: 50702 - DNA, 81 bp, Homo sapiens; identical to SEQ ID NO: 29885
  misc_feature 1..81: note = chr5:129241413-129241494
  misc_feature 1..81: note = hyper
  source 1..81: mol_type = genomic DNA

SEQ ID NO: 50703 - DNA, 30 bp, Homo sapiens; identical to SEQ ID NO: 29886
  misc_feature 1..30: note = chr5:129241724-129241754
  misc_feature 1..30: note = hyper
  source 1..30: mol_type = genomic DNA

SEQ ID NO: 50704 - DNA, 360 bp, Homo sapiens; identical to SEQ ID NO: 29887
  misc_feature 1..360: note = chr5:131346877-131347237
  misc_feature 1..360: note = hyper
  source 1..360: mol_type = genomic DNA

SEQ ID NO: 50705 - DNA, 39 bp, Homo sapiens; identical to SEQ ID NO: 29888
  misc_feature 1..39: note = chr5:131347702-131347741
  misc_feature 1..39: note = hyper
  source 1..39: mol_type = genomic DNA

SEQ ID NO: 50706 - DNA, 123 bp, Homo sapiens; identical to SEQ ID NO: 29889
  misc_feature 1..123: note = chr5:131593289-131593412
  misc_feature 1..123: note = hyper
  source 1..123: mol_type = genomic DNA

SEQ ID NO: 50707 - DNA, 15 bp, Homo sapiens
  misc_feature 1..15: note = chr5:131593472-131593487
  misc_feature 1..15: note = hyper
  source 1..15: mol_type = genomic DNA
cgcctggtgggcggc

SEQ ID NO: 50708 - DNA, 66 bp, Homo sapiens
  misc_feature 1..66: note = chr5:131992030-131992096
  misc_feature 1..66: note = hyper
  source 1..66: mol_type = genomic DNA
agcttccagactggccggtctgcgcgcccacccctgcctcccggaccggccaccgccggaggccgc

SEQ ID NO: 50709 - DNA, 136 bp, Homo sapiens; identical to SEQ ID NO: 18943
  misc_feature 1..136: note = chr5:131992157-131992293
  misc_feature 1..136: note = hyper
  source 1..136: mol_type = genomic DNA

SEQ ID NO: 50710 - DNA, 246 bp, Homo sapiens; identical to SEQ ID NO: 29892
  misc_feature 1..246: note = chr5:132083083-132083329
  misc_feature 1..246: note = hyper
  source 1..246: mol_type = genomic DNA

SEQ ID NO: 50711 - DNA, 90 bp, Homo sapiens; identical to SEQ ID NO: 29893
  misc_feature 1..90: note = chr5:132947087-132947177
  misc_feature 1..90: note = hyper
  source 1..90: mol_type = genomic DNA

SEQ ID NO: 50712 - DNA, 21 bp, Homo sapiens
  misc_feature 1..21: note = chr5:132947465-132947486
  misc_feature 1..21: note = hyper
  source 1..21: mol_type = genomic DNA
ccctttgggctgcagcgagga

SEQ ID NO: 50713 - DNA, 693 bp, Homo sapiens; identical to SEQ ID NO: 18945
  misc_feature 1..693: note = chr5:132947836-132948529
  misc_feature 1..693: note = hyper
  source 1..693: mol_type = genomic DNA

SEQ ID NO: 50714 - DNA, 155 bp, Homo sapiens; identical to SEQ ID NO: 29895
  misc_feature 1..155: note = chr5:133449703-133449858
  misc_feature 1..155: note = hyper
  source 1..155: mol_type = genomic DNA

SEQ ID NO: 50715 - DNA, 32 bp, Homo sapiens
  misc_feature 1..32: note = chr5:134367203-134367235
  misc_feature 1..32: note = hyper
  source 1..32: mol_type = genomic DNA
gtaggcaggacggggagcgggtcacctgggct

SEQ ID NO: 50716 - DNA, 641 bp, Homo sapiens
  misc_feature 1..641: note = chr5:134375210-134375851
  misc_feature 1..641: note = hyper
  source 1..641: mol_type = genomic DNA
gcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggtttt

SEQ ID NO: 50717 - DNA, 30 bp, Homo sapiens; identical to SEQ ID NO: 29899
  misc_feature 1..30: note = chr5:134376833-134376863
  misc_feature 1..30: note = hyper
  source 1..30: mol_type = genomic DNA

SEQ ID NO: 50718 - DNA, 39 bp, Homo sapiens
  misc_feature 1..39: note = chr5:134385913-134385952
  misc_feature 1..39: note = hyper
  source 1..39: mol_type = genomic DNA
ggaagggcaggagggcgaggggctagggcgatggaaggg

SEQ ID NO: 50719 - DNA, 97 bp, Homo sapiens; identical to SEQ ID NO: 29902
  misc_feature 1..97: note = chr5:134801812-134801909
  misc_feature 1..97: note = hyper
  source 1..97: mol_type = genomic DNA

SEQ ID NO: 50720 - DNA, 93 bp, Homo sapiens; identical to SEQ ID NO: 29903
  misc_feature 1..93: note = chr5:134802273-134802366
  misc_feature 1..93: note = hyper
  source 1..93: mol_type = genomic DNA

SEQ ID NO: 50721 - DNA, 13 bp, Homo sapiens
  misc_feature 1..13: note = chr5:134825450-134825463
  misc_feature 1..13: note = hyper
  source 1..13: mol_type = genomic DNA
tccgagcccgtgg

SEQ ID NO: 50722 - DNA, 36 bp, Homo sapiens
  misc_feature 1..36: note = chr5:134826006-134826042
  misc_feature 1..36: note = hyper
  source 1..36: mol_type = genomic DNA
cacagtagattcacacccctccgaggggactaataa

SEQ ID NO: 50723 - DNA, 19 bp, Homo sapiens
  misc_feature 1..19: note = chr5:134826479-134826498
  misc_feature 1..19: note = hyper
  source 1..19: mol_type = genomic DNA
cgtgcgctgagggcccgga

SEQ ID NO: 50724 - DNA, 265 bp, Homo sapiens
  misc_feature 1..265: note = chr5:134870515-134870780
  misc_feature 1..265: note = hyper
  source 1..265: mol_type = genomic DNA
gcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggct

SEQ ID NO: 50725 - DNA, 184 bp, Homo sapiens
  misc_feature 1..184: note = chr5:134871417-134871601
  misc_feature 1..184: note = hyper
  source 1..184: mol_type = genomic DNA
cgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtct

SEQ ID NO: 50726 - DNA, 50 bp, Homo sapiens
  misc_feature 1..50: note = chr5:134879428-134879478
  misc_feature 1..50: note = hyper
  source 1..50: mol_type = genomic DNA
caagtcttgagcaaacgaccctagcgccgtggctcttcctacggcggggg

SEQ ID NO: 50727 - DNA, 376 bp, Homo sapiens
  misc_feature 1..376: note = chr5:134914251-134914627
  misc_feature 1..376: note = hyper
  source 1..376: mol_type = genomic DNA
ggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgccagcagcagcaggagcagcgcggccgccaggagcctcatgctgaccggaggggcgcggcgtgggagcagggacatggggagggcgctggcccgtcggagcggcggcccggagacgccacccagctctgctcggctttctctgcccggggcgcgccttccggctctgctggctccggctgcgccgtcggtggatgccca

SEQ ID NO: 50728 - skipped

SEQ ID NO: 50729 - DNA, 290 bp, Homo sapiens; identical to SEQ ID NO: 29911
  misc_feature 1..290: note = chr5:135170256-135170546
  misc_feature 1..290: note = hyper
  source 1..290: mol_type = genomic DNA

SEQ ID NO: 50730 - DNA, 172 bp, Homo sapiens; identical to SEQ ID NO: 29912
  misc_feature 1..172: note = chr5:135170997-135171169
  misc_feature 1..172: note = hyper
  source 1..172: mol_type = genomic DNA

SEQ ID NO: 50731 - DNA, 36 bp, Homo sapiens
  misc_feature 1..36: note = chr5:135265701-135265737
  misc_feature 1..36: note = hyper
  source 1..36: mol_type = genomic DNA
gcattgataaaggggcgcccttcatcgggagtaagt

SEQ ID NO: 50732 - DNA, 93 bp, Homo sapiens; identical to SEQ ID NO: 18953
  misc_feature 1..93: note = chr5:135265767-135265860
  misc_feature 1..93: note = hyper
  source 1..93: mol_type = genomic DNA

SEQ ID NO: 50733 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 50734 - DNA, 182 bp, Homo sapiens; identical to SEQ ID NO: 18955
  misc_feature 1..182: note = chr5:135265932-135266114
  misc_feature 1..182: note = hyper
  source 1..182: mol_type = genomic DNA

SEQ ID NO: 50735 - DNA, 33 bp, Homo sapiens
  misc_feature 1..33: note = chr5:135266672-135266705
  misc_feature 1..33: note = hyper
  source 1..33: mol_type = genomic DNA
cgagtgtgccttttaagacgcttccaagataaa

SEQ ID NO: 50736 - DNA, 62 bp, Homo sapiens; identical to SEQ ID NO: 29917
  misc_feature 1..62: note = chr5:135527945-135528007
  misc_feature 1..62: note = hyper
  source 1..62: mol_type = genomic DNA

SEQ ID NO: 50737 - DNA, 647 bp, Homo sapiens
  misc_feature 1..647: note = chr5:135528233-135528880
  misc_feature 1..647: note = hyper
  source 1..647: mol_type = genomic DNA
ccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcggg

SEQ ID NO: 50738 - DNA, 24 bp, Homo sapiens
  misc_feature 1..24: note = chr5:136834026-136834050
  misc_feature 1..24: note = hyper
  source 1..24: mol_type = genomic DNA
cgcgccccccagggccgggtggcg

SEQ ID NO: 50739 - DNA, 158 bp, Homo sapiens
  misc_feature 1..158: note = chr5:136834506-136834664
  misc_feature 1..158: note = hyper
  source 1..158: mol_type = genomic DNA
ccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctc

SEQ ID NO: 50740 - DNA, 14 bp, Homo sapiens
  misc_feature 1..14: note = chr5:136834706-136834720
  misc_feature 1..14: note = hyper
  source 1..14: mol_type = genomic DNA
cgacagctaaggga

SEQ ID NO: 50741 - DNA, 55 bp, Homo sapiens
  misc_feature 1..55: note = chr5:136834826-136834881
  misc_feature 1..55: note = hyper
  source 1..55: mol_type = genomic DNA
actactccaagttggggcgcggggttcctctgggcacgtaccttgggggccggcc

SEQ ID NO: 50742 - DNA, 107 bp, Homo sapiens; identical to SEQ ID NO: 29923
  misc_feature 1..107: note = chr5:136834912-136835019
  misc_feature 1..107: note = hyper
  source 1..107: mol_type = genomic DNA

SEQ ID NO: 50743 - skipped

SEQ ID NO: 50744 - DNA, 364 bp, Homo sapiens; identical to SEQ ID NO: 29925
  misc_feature 1..364: note = chr5:137577620-137577984
  misc_feature 1..364: note = hyper
  source 1..364: mol_type = genomic DNA

SEQ ID NO: 50745 - DNA, 33 bp, Homo sapiens
  misc_feature 1..33: note = chr5:139047957-139047990
  misc_feature 1..33: note = hyper
  source 1..33: mol_type = genomic DNA
acgcggacgtgcctgcgcggctctggcggccgc

SEQ ID NO: 50746 - DNA, 60 bp, Homo sapiens
  misc_feature 1..60: note = chr5:139048162-139048222
  misc_feature 1..60: note = hyper
  source 1..60: mol_type = genomic DNA
gggagccagctctgctcgcctggcttaacccagacgagcccaggacgccctatccctgaa

SEQ ID NO: 50747 - DNA, 49 bp, Homo sapiens; identical to SEQ ID NO: 29927
  misc_feature 1..49: note = chr5:139175487-139175536
  misc_feature 1..49: note = hyper
  source 1..49: mol_type = genomic DNA

SEQ ID NO: 50748 - DNA, 62 bp, Homo sapiens; identical to SEQ ID NO: 29928
  misc_feature 1..62: note = chr5:139175815-139175877
  misc_feature 1..62: note = hyper
  source 1..62: mol_type = genomic DNA

SEQ ID NO: 50749 - DNA, 58 bp, Homo sapiens; identical to SEQ ID NO: 29929
  misc_feature 1..58: note = chr5:139175929-139175987
  misc_feature 1..58: note = hyper
  source 1..58: mol_type = genomic DNA

SEQ ID NO: 50750 - DNA, 48 bp, Homo sapiens
  misc_feature 1..48: note = chr5:139227725-139227773
  misc_feature 1..48: note = hyper
  source 1..48: mol_type = genomic DNA
acgccgaggctgagccgccgcccgagccgctgctcagcgacagcgagt

SEQ ID NO: 50751 - DNA, 12 bp, Homo sapiens
  misc_feature 1..12: note = chr5:139227909-139227921
  misc_feature 1..12: note = hyper
  source 1..12: mol_type = genomic DNA
ggtctcgtactc

SEQ ID NO: 50752 - DNA, 36 bp, Homo sapiens; identical to SEQ ID NO: 29931
  misc_feature 1..36: note = chr5:139283710-139283746
  misc_feature 1..36: note = hyper
  source 1..36: mol_type = genomic DNA

SEQ ID NO: 50753 - DNA, 490 bp, Homo sapiens; identical to SEQ ID NO: 29932
  misc_feature 1..490: note = chr5:139283973-139284463
  misc_feature 1..490: note = hyper
  source 1..490: mol_type = genomic DNA

SEQ ID NO: 50754 - DNA, 305 bp, Homo sapiens; identical to SEQ ID NO: 18969
  misc_feature 1..305: note = chr5:139525423-139525728
  misc_feature 1..305: note = hyper
  source 1..305: mol_type = genomic DNA

SEQ ID NO: 50755 - DNA, 128 bp, Homo sapiens; identical to SEQ ID NO: 29934
  misc_feature 1..128: note = chr5:140012165-140012293
  misc_feature 1..128: note = hyper
  source 1..128: mol_type = genomic DNA

SEQ ID NO: 50756 - DNA, 35 bp, Homo sapiens; identical to SEQ ID NO: 29935
  misc_feature 1..35: note = chr5:140012364-140012399
  misc_feature 1..35: note = hyper
  source 1..35: mol_type = genomic DNA

SEQ ID NO: 50757 - DNA, 65 bp, Homo sapiens
  misc_feature 1..65: note = chr5:140174733-140174798
  misc_feature 1..65: note = hyper
  source 1..65: mol_type = genomic DNA
gcctgttccgggtggcgtccaaaagacacggggaccttctggaggtaaatctgcagaatggcatt

SEQ ID NO: 50758 - DNA, 11 bp, Homo sapiens
  misc_feature 1..11: note = chr5:140187083-140187094
  misc_feature 1..11: note = hyper
  source 1..11: mol_type = genomic DNA
ccacctggagg

SEQ ID NO: 50759 - DNA, 32 bp, Homo sapiens; identical to SEQ ID NO: 29938
  misc_feature 1..32: note = chr5:140214378-140214410
  misc_feature 1..32: note = hyper
  source 1..32: mol_type = genomic DNA

SEQ ID NO: 50760 - DNA, 60 bp, Homo sapiens; identical to SEQ ID NO: 29939
  misc_feature 1..60: note = chr5:140248774-140248834
  misc_feature 1..60: note = hyper
  source 1..60: mol_type = genomic DNA

SEQ ID NO: 50761 - DNA, 111 bp, Homo sapiens; identical to SEQ ID NO: 29940
  misc_feature 1..111: note = chr5:140261900-140262011
  misc_feature 1..111: note = hyper
  source 1..111: mol_type = genomic DNA

SEQ ID NO: 50762 - DNA, 173 bp, Homo sapiens; identical to SEQ ID NO: 18971
  misc_feature 1..173: note = chr5:140305805-140305978
  misc_feature 1..173: note = hyper
  source 1..173: mol_type = genomic DNA

SEQ ID NO: 50763 - DNA, 122 bp, Homo sapiens
  misc_feature 1..122: note = chr5:140306050-140306172
  misc_feature 1..122: note = hyper
  source 1..122: mol_type = genomic DNA
caccgtttaaggagagaagtgttagtgtctcggggcgtctcccaggctccgccctgcgcccgcagccagcgtggtggtcgagaccccagcccgctgctactggagacagcacctctcgcgcc

SEQ ID NO: 50764 - DNA, 54 bp, Homo sapiens
  misc_feature 1..54: note = chr5:140306733-140306787
  misc_feature 1..54: note = hyper
  source 1..54: mol_type = genomic DNA
tgtgcagggccaaagctgcctgcgtcttgacctacgacctggtgctcgaggacc

SEQ ID NO: 50765 - DNA, 30 bp, Homo sapiens; identical to SEQ ID NO: 8071
  misc_feature 1..30: note = chr5:140345497-140345527
  misc_feature 1..30: note = hyper
  source 1..30: mol_type = genomic DNA

SEQ ID NO: 50766 - DNA, 30 bp, Homo sapiens; identical to SEQ ID NO: 29945
  misc_feature 1..30: note = chr5:140345821-140345851
  misc_feature 1..30: note = hyper
  source 1..30: mol_type = genomic DNA

SEQ ID NO: 50767 - DNA, 40 bp, Homo sapiens; identical to SEQ ID NO: 29946
  misc_feature 1..40: note = chr5:140346709-140346749
  misc_feature 1..40: note = hyper
  source 1..40: mol_type = genomic DNA

SEQ ID NO: 50768 - DNA, 140 bp, Homo sapiens
  misc_feature 1..140: note = chr5:140514751-140514891
  misc_feature 1..140: note = hyper
  source 1..140: mol_type = genomic DNA
aatagtaaattaggacgcctggtggcgctgcaggctaagagtgtggatagtgggctctgcggataactcagacgccattaagctggggaatccaaactctaaaagaaggacgcattttaggtaagatctagtggctagat

SEQ ID NO: 50769 - DNA, 29 bp, Homo sapiens
  misc_feature 1..29: note = chr5:140514921-140514950
  misc_feature 1..29: note = hyper
  source 1..29: mol_type = genomic DNA
cagtcaagaaagatcggattcgcggttat

SEQ ID NO: 50770 - DNA, 182 bp, Homo sapiens; identical to SEQ ID NO: 29948
  misc_feature 1..182: note = chr5:140593316-140593498
  misc_feature 1..182: note = hyper
  source 1..182: mol_type = genomic DNA

SEQ ID NO: 50771 - DNA, 21 bp, Homo sapiens
  misc_feature 1..21: note = chr5:140604438-140604459
  misc_feature 1..21: note = hyper
  source 1..21: mol_type = genomic DNA
ctcctacaccctgttcgtccg

SEQ ID NO: 50772 - DNA, 12 bp, Homo sapiens
  misc_feature 1..12: note = chr5:140604501-140604513
  misc_feature 1..12: note = hyper
  source 1..12: mol_type = genomic DNA
cacagacagaga

SEQ ID NO: 50773 - DNA, 73 bp, Homo sapiens
  misc_feature 1..73: note = chr5:140613853-140613926
  misc_feature 1..73: note = hyper
  source 1..73: mol_type = genomic DNA
agagtcgcatggtggcgctgcaggataagacggtgaaatttttgtaaccgcagatgctctggttttccttaac

SEQ ID NO: 50774 - DNA, 28 bp, Homo sapiens
  misc_feature 1..28: note = chr5:140614383-140614411
  misc_feature 1..28: note = hyper
  source 1..28: mol_type = genomic DNA
cgagcagctggaccgggaggcactttgt

SEQ ID NO: 50775 - DNA, 120 bp, Homo sapiens; identical to SEQ ID NO: 29953
  misc_feature 1..120: note = chr5:140713985-140714105
  misc_feature 1..120: note = hyper
  source 1..120: mol_type = genomic DNA

SEQ ID NO: 50776 - DNA, 45 bp, Homo sapiens; identical to SEQ ID NO: 29954
  misc_feature 1..45: note = chr5:140767211-140767256
  misc_feature 1..45: note = hyper
  source 1..45: mol_type = genomic DNA

SEQ ID NO: 50777 - DNA, 182 bp, Homo sapiens; identical to SEQ ID NO: 18976
  misc_feature 1..182: note = chr5:140777487-140777669
  misc_feature 1..182: note = hyper
  source 1..182: mol_type = genomic DNA

SEQ ID NO: 50778 - DNA, 85 bp, Homo sapiens; identical to SEQ ID NO: 29956
  misc_feature 1..85: note = chr5:140787848-140787933
  misc_feature 1..85: note = hyper
  source 1..85: mol_type = genomic DNA

SEQ ID NO: 50779 - DNA, 290 bp, Homo sapiens
  misc_feature 1..290: note = chr5:140797342-140797632
  misc_feature 1..290: note = hyper
  source 1..290: mol_type = genomic DNA
cctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgag

SEQ ID NO: 50780 - DNA, 21 bp, Homo sapiens
  misc_feature 1..21: note = chr5:140800458-140800479
  misc_feature 1..21: note = hyper
  source 1..21: mol_type = genomic DNA
taagctctacaaatacgtgtg

SEQ ID NO: 50781 - DNA, 16 bp, Homo sapiens
  misc_feature 1..16: note = chr5:140801246-140801262
  misc_feature 1..16: note = hyper
  source 1..16: mol_type = genomic DNA
gcgatttgctcttcct

SEQ ID NO: 50782 - DNA, 11 bp, Homo sapiens
  misc_feature 1..11: note = chr5:140856622-140856633
  misc_feature 1..11: note = hyper
  source 1..11: mol_type = genomic DNA
gacaccaaact

SEQ ID NO: 50783 - DNA, 89 bp, Homo sapiens; identical to SEQ ID NO: 29963
  misc_feature 1..89: note = chr5:140864611-140864700
  misc_feature 1..89: note = hyper
  source 1..89: mol_type = genomic DNA

SEQ ID NO: 50784 - DNA, 38 bp, Homo sapiens; identical to SEQ ID NO: 29964
  misc_feature 1..38: note = chr5:141030807-141030845
  misc_feature 1..38: note = hyper
  source 1..38: mol_type = genomic DNA

SEQ ID NO: 50785 - DNA, 317 bp, Homo sapiens; identical to SEQ ID NO: 18980
  misc_feature 1..317: note = chr5:141262718-141263035
  misc_feature 1..317: note = hyper
  source 1..317: mol_type = genomic DNA

SEQ ID NO: 50786 - DNA, 288 bp, Homo sapiens; identical to SEQ ID NO: 29966
  misc_feature 1..288: note = chr5:141293747-141294035
  misc_feature 1..288: note = hyper
  source 1..288: mol_type = genomic DNA

SEQ ID NO: 50787 - DNA, 10 bp, Homo sapiens
  misc_feature 1..10: note = chr5:141931330-141931340
  misc_feature 1..10: note = hyper
  source 1..10: mol_type = genomic DNA
ctcacttctc

SEQ ID NO: 50788 - DNA, 155 bp, Homo sapiens; identical to SEQ ID NO: 29969
  misc_feature 1..155: note = chr5:142781720-142781875
  misc_feature 1..155: note = hyper
  source 1..155: mol_type = genomic DNA

SEQ ID NO: 50789 - DNA, 186 bp, Homo sapiens
  misc_feature 1..186: note = chr5:142784781-142784967
  misc_feature 1..186: note = hyper
  source 1..186: mol_type = genomic DNA
gggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcg

SEQ ID NO: 50790 - DNA, 287 bp, Homo sapiens; identical to SEQ ID NO: 29971
  misc_feature 1..287: note = chr5:143584834-143585121
  misc_feature 1..287: note = hyper
  source 1..287: mol_type = genomic DNA

SEQ ID NO: 50791 - DNA, 182 bp, Homo sapiens; identical to SEQ ID NO: 29972
  misc_feature 1..182: note = chr5:145214963-145215145
  misc_feature 1..182: note = hyper
  source 1..182: mol_type = genomic DNA

SEQ ID NO: 50792 - DNA, 50 bp, Homo sapiens; identical to SEQ ID NO: 29973
  misc_feature 1..50: note = chr5:145316176-145316226
  misc_feature 1..50: note = hyper
  source 1..50: mol_type = genomic DNA

SEQ ID NO: 50793 - skipped

SEQ ID NO: 50794 - DNA, 196 bp, Homo sapiens
  misc_feature 1..196: note = chr5:145716979-145717175
  misc_feature 1..196: note = hyper
  source 1..196: mol_type = genomic DNA
cagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggt

SEQ ID NO: 50795 - DNA, 265 bp, Homo sapiens; identical to SEQ ID NO: 29977
  misc_feature 1..265: note = chr5:145717780-145718045
  misc_feature 1..265: note = hyper
  source 1..265: mol_type = genomic DNA

SEQ ID NO: 50796 - DNA, 36 bp, Homo sapiens; identical to SEQ ID NO: 29978
  misc_feature 1..36: note = chr5:145718465-145718501
  misc_feature 1..36: note = hyper
  source 1..36: mol_type = genomic DNA

SEQ ID NO: 50797 - DNA, 12 bp, Homo sapiens
  misc_feature 1..12: note = chr5:145719925-145719937
  misc_feature 1..12: note = hyper
  source 1..12: mol_type = genomic DNA
ccttaaaaagaa

SEQ ID NO: 50798 - DNA, 280 bp, Homo sapiens; identical to SEQ ID NO: 2659
  misc_feature 1..280: note = chr5:145720018-145720298
  misc_feature 1..280: note = hyper
  source 1..280: mol_type = genomic DNA

SEQ ID NO: 50799 - DNA, 169 bp, Homo sapiens; identical to SEQ ID NO: 29986
  misc_feature 1..169: note = chr5:145723301-145723470
  misc_feature 1..169: note = hyper
  source 1..169: mol_type = genomic DNA

SEQ ID NO: 50800 - DNA, 166 bp, Homo sapiens
  misc_feature 1..166: note = chr5:145724336-145724502
  misc_feature 1..166: note = hyper
  source 1..166: mol_type = genomic DNA
gctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttc

SEQ ID NO: 50801 - DNA, 45 bp, Homo sapiens; identical to SEQ ID NO: 29988
  misc_feature 1..45: note = chr5:145724793-145724838
  misc_feature 1..45: note = hyper
  source 1..45: mol_type = genomic DNA

SEQ ID NO: 50802 - DNA, 83 bp, Homo sapiens
  misc_feature 1..83: note = chr5:145725844-145725927
  misc_feature 1..83: note = hyper
  source 1..83: mol_type = genomic DNA
cccacgcgttgcttatacctttctttgtaaactgtcagatttctgccccctccctcagttcagccctgcgcagccttgcctgc

SEQ ID NO: 50803 - DNA, 30 bp, Homo sapiens; identical to SEQ ID NO: 29990
  misc_feature 1..30: note = chr5:146256927-146256957
  misc_feature 1..30: note = hyper
  source 1..30: mol_type = genomic DNA

SEQ ID NO: 50804 - DNA, 35 bp, Homo sapiens; identical to SEQ ID NO: 29991
  misc_feature 1..35: note = chr5:146257159-146257194
  misc_feature 1..35: note = hyper
  source 1..35: mol_type = genomic DNA

SEQ ID NO: 50805 - DNA, 798 bp, Homo sapiens
  misc_feature 1..798: note = chr5:146257602-146258400
  misc_feature 1..798: note = hyper
  source 1..798: mol_type = genomic DNA
ttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagc

SEQ ID NO: 50806 - DNA, 35 bp, Homo sapiens; identical to SEQ ID NO: 29994
  misc_feature 1..35: note = chr5:146614297-146614332
  misc_feature 1..35: note = hyper
  source 1..35: mol_type = genomic DNA

SEQ ID NO: 50807 - DNA, 35 bp, Homo sapiens; identical to SEQ ID NO: 29995
  misc_feature 1..35: note = chr5:146614703-146614738
  misc_feature 1..35: note = hyper
  source 1..35: mol_type = genomic DNA

SEQ ID NO: 50808 - DNA, 36 bp, Homo sapiens; identical to SEQ ID NO: 29996
  misc_feature 1..36: note = chr5:146832654-146832690
  misc_feature 1..36: note = hyper
  source 1..36: mol_type = genomic DNA

SEQ ID NO: 50809 - DNA, 362 bp, Homo sapiens; identical to SEQ ID NO: 29997
  misc_feature 1..362: note = chr5:146888821-146889183
  misc_feature 1..362: note = hyper
  source 1..362: mol_type = genomic DNA

SEQ ID NO: 50810 - DNA, 239 bp, Homo sapiens
  misc_feature 1..239: note = chr5:146889575-146889814
  misc_feature 1..239: note = hyper
  source 1..239: mol_type = genomic DNA
cctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcc

SEQ ID NO: 50811 - DNA, 38 bp, Homo sapiens; identical to SEQ ID NO: 30000
  misc_feature 1..38: note = chr5:148033734-148033772
  misc_feature 1..38: note = hyper
  source 1..38: mol_type = genomic DNA

SEQ ID NO: 50812 - DNA, 160 bp, Homo sapiens; identical to SEQ ID NO: 8110
  misc_feature 1..160: note = chr5:148206272-148206432
  misc_feature 1..160: note = hyper
  source 1..160: mol_type = genomic DNA

SEQ ID NO: 50813 - DNA, 272 bp, Homo sapiens; identical to SEQ ID NO: 30002
  misc_feature 1..272: note = chr5:148521059-148521331
  misc_feature 1..272: note = hyper
  source 1..272: mol_type = genomic DNA

SEQ ID NO: 50814 - DNA, 184 bp, Homo sapiens; identical to SEQ ID NO: 30003
  misc_feature 1..184: note = chr5:148651223-148651407
  misc_feature 1..184: note = hyper
  source 1..184: mol_type = genomic DNA

SEQ ID NO: 50815 - DNA, 484 bp, Homo sapiens; identical to SEQ ID NO: 30004
  misc_feature 1..484: note = chr5:148651703-148652187
  misc_feature 1..484: note = hyper
  source 1..484: mol_type = genomic DNA

SEQ ID NO: 50816 - DNA, 22 bp, Homo sapiens
  misc_feature 1..22: note = chr5:149546581-149546603
  misc_feature 1..22: note = hyper
  source 1..22: mol_type = genomic DNA
actctcacgtggagccggcccc

SEQ ID NO: 50817 - DNA, 363 bp, Homo sapiens; identical to SEQ ID NO: 30006
  misc_feature 1..363: note = chr5:149569485-149569848
  misc_feature 1..363: note = hyper
  source 1..363: mol_type = genomic DNA

SEQ ID NO: 50818 - DNA, 43 bp, Homo sapiens
  misc_feature 1..43: note = chr5:149682031-149682074
  misc_feature 1..43: note = hyper
  source 1..43: mol_type = genomic DNA
tgcgagggagttcagcgccccccggggacggtccagtgtctgg

SEQ ID NO: 50819 - DNA, 43 bp, Homo sapiens
  misc_feature 1..43: note = chr5:150051058-150051101
  misc_feature 1..43: note = hyper
  source 1..43: mol_type = genomic DNA
attcttgcctccccccgacctttttttttggtggagggagaac

SEQ ID NO: 50820 - DNA, 125 bp, Homo sapiens
  misc_feature 1..125: note = chr5:150051667-150051792
  misc_feature 1..125: note = hyper
  source 1..125: mol_type = genomic DNA
caagaccaacccgcgctgcgaactcgtggcttcctcactgcagtcctccgtgtttcctgggatggggaggggtctcctgtgctggagcaactgtggcttcccattcccgccgtcctctcccctaa

SEQ ID NO: 50821 - DNA, 30 bp, Homo sapiens; identical to SEQ ID NO: 30009
  misc_feature 1..30: note = chr5:150052081-150052111
  misc_feature 1..30: note = hyper
  source 1..30: mol_type = genomic DNA

SEQ ID NO: 50822 - DNA, 201 bp, Homo sapiens
  misc_feature 1..201: note = chr5:150399922-150400123
  misc_feature 1..201: note = hyper
  source 1..201: mol_type = genomic DNA
aaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttg

SEQ ID NO: 50823 - DNA, 206 bp, Homo sapiens; identical to SEQ ID NO: 19001
  misc_feature 1..206: note = chr5:150400203-150400409
  misc_feature 1..206: note = hyper
  source 1..206: mol_type = genomic DNA

SEQ ID NO: 50824 - DNA, 142 bp, Homo sapiens
  misc_feature 1..142: note = chr5:151066300-151066442
  misc_feature 1..142: note = hyper
  source 1..142: mol_type = genomic DNA
agccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggc

SEQ ID NO: 50825 - DNA, 26 bp, Homo sapiens
  misc_feature 1..26: note = chr5:151066474-151066500
  misc_feature 1..26: note = hyper
  source 1..26: mol_type = genomic DNA
ctgaaggaccgcgggaatgtggaggg

SEQ ID NO: 50826 - DNA, 147 bp, Homo sapiens; identical to SEQ ID NO: 19003
  misc_feature 1..147: note = chr5:151304224-151304371
  misc_feature 1..147: note = hyper
  source 1..147: mol_type = genomic DNA

SEQ ID NO: 50827 - DNA, 238 bp, Homo sapiens; identical to SEQ ID NO: 19004
  misc_feature 1..238: note = chr5:151304401-151304639
  misc_feature 1..238: note = hyper
  source 1..238: mol_type = genomic DNA

SEQ ID NO: 50828 - DNA, 33 bp, Homo sapiens; identical to SEQ ID NO: 8118
  misc_feature 1..33: note = chr5:151304708-151304741
  misc_feature 1..33: note = hyper
  source 1..33: mol_type = genomic DNA

SEQ ID NO: 50829 - DNA, 126 bp, Homo sapiens; identical to SEQ ID NO: 30014
  misc_feature 1..126: note = chr5:152870193-152870319
  misc_feature 1..126: note = hyper
  source 1..126: mol_type = genomic DNA

SEQ ID NO: 50830 - DNA, 239 bp, Homo sapiens
  misc_feature 1..239: note = chr5:153852425-153852664
  misc_feature 1..239: note = hyper
  source 1..239: mol_type = genomic DNA
gcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgc

SEQ ID NO: 50831 - DNA, 512 bp, Homo sapiens
  misc_feature 1..512: note = chr5:153852792-153853304
  misc_feature 1..512: note = hyper
  source 1..512: mol_type = genomic DNA
tcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgcta

SEQ ID NO: 50832 - DNA, 34 bp, Homo sapiens; identical to SEQ ID NO: 19008
  misc_feature 1..34: note = chr5:153853386-153853420
  misc_feature 1..34: note = hyper
  source 1..34: mol_type = genomic DNA

SEQ ID NO: 50833 - DNA, 41 bp, Homo sapiens; identical to SEQ ID NO: 19009
  misc_feature 1..41: note = chr5:153853478-153853519
  misc_feature 1..41: note = hyper
  source 1..41: mol_type = genomic DNA

SEQ ID NO: 50834 - DNA, 147 bp, Homo sapiens
  misc_feature 1..147: note = chr5:153855264-153855411
  misc_feature 1..147: note = hyper
  source 1..147: mol_type = genomic DNA
cagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtg

SEQ ID NO: 50835 - DNA, 88 bp, Homo sapiens
  misc_feature 1..88: note = chr5:153855839-153855927
  misc_feature 1..88: note = hyper
  source 1..88: mol_type = genomic DNA
acttccgccagcctcccaacctggtttaaacatcagggcttggatgcaggcttggggccccctaagccggagctgggagcctcagata

SEQ ID NO: 50836 - DNA, 264 bp, Homo sapiens
  misc_feature 1..264: note = chr5:153856396-153856660
  misc_feature 1..264: note = hyper
  source 1..264: mol_type = genomic DNA
aaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattc

SEQ ID NO: 50837 - DNA, 74 bp, Homo sapiens
  misc_feature 1..74: note = chr5:153856862-153856936
  misc_feature 1..74: note = hyper
  source 1..74: mol_type = genomic DNA
ctccatgcacaggatcgcacgctgtgaccaaccatctcagaactcttcccaacctttccaaatcggacacagga

SEQ ID NO: 50838 - DNA, 202 bp, Homo sapiens
  misc_feature 1..202: note = chr5:153856996-153857198
  misc_feature 1..202: note = hyper
  source 1..202: mol_type = genomic DNA
ggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggca

SEQ ID NO: 50839 - DNA, 95 bp, Homo sapiens
  misc_feature 1..95: note = chr5:153857284-153857379
  misc_feature 1..95: note = hyper
  source 1..95: mol_type = genomic DNA
cgccggccaagacggccgccaagcgcctccagccgcccggggctctgcccaggcctggcgtcaggaccataggcggtggcggctgcagcggccgc

SEQ ID NO: 50840 - DNA, 452 bp, Homo sapiens
  misc_feature 1..452: note = chr5:153857429-153857881
  misc_feature 1..452: note = hyper
  source 1..452: mol_type = genomic DNA
gcagccagctctggaagtagggcctttcctgatgacagcgcgaggccggaccgaagaggaagggttcgtggagcatggggtgcgcagggtgcgggtggtgatggtggtgatggtgtgcgtagctgcccacgaggttcatgttggagcggctactggcctgcgccgccagccctattaacgccgctccatgcgccccagagactgccgggggccacctgtgggctctggagccactactgggcgccggctttgggagagtccgggcaaggctgaaaatgagacgcgcagcccactgtcttcttaccggtttctgccgcgggcgaggtcgccgaagcccaaagacctgtttaacccttctgcggactcccctgcggatctggcttatataagaccgcggctttgatgtcaacctctcccgggagccaatggcaggggggcggggataaggaaaa

SEQ ID NO: 50841 - DNA, 296 bp, Homo sapiens
  misc_feature 1..296: note = chr5:153858599-153858895
  misc_feature 1..296: note = hyper
  source 1..296: mol_type = genomic DNA
agatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccg

SEQ ID NO: 50842 - DNA, 22 bp, Homo sapiens
  misc_feature 1..22: note = chr5:153858916-153858938
  misc_feature 1..22: note = hyper
  source 1..22: mol_type = genomic DNA
cgacgtccggcatctctcacgc

SEQ ID NO: 50843 - DNA, 290 bp, Homo sapiens
  misc_feature 1..290: note = chr5:153859386-153859676
  misc_feature 1..290: note = hyper
  source 1..290: mol_type = genomic DNA
tgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgc

SEQ ID NO: 50844 - skipped

SEQ ID NO: 50845 - DNA, 44 bp, Homo sapiens; identical to SEQ ID NO: 30027
  misc_feature 1..44: note = chr5:153863373-153863417
  misc_feature 1..44: note = hyper
  source 1..44: mol_type = genomic DNA

SEQ ID NO: 50846 - skipped

SEQ ID NO: 50847 - DNA, 30 bp, Homo sapiens; identical to SEQ ID NO: 30029
  misc_feature 1..30: note = chr5:153863972-153864002
  misc_feature 1..30: note = hyper
  source 1..30: mol_type = genomic DNA

SEQ ID NO: 50848 - DNA, 304 bp, Homo sapiens; identical to SEQ ID NO: 30030
  misc_feature 1..304: note = chr5:153990970-153991274
  misc_feature 1..304: note = hyper
  source 1..304: mol_type = genomic DNA

SEQ ID NO: 50849 - DNA, 406 bp, Homo sapiens; identical to SEQ ID NO: 19018
  misc_feature 1..406: note = chr5:155107388-155107794
  misc_feature 1..406: note = hyper
  source 1..406: mol_type = genomic DNA

SEQ ID NO: 50850 - DNA, 31 bp, Homo sapiens
  misc_feature 1..31: note = chr5:155107848-155107879
  misc_feature 1..31: note = hyper
  source 1..31: mol_type = genomic DNA
tgccgctgccggagcccgaacccaagcccca

SEQ ID NO: 50851 - DNA, 207 bp, Homo sapiens
  misc_feature 1..207: note = chr5:155108526-155108733
  misc_feature 1..207: note = hyper
  source 1..207: mol_type = genomic DNA
gcgggatagcgtttatacccaggggtgagtaggccgctaatggaggccccctttacccccagctagcggcttgcatggacggcaaagagacgggagaaagttgggtctccttgcgcttaatctggcattggcagaggaatgcaacactgtttcctccaactcgattgccgcgggggtttccccagttccctccatctctaagccaag

SEQ ID NO: 50852 - DNA, 86 bp, Homo sapiens; identical to SEQ ID NO: 19019
  misc_feature 1..86: note = chr5:155108763-155108849
  misc_feature 1..86: note = hyper
  source 1..86: mol_type = genomic DNA

SEQ ID NO: 50853 - DNA, 255 bp, Homo sapiens; identical to SEQ ID NO: 30034
  misc_feature 1..255: note = chr5:155109192-155109447
  misc_feature 1..255: note = hyper
  source 1..255: mol_type = genomic DNA

SEQ ID NO: 50854 - DNA, 455 bp, Homo sapiens; identical to SEQ ID NO: 30035
  misc_feature 1..455: note = chr5:156887049-156887504
  misc_feature 1..455: note = hyper
  source 1..455: mol_type = genomic DNA

SEQ ID NO: 50855 - DNA, 15 bp, Homo sapiens
  misc_feature 1..15: note = chr5:157001843-157001858
  misc_feature 1..15: note = hyper
  source 1..15: mol_type = genomic DNA
cgcttcacagaaggg

SEQ ID NO: 50856 - DNA, 30 bp, Homo sapiens; identical to SEQ ID NO: 30037
  misc_feature 1..30: note = chr5:157002174-157002204
  misc_feature 1..30: note = hyper
  source 1..30: mol_type = genomic DNA

SEQ ID NO: 50857 - DNA, 332 bp, Homo sapiens; identical to SEQ ID NO: 30038
  misc_feature 1..332: note = chr5:157002447-157002779
  misc_feature 1..332: note = hyper
  source 1..332: mol_type = genomic DNA

SEQ ID NO: 50858 - DNA, 91 bp, Homo sapiens
  misc_feature 1..91: note = chr5:157098271-157098362
  misc_feature 1..91: note = hyper
  source 1..91: mol_type = genomic DNA
gccccgccagcaggccggggtcactgcagtccccacgtcgaagcggaaaaggtctgctcagctcaccgcaccccacttcttccagacccgt

SEQ ID NO: 50859 - DNA, 91 bp, Homo sapiens
  misc_feature 1..91: note = chr5:157098619-157098710
  misc_feature 1..91: note = hyper
  source 1..91: mol_type = genomic DNA
gcaatgacacagccgactaggccctcggtcacctgtgaccagggatcctccacgatcggcgggaccgccgcccaggcgaccaccagttcca

SEQ ID NO: 50860 - DNA, 25 bp, Homo sapiens
  misc_feature 1..25: note = chr5:158478441-158478466
  misc_feature 1..25: note = hyper
  source 1..25: mol_type = genomic DNA
cccacccccccaccccgccgcccgg

SEQ ID NO: 50861 - DNA, 51 bp, Homo sapiens
  misc_feature 1..51: note = chr5:158478764-158478815
  misc_feature 1..51: note = hyper
  source 1..51: mol_type = genomic DNA
agccgatcccgctttgcagttgtgcacaatcacaatcgcagccagcagttt

SEQ ID NO: 50862 - skipped

SEQ ID NO: 50863 - DNA, 289 bp, Homo sapiens; identical to SEQ ID NO: 30043
  misc_feature 1..289: note = chr5:158526129-158526418
  misc_feature 1..289: note = hyper
  source 1..289: mol_type = genomic DNA

SEQ ID NO: 50864 - DNA, 32 bp, Homo sapiens
  misc_feature 1..32: note = chr5:158527411-158527443
  misc_feature 1..32: note = hyper
  source 1..32: mol_type = genomic DNA
ataacgtcatctttccgcccaccgcagccaat

SEQ ID NO: 50865 - DNA, 45 bp, Homo sapiens
  misc_feature 1..45: note = chr5:158528069-158528114
  misc_feature 1..45: note = hyper
  source 1..45: mol_type = genomic DNA
tgccagggttgggcactgttctcactcacacgctcacctctctcg

SEQ ID NO: 50866 - DNA, 155 bp, Homo sapiens; identical to SEQ ID NO: 30046
  misc_feature 1..155: note = chr5:158533542-158533697
  misc_feature 1..155: note = hyper
  source 1..155: mol_type = genomic DNA

SEQ ID NO: 50867 - DNA, 96 bp, Homo sapiens; identical to SEQ ID NO: 30047
  misc_feature 1..96: note = chr5:159200128-159200224
  misc_feature 1..96: note = hyper
  source 1..96: mol_type = genomic DNA

SEQ ID NO: 50868 - DNA, 145 bp, Homo sapiens; identical to SEQ ID NO: 30048
  misc_feature 1..145: note = chr5:159343442-159343587
  misc_feature 1..145: note = hyper
  source 1..145: mol_type = genomic DNA

SEQ ID NO: 50869 - DNA, 23 bp, Homo sapiens
  misc_feature 1..23: note = chr5:159399072-159399095
  misc_feature 1..23: note = hyper
  source 1..23: mol_type = genomic DNA
tcgcctgggcggctgcgcctaca

SEQ ID NO: 50870 - DNA, 188 bp, Homo sapiens; identical to SEQ ID NO: 30050
  misc_feature 1..188: note = chr5:159399509-159399697
  misc_feature 1..188: note = hyper
  source 1..188: mol_type = genomic DNA

SEQ ID NO: 50871 - DNA, 86 bp, Homo sapiens; identical to SEQ ID NO: 30051
  misc_feature 1..86: note = chr5:159615222-159615308
  misc_feature 1..86: note = hyper
  source 1..86: mol_type = genomic DNA

SEQ ID NO: 50872 - DNA, 30 bp, Homo sapiens; identical to SEQ ID NO: 30052
  misc_feature 1..30: note = chr5:159738710-159738740
  misc_feature 1..30: note = hyper
  source 1..30: mol_type = genomic DNA

SEQ ID NO: 50873 - DNA, 30 bp, Homo sapiens; identical to SEQ ID NO: 30053
  misc_feature 1..30: note = chr5:159739156-159739186
  misc_feature 1..30: note = hyper
  source 1..30: mol_type = genomic DNA

SEQ ID NO: 50874 - DNA, 61 bp, Homo sapiens; identical to SEQ ID NO: 30054
  misc_feature 1..61: note = chr5:159739813-159739874
  misc_feature 1..61: note = hyper
  source 1..61: mol_type = genomic DNA

SEQ ID NO: 50875 - DNA, 336 bp, Homo sapiens; identical to SEQ ID NO: 30055
  misc_feature 1..336: note = chr5:160973454-160973790
  misc_feature 1..336: note = hyper
  source 1..336: mol_type = genomic DNA

SEQ ID NO: 50876 - DNA, 249 bp, Homo sapiens; identical to SEQ ID NO: 30056
  misc_feature 1..249: note = chr5:160974612-160974861
  misc_feature 1..249: note = hyper
  source 1..249: mol_type = genomic DNA

SEQ ID NO: 50877 - DNA, 257 bp, Homo sapiens; identical to SEQ ID NO: 30057
  misc_feature 1..257: note = chr5:160975090-160975347
  misc_feature 1..257: note = hyper
  source 1..257: mol_type = genomic DNA

SEQ ID NO: 50878 - DNA, 100 bp, Homo sapiens; identical to SEQ ID NO: 8154
  misc_feature 1..100: note = chr5:160975348-160975448
  misc_feature 1..100: note = hyper
  source 1..100: mol_type = genomic DNA

SEQ ID NO: 50879 - DNA, 180 bp, Homo sapiens; identical to SEQ ID NO: 19035
  misc_feature 1..180: note = chr5:160975754-160975934
  misc_feature 1..180: note = hyper
  source 1..180: mol_type = genomic DNA

SEQ ID NO: 50880 - DNA, 15 bp, Homo sapiens
  misc_feature 1..15: note = chr5:160975955-160975970
  misc_feature 1..15: note = hyper
  source 1..15: mol_type = genomic DNA
cggaagtagctccac

SEQ ID NO: 50881 - DNA, 30 bp, Homo sapiens; identical to SEQ ID NO: 8157
  misc_feature 1..30: note = chr5:161274605-161274635
  misc_feature 1..30: note = hyper
  source 1..30: mol_type = genomic DNA

SEQ ID NO: 50882 - DNA, 110 bp, Homo sapiens; identical to SEQ ID NO: 30062
  misc_feature 1..110: note = chr5:161275376-161275486
  misc_feature 1..110: note = hyper
  source 1..110: mol_type = genomic DNA

SEQ ID NO: 50883 - DNA, 55 bp, Homo sapiens; identical to SEQ ID NO: 30063
  misc_feature 1..55: note = chr5:161275816-161275871
  misc_feature 1..55: note = hyper
  source 1..55: mol_type = genomic DNA

SEQ ID NO: 50884 - DNA, 30 bp, Homo sapiens; identical to SEQ ID NO: 30064
  misc_feature 1..30: note = chr5:161495166-161495196
  misc_feature 1..30: note = hyper
  source 1..30: mol_type = genomic DNA

SEQ ID NO: 50885 - DNA, 69 bp, Homo sapiens; identical to SEQ ID NO: 30065
  misc_feature 1..69: note = chr5:162931214-162931283
  misc_feature 1..69: note = hyper
  source 1..69: mol_type = genomic DNA

SEQ ID NO: 50886 - DNA, 191 bp, Homo sapiens; identical to SEQ ID NO: 30066
  misc_feature 1..191: note = chr5:162931522-162931713
  misc_feature 1..191: note = hyper
  source 1..191: mol_type = genomic DNA

SEQ ID NO: 50887 - DNA, 100 bp, Homo sapiens; identical to SEQ ID NO: 30067
  misc_feature 1..100: note = chr5:166405747-166405847
  misc_feature 1..100: note = hyper
  source 1..100: mol_type = genomic DNA

SEQ ID NO: 50888 - DNA, 42 bp, Homo sapiens; identical to SEQ ID NO: 30068
  misc_feature 1..42: note = chr5:166406152-166406194
  misc_feature 1..42: note = hyper
  source 1..42: mol_type = genomic DNA

SEQ ID NO: 50889 - DNA, 222 bp, Homo sapiens; identical to SEQ ID NO: 30069
  misc_feature 1..222: note = chr5:166406254-166406476
  misc_feature 1..222: note = hyper
  source 1..222: mol_type = genomic DNA

SEQ ID NO: 50890 - DNA, 50 bp, Homo sapiens; identical to SEQ ID NO: 30070
  misc_feature 1..50: note = chr5:167001021-167001071
  misc_feature 1..50: note = hyper
  source 1..50: mol_type = genomic DNA

SEQ ID NO: 50891 - DNA, 87 bp, Homo sapiens; identical to SEQ ID NO: 19042
  misc_feature 1..87: note = chr5:167956090-167956177
  misc_feature 1..87: note = hyper
  source 1..87: mol_type = genomic DNA

SEQ ID NO: 50892 - DNA, 129 bp, Homo sapiens; identical to SEQ ID NO: 30073
  misc_feature 1..129: note = chr5:167956694-167956823
  misc_feature 1..129: note = hyper
  source 1..129: mol_type = genomic DNA

SEQ ID NO: 50893 - DNA, 136 bp, Homo sapiens; identical to SEQ ID NO: 30074
  misc_feature 1..136: note = chr5:167956844-167956980
  misc_feature 1..136: note = hyper
  source 1..136: mol_type = genomic DNA

SEQ ID NO: 50894 - DNA, 448 bp, Homo sapiens
  misc_feature 1..448: note = chr5:168727476-168727924
  misc_feature 1..448: note = hyper
  source 1..448: mol_type = genomic DNA
caggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcg

SEQ ID NO: 50895 - DNA, 82 bp, Homo sapiens; identical to SEQ ID NO: 8166
  misc_feature 1..82: note = chr5:168727994-168728076
  misc_feature 1..82: note = hyper
  source 1..82: mol_type = genomic DNA

SEQ ID NO: 50896 - DNA, 276 bp, Homo sapiens; identical to SEQ ID NO: 30077
  misc_feature 1..276: note = chr5:168728077-168728353
  misc_feature 1..276: note = hyper
  source 1..276: mol_type = genomic DNA

SEQ ID NO: 50897 - DNA, 30 bp, Homo sapiens; identical to SEQ ID NO: 30078
  misc_feature 1..30: note = chr5:168728570-168728600
  misc_feature 1..30: note = hyper
  source 1..30: mol_type = genomic DNA

SEQ ID NO: 50898 - DNA, 305 bp, Homo sapiens
  misc_feature 1..305: note = chr5:169064022-169064327
  misc_feature 1..305: note = hyper
  source 1..305: mol_type = genomic DNA
gcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggccca

SEQ ID NO: 50899 - DNA, 30 bp, Homo sapiens; identical to SEQ ID NO: 30081
  misc_feature 1..30: note = chr5:169930863-169930893
  misc_feature 1..30: note = hyper
  source 1..30: mol_type = genomic DNA

SEQ ID NO: 50900 - DNA, 104 bp, Homo sapiens; identical to SEQ ID NO: 30082
  misc_feature 1..104: note = chr5:169931223-169931327
  misc_feature 1..104: note = hyper
  source 1..104: mol_type = genomic DNA

SEQ ID NO: 50901 - DNA, 131 bp, Homo sapiens; identical to SEQ ID NO: 30083
  misc_feature 1..131: note = chr5:169931353-169931484
  misc_feature 1..131: note = hyper
  source 1..131: mol_type = genomic DNA

SEQ ID NO: 50902 - DNA, 328 bp, Homo sapiens
  misc_feature 1..328: note = chr5:170107959-170108287
  misc_feature 1..328: note = hyper
  source 1..328: mol_type = genomic DNA
tggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccga

SEQ ID NO: 50903 - DNA, 70 bp, Homo sapiens
  misc_feature 1..70: note = chr5:170108372-170108442
  misc_feature 1..70: note = hyper
  source 1..70: mol_type = genomic DNA
tgaaatgtggtgcgcctggggagtgcgggagccaggaagttagggtctcctgctccggccctatgagcat

SEQ ID NO: 50904 - DNA, 42 bp, Homo sapiens
  misc_feature 1..42: note = chr5:170735112-170735154
  misc_feature 1..42: note = hyper
  source 1..42: mol_type = genomic DNA
aacgattttagaattcgctggaagaaaatgattccgcttgtc

SEQ ID NO: 50905 - DNA, 115 bp, Homo sapiens
  misc_feature 1..115: note = chr5:170735206-170735321
  misc_feature 1..115: note = hyper
  source 1..115: mol_type = genomic DNA
tgccctgggccgggtagacagtcactgaggcgcgagcagaacggggagtggttccagcgcccaaagtggactggagccgggaagggctcaccagtcgcgtttcccaaagaaatcc

SEQ ID NO: 50906 - DNA, 219 bp, Homo sapiens
  misc_feature 1..219: note = chr5:170737479-170737698
  misc_feature 1..219: note = hyper
  source 1..219: mol_type = genomic DNA
ttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcact

SEQ ID NO: 50907 - DNA, 342 bp, Homo sapiens; identical to SEQ ID NO: 19055
  misc_feature 1..342: note = chr5:170739481-170739823
  misc_feature 1..342: note = hyper
  source 1..342: mol_type = genomic DNA

SEQ ID NO: 50908 - skipped

SEQ ID NO: 50909 - DNA, 86 bp, Homo sapiens
  misc_feature 1..86: note = chr5:170745303-170745389
  misc_feature 1..86: note = hyper
  source 1..86: mol_type = genomic DNA
gttgagctcaggggccgatggtgattatccagcatgcgaagctgccttgcatttgcatccactgttcaggtgctacagctggggca

SEQ ID NO: 50910 - DNA, 102 bp, Homo sapiens; identical to SEQ ID NO: 30103
  misc_feature 1..102: note = chr5:172386993-172387095
  misc_feature 1..102: note = hyper
  source 1..102: mol_type = genomic DNA

SEQ ID NO: 50911 - DNA, 54 bp, Homo sapiens
  misc_feature 1..54: note = chr5:172655825-172655879
  misc_feature 1..54: note = hyper
  source 1..54: mol_type = genomic DNA
caaggctgttgcctgcggcgtagaagcgctgggcctgagctcggaatgcttccc

SEQ ID NO: 50912 - DNA, 346 bp, Homo sapiens
  misc_feature 1..346: note = chr5:172656215-172656561
  misc_feature 1..346: note = hyper
  source 1..346: mol_type = genomic DNA
taatttttttccctttcttttttaaataaacctaccttccttcccccattttttccttttaatatcgctgtttatctccattttttttaactgcggcgtgttcttgttcgattttaaaaaatactaaaaataaaatgagtcccctaggtgcctccctggcgccctaggcatggagagctcatgcctgcgccaccctcatctccgctggctttgccacctcggaggcgccccacacttctcctttgttttgcttttctctgagccggttgagttttcttaccctgaatgcgtcgtttatacaattagcaactgaacacagaacaaatatcaccgatataattggggt

SEQ ID NO: 50913 - DNA, 200 bp, Homo sapiens
  misc_feature 1..200: note = chr5:172659655-172659855
  misc_feature 1..200: note = hyper
  source 1..200: mol_type = genomic DNA
gacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtccccta

SEQ ID NO: 50914 - DNA, 36 bp, Homo sapiens
  misc_feature 1..36: note = chr5:172660218-172660254
  misc_feature 1..36: note = hyper
  source 1..36: mol_type = genomic DNA
gggaacagagaggcagagagacgcttggtaagagcg

SEQ ID NO: 50915 - DNA, 643 bp, Homo sapiens
  misc_feature 1..643: note = chr5:172661684-172662327
  misc_feature 1..643: note = hyper
  source 1..643: mol_type = genomic DNA
tggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaaaggcagacgcacacttggccggtgaaggcgcgcggcccagctctgcgcgcagctctgggaggcccggcgcagccgcctcgggcccagcgtaggcctctggcttgaaggcggccagcatgcaggaggagggcgccagggtcgcctccaggcgggcagagagctctccggcggcagccaggctgcgctgctgctgttccaggtttaggatgtctttgactgagaagggcgtgggcgtgagagcagggctggggaacatggtggcagcgccagtctcacagcgccaggtgggcggcagaaagcggcgctgcccacggcccctggcagcttccctgcatggtgccgccgcccgcccgcgcacccgtcggccagctctggatgtgtccgggcagcaggtagcgctgagcacaaggggcaggagaggcgggaccaggccagaggagggggactcagcctgccattgggccaggggcctcgatgacaggagcgatgagcagttt

SEQ ID NO: 50916 - DNA, 16 bp, Homo sapiens
  misc_feature 1..16: note = chr5:172664210-172664226
  misc_feature 1..16: note = hyper
  source 1..16: mol_type = genomic DNA
caaattctccttggac

SEQ ID NO: 50917 - DNA, 110 bp, Homo sapiens
  misc_feature 1..110: note = chr5:172664487-172664597
  misc_feature 1..110: note = hyper
  source 1..110: mol_type = genomic DNA
ctgctggccaggcggctcgcgatgacagtttgaaagattagtgtgagcggacgcctgaaatattaccgtttaatgggggacatcgaggctacatccgggatccctgtttt

SEQ ID NO: 50918 - DNA, 142 bp, Homo sapiens
  misc_feature 1..142: note = chr5:172665448-172665590
  misc_feature 1..142: note = hyper
  source 1..142: mol_type = genomic DNA
ggaatgtcattaatgcgctggggagacgtccattggagacaggcggcgttatccgcggctttatcttcaacaacgcctcgctctcggcccgcgcgggggaaacagatgggagtttctgtctgggacgctcgccccatgttta

SEQ ID NO: 50919 - DNA, 53 bp, Homo sapiens
  misc_feature 1..53: note = chr5:172665812-172665865
  misc_feature 1..53: note = hyper
  source 1..53: mol_type = genomic DNA
cctccgcctccgcctccgcgctgggcccctccgccgcccggcttccttcctgg

SEQ ID NO: 50920 - DNA, 162 bp, Homo sapiens
  misc_feature 1..162: note = chr5:172670821-172670983
  misc_feature 1..162: note = hyper
  source 1..162: mol_type = genomic DNA
gtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcgg

SEQ ID NO: 50921 - DNA, 80 bp, Homo sapiens
  misc_feature 1..80: note = chr5:172671018-172671098
  misc_feature 1..80: note = hyper
  source 1..80: mol_type = genomic DNA
ctcggagtcccgtcgctggaggtcacagctgggaaaatcaggtgacattcgagtcagatggacaacgactcagatacagt

SEQ ID NO: 50922 - DNA, 146 bp, Homo sapiens; identical to SEQ ID NO: 30115
  misc_feature 1..146: note = chr5:172672747-172672893
  misc_feature 1..146: note = hyper
  source 1..146: mol_type = genomic DNA

SEQ ID NO: 50923 - DNA, 97 bp, Homo sapiens; identical to SEQ ID NO: 30116
  misc_feature 1..97: note = chr5:172672960-172673057
  misc_feature 1..97: note = hyper
  source 1..97: mol_type = genomic DNA

SEQ ID NO: 50924 - DNA, 109 bp, Homo sapiens; identical to SEQ ID NO: 30117
  misc_feature 1..109: note = chr5:172710849-172710958
  misc_feature 1..109: note = hyper
  source 1..109: mol_type = genomic DNA

SEQ ID NO: 50925 - DNA, 234 bp, Homo sapiens
  misc_feature 1..234: note = chr5:172754355-172754589
  misc_feature 1..234: note = hyper
  source 1..234: mol_type = genomic DNA
tgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttt

SEQ ID NO: 50926 - DNA, 211 bp, Homo sapiens; identical to SEQ ID NO: 19067
  misc_feature 1..211: note = chr5:172754621-172754832
  misc_feature 1..211: note = hyper
  source 1..211: mol_type = genomic DNA

SEQ ID NO: 50927 - DNA, 62 bp, Homo sapiens; identical to SEQ ID NO: 30119
  misc_feature 1..62: note = chr5:172755316-172755378
  misc_feature 1..62: note = hyper
  source 1..62: mol_type = genomic DNA

SEQ ID NO: 50928 - DNA, 50 bp, Homo sapiens
  misc_feature 1..50: note = chr5:172755420-172755470
  misc_feature 1..50: note = hyper
  source 1..50: mol_type = genomic DNA
cggcaatggcagggatggtgcctcaaatatccctggaagctctggtgtca

SEQ ID NO: 50929 - DNA, 671 bp, Homo sapiens; identical to SEQ ID NO: 19068
  misc_feature 1..671: note = chr5:172756377-172757048
  misc_feature 1..671: note = hyper
  source 1..671: mol_type = genomic DNA

SEQ ID NO: 50930 - DNA, 111 bp, Homo sapiens
  misc_feature 1..111: note = chr5:172757111-172757222
  misc_feature 1..111: note = hyper
  source 1..111: mol_type = genomic DNA
gagggggtggggagggcgtcttcagagtgggcttcccctgcgctggagcgccagggagcatccataaattgtcactttgaaggtccgaacctgcggcggtagggaccatgc

SEQ ID NO: 50931 - DNA, 400 bp, Homo sapiens; identical to SEQ ID NO: 30123
  misc_feature 1..400: note = chr5:173738828-173739228
  misc_feature 1..400: note = hyper
  source 1..400: mol_type = genomic DNA

SEQ ID NO: 50932 - DNA, 55 bp, Homo sapiens; identical to SEQ ID NO: 8210
  misc_feature 1..55: note = chr5:174119987-174120042
  misc_feature 1..55: note = hyper
  source 1..55: mol_type = genomic DNA

SEQ ID NO: 50933 - DNA, 103 bp, Homo sapiens
  misc_feature 1..103: note = chr5:174147420-174147523
  misc_feature 1..103: note = hyper
  source 1..103: mol_type = genomic DNA
cctctcccctctctgcgcctggacgacttcatctgtggaatggggagaaagctcaggctttagggggccttcagtaatctgcatcgtgcttttggcaaaagct

SEQ ID NO: 50934 - DNA, 23 bp, Homo sapiens
  misc_feature 1..23: note = chr5:174150445-174150468
  misc_feature 1..23: note = hyper
  source 1..23: mol_type = genomic DNA
tcgaagctcgctctccccttccc

SEQ ID NO: 50935 - DNA, 72 bp, Homo sapiens; identical to SEQ ID NO: 30128
  misc_feature 1..72: note = chr5:174151125-174151197
  misc_feature 1..72: note = hyper
  source 1..72: mol_type = genomic DNA

SEQ ID NO: 50936 - DNA, 306 bp, Homo sapiens; identical to SEQ ID NO: 30129
  misc_feature 1..306: note = chr5:174151463-174151769
  misc_feature 1..306: note = hyper
  source 1..306: mol_type = genomic DNA

SEQ ID NO: 50937 - skipped

SEQ ID NO: 50938 - DNA, 30 bp, Homo sapiens; identical to SEQ ID NO: 30131
  misc_feature 1..30: note = chr5:174162217-174162247
  misc_feature 1..30: note = hyper
  source 1..30: mol_type = genomic DNA

SEQ ID NO: 50939 - DNA, 37 bp, Homo sapiens; identical to SEQ ID NO: 8213
  misc_feature 1..37: note = chr5:174162509-174162546
  misc_feature 1..37: note = hyper
  source 1..37: mol_type = genomic DNA

SEQ ID NO: 50940 - DNA, 86 bp, Homo sapiens; identical to SEQ ID NO: 30133
  misc_feature 1..86: note = chr5:174162770-174162856
  misc_feature 1..86: note = hyper
  source 1..86: mol_type = genomic DNA

SEQ ID NO: 50941 - DNA, 41 bp, Homo sapiens; identical to SEQ ID NO: 30134
  misc_feature 1..41: note = chr5:174178168-174178209
  misc_feature 1..41: note = hyper
  source 1..41: mol_type = genomic DNA

SEQ ID NO: 50942 - DNA, 126 bp, Homo sapiens; identical to SEQ ID NO: 30135
  misc_feature 1..126: note = chr5:174178667-174178793
  misc_feature 1..126: note = hyper
  source 1..126: mol_type = genomic DNA

SEQ ID NO: 50943 - DNA, 86 bp, Homo sapiens; identical to SEQ ID NO: 30136
  misc_feature 1..86: note = chr5:174220856-174220942
  misc_feature 1..86: note = hyper
  source 1..86: mol_type = genomic DNA

SEQ ID NO: 50944 - DNA, 39 bp, Homo sapiens
  misc_feature 1..39: note = chr5:174870699-174870738
  misc_feature 1..39: note = hyper
  source 1..39: mol_type = genomic DNA
accttgccttggggtcgtctctctcaaagcccctggagc

SEQ ID NO: 50945 - DNA, 388 bp, Homo sapiens; identical to SEQ ID NO: 19074
  misc_feature 1..388: note = chr5:174870786-174871174
  misc_feature 1..388: note = hyper
  source 1..388: mol_type = genomic DNA

SEQ ID NO: 50946 - DNA, 381 bp, Homo sapiens; identical to SEQ ID NO: 19075
  misc_feature 1..381: note = chr5:174871497-174871878
  misc_feature 1..381: note = hyper
  source 1..381: mol_type = genomic DNA

SEQ ID NO: 50947 - DNA, 97 bp, Homo sapiens
  misc_feature 1..97: note = chr5:175085050-175085147
  misc_feature 1..97: note = hyper
  source 1..97: mol_type = genomic DNA
aggccgtgcgcgcgccgcccgctgcatccctgcccggagcgcagccggcgcgggcgcgggaccgaggcgaaccgggtgcggagccaatacccgcggc

SEQ ID NO: 50948 - DNA, 106 bp, Homo sapiens; identical to SEQ ID NO: 19077
  misc_feature 1..106: note = chr5:175085209-175085315
  misc_feature 1..106: note = hyper
  source 1..106: mol_type = genomic DNA

SEQ ID NO: 50949 - DNA, 25 bp, Homo sapiens
  misc_feature 1..25: note = chr5:175085719-175085744
  misc_feature 1..25: note = hyper
  source 1..25: mol_type = genomic DNA
gaccgatgaccggagccacaacagg

SEQ ID NO: 50950 - DNA, 30 bp, Homo sapiens; identical to SEQ ID NO: 30140
  misc_feature 1..30: note = chr5:175223481-175223511
  misc_feature 1..30: note = hyper
  source 1..30: mol_type = genomic DNA

SEQ ID NO: 50951 - DNA, 70 bp, Homo sapiens; identical to SEQ ID NO: 30141
  misc_feature 1..70: note = chr5:175223880-175223950
  misc_feature 1..70: note = hyper
  source 1..70: mol_type = genomic DNA

SEQ ID NO: 50952 - DNA, 321 bp, Homo sapiens; identical to SEQ ID NO: 30142
  misc_feature 1..321: note = chr5:175224441-175224762
  misc_feature 1..321: note = hyper
  source 1..321: mol_type = genomic DNA

SEQ ID NO: 50953 - DNA, 40 bp, Homo sapiens; identical to SEQ ID NO: 8222
  misc_feature 1..40: note = chr5:175298910-175298950
  misc_feature 1..40: note = hyper
  source 1..40: mol_type = genomic DNA

SEQ ID NO: 50954 - DNA, 138 bp, Homo sapiens
  misc_feature 1..138: note = chr5:175299156-175299294
  misc_feature 1..138: note = hyper
  source 1..138: mol_type = genomic DNA
cccggaggagggagtcgcccccaggggtacagtgcgcactcccggagtgagtcagagggcggcggcaggggggcggacagaccgcaggtggaggggaggagaacgtagacattgacaggggatgggggaccaagggga

SEQ ID NO: 50955 - DNA, 550 bp, Homo sapiens; identical to SEQ ID NO: 30146
  misc_feature 1..550: note = chr5:175299591-175300141
  misc_feature 1..550: note = hyper
  source 1..550: mol_type = genomic DNA

SEQ ID NO: 50956 - DNA, 29 bp, Homo sapiens
  misc_feature 1..29: note = chr5:175300142-175300171
  misc_feature 1..29: note = hyper
  source 1..29: mol_type = genomic DNA
cagggatagaccaaggcttcccgcagaat

SEQ ID NO: 50957 - DNA, 135 bp, Homo sapiens; identical to SEQ ID NO: 19083
  misc_feature 1..135: note = chr5:175300216-175300351
  misc_feature 1..135: note = hyper
  source 1..135: mol_type = genomic DNA

SEQ ID NO: 50958 - DNA, 31 bp, Homo sapiens; identical to SEQ ID NO: 19084
  misc_feature 1..31: note = chr5:175300381-175300412
  misc_feature 1..31: note = hyper
  source 1..31: mol_type = genomic DNA

SEQ ID NO: 50959 - DNA, 54 bp, Homo sapiens; identical to SEQ ID NO: 30149
  misc_feature 1..54: note = chr5:175488184-175488238
  misc_feature 1..54: note = hyper
  source 1..54: mol_type = genomic DNA

SEQ ID NO: 50960 - DNA, 308 bp, Homo sapiens; identical to SEQ ID NO: 30150
  misc_feature 1..308: note = chr5:175560514-175560822
  misc_feature 1..308: note = hyper
  source 1..308: mol_type = genomic DNA

SEQ ID NO: 50961 - DNA, 48 bp, Homo sapiens
  misc_feature 1..48: note = chr5:175621342-175621390
  misc_feature 1..48: note = hyper
  source 1..48: mol_type = genomic DNA
gccggcgcctgctcccgcagacctgccatgccaatgctctccaagctg

SEQ ID NO: 50962 - skipped

SEQ ID NO: 50963 - DNA, 83 bp, Homo sapiens; identical to SEQ ID NO: 30152
  misc_feature 1..83: note = chr5:175626566-175626649
  misc_feature 1..83: note = hyper
  source 1..83: mol_type = genomic DNA

SEQ ID NO: 50964 - DNA, 108 bp, Homo sapiens; identical to SEQ ID NO: 30153
  misc_feature 1..108: note = chr5:175792208-175792316
  misc_feature 1..108: note = hyper
  source 1..108: mol_type = genomic DNA

SEQ ID NO: 50965 - DNA, 325 bp, Homo sapiens
  misc_feature 1..325: note = chr5:175792540-175792865
  misc_feature 1..325: note = hyper
  source 1..325: mol_type = genomic DNA
cgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtc

SEQ ID NO: 50966 - DNA, 155 bp, Homo sapiens
  misc_feature 1..155: note = chr5:175793063-175793218
  misc_feature 1..155: note = hyper
  source 1..155: mol_type = genomic DNA
tcggctcgcgcccctccggcgcctgcgcagtgcaccccgcccgggggtggggatgtcgggagaaaccccatcccctcccgcctgcggtcgggactccgagaccggtggaggaagcggggcgcgcgagcgtttaaggaattcgccaagggtttgga

SEQ ID NO: 50967 - DNA, 71 bp, Homo sapiens; identical to SEQ ID NO: 30157
  misc_feature 1..71: note = chr5:176038550-176038621
  misc_feature 1..71: note = hyper
  source 1..71: mol_type = genomic DNA

SEQ ID NO: 50968 - DNA, 74 bp, Homo sapiens
  misc_feature 1..74: note = chr5:176046289-176046363
  misc_feature 1..74: note = hyper
  source 1..74: mol_type = genomic DNA
gcctcggtgcaagcgcggagagagggcctctgcggcaagagggcaggggcggggcctcgcgcagggactgccta

SEQ ID NO: 50969 - DNA, 48 bp, Homo sapiens
  misc_feature 1..48: note = chr5:176046554-176046602
  misc_feature 1..48: note = hyper
  source 1..48: mol_type = genomic DNA
cggcgccttcgtgggggtgggagggtggagcaccggaggccagggctc

SEQ ID NO: 50970 - DNA, 659 bp, Homo sapiens; identical to SEQ ID NO: 30159
  misc_feature 1..659: note = chr5:176056505-176057164
  misc_feature 1..659: note = hyper
  source 1..659: mol_type = genomic DNA

SEQ ID NO: 50971 - DNA, 141 bp, Homo sapiens; identical to SEQ ID NO: 30160
  misc_feature 1..141: note = chr5:176057373-176057514
  misc_feature 1..141: note = hyper
  source 1..141: mol_type = genomic DNA

SEQ ID NO: 50972 - DNA, 30 bp, Homo sapiens; identical to SEQ ID NO: 30161
  misc_feature 1..30: note = chr5:176057751-176057781
  misc_feature 1..30: note = hyper
  source 1..30: mol_type = genomic DNA

SEQ ID NO: 50973 - DNA, 194 bp, Homo sapiens
  misc_feature 1..194: note = chr5:176107080-176107274
  misc_feature 1..194: note = hyper
  source 1..194: mol_type = genomic DNA
gccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaa

SEQ ID NO: 50974 - DNA, 30 bp, Homo sapiens; identical to SEQ ID NO: 30164
  misc_feature 1..30: note = chr5:176170309-176170339
  misc_feature 1..30: note = hyper
  source 1..30: mol_type = genomic DNA

SEQ ID NO: 50975 - DNA, 100 bp, Homo sapiens
  misc_feature 1..100: note = chr5:176236898-176236998
  misc_feature 1..100: note = hyper
  source 1..100: mol_type = genomic DNA
ccagcctgcgaggctgggactgcgggtgtccccgagtctggcctgccagctctggtggccagggcacctctgcgcgcgggccagggccccggggctctcc

SEQ ID NO: 50976 - DNA, 17 bp, Homo sapiens
  misc_feature 1..17: note = chr5:176237148-176237165
  misc_feature 1..17: note = hyper
  source 1..17: mol_type = genomic DNA
cgcgccggggtcgccgc

SEQ ID NO: 50977 - DNA, 95 bp, Homo sapiens; identical to SEQ ID NO: 2711
  misc_feature 1..95: note = chr5:177411327-177411422
  misc_feature 1..95: note = hyper
  source 1..95: mol_type = genomic DNA

SEQ ID NO: 50978 - DNA, 131 bp, Homo sapiens
  misc_feature 1..131: note = chr5:177411507-177411638
  misc_feature 1..131: note = hyper
  source 1..131: mol_type = genomic DNA
cgcggagatgggccagagtccggccatccagaagtgcctggagcgcacagcaaggccctgccctcggctccgtgaaggtgagggggtaaagtcggcccggagtccccgggggtgcaggaggggccccgcgg

SEQ ID NO: 50979 - DNA, 68 bp, Homo sapiens
  misc_feature 1..68: note = chr5:177412141-177412209
  misc_feature 1..68: note = hyper
  source 1..68: mol_type = genomic DNA
atcgtaaacggggcaacttccaactctgccagttttaagcttctagagtatctcctcggcggagcgcg

SEQ ID NO: 50980 - DNA, 90 bp, Homo sapiens; identical to SEQ ID NO: 30170
  misc_feature 1..90: note = chr5:177412560-177412650
  misc_feature 1..90: note = hyper
  source 1..90: mol_type = genomic DNA

SEQ ID NO: 50981 - DNA, 30 bp, Homo sapiens; identical to SEQ ID NO: 30171
  misc_feature 1..30: note = chr5:177666777-177666807
  misc_feature 1..30: note = hyper
  source 1..30: mol_type = genomic DNA

SEQ ID NO: 50982 - DNA, 38 bp, Homo sapiens
  misc_feature 1..38: note = chr5:178004287-178004325
  misc_feature 1..38: note = hyper
  source 1..38: mol_type = genomic DNA
cgtctcccctcttctcgggacaccagccctgttggatc

SEQ ID NO: 50983 - DNA, 49 bp, Homo sapiens
  misc_feature 1..49: note = chr5:178017867-178017916
  misc_feature 1..49: note = hyper
  source 1..49: mol_type = genomic DNA
agaggcagggtcgagattgcgccaaacagaaatacgccccttagaatct

SEQ ID NO: 50984 - DNA, 43 bp, Homo sapiens; identical to SEQ ID NO: 30176
  misc_feature 1..43: note = chr5:178422264-178422307
  misc_feature 1..43: note = hyper
  source 1..43: mol_type = genomic DNA

SEQ ID NO: 50985 - DNA, 217 bp, Homo sapiens; identical to SEQ ID NO: 30177
  misc_feature 1..217: note = chr5:178450901-178451118
  misc_feature 1..217: note = hyper
  source 1..217: mol_type = genomic DNA

SEQ ID NO: 50986 - DNA, 346 bp, Homo sapiens
  misc_feature 1..346: note = chr5:178487398-178487744
  misc_feature 1..346: note = hyper
  source 1..346: mol_type = genomic DNA
cggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtg

SEQ ID NO: 50987 - DNA, 338 bp, Homo sapiens; identical to SEQ ID NO: 30180
  misc_feature 1..338: note = chr5:178594123-178594461
  misc_feature 1..338: note = hyper
  source 1..338: mol_type = genomic DNA

SEQ ID NO: 50988 - DNA, 145 bp, Homo sapiens; identical to SEQ ID NO: 30181
  misc_feature 1..145: note = chr5:178770760-178770905
  misc_feature 1..145: note = hyper
  source 1..145: mol_type = genomic DNA

SEQ ID NO: 50989 - DNA, 116 bp, Homo sapiens; identical to SEQ ID NO: 19103
  misc_feature 1..116: note = chr5:178771198-178771314
  misc_feature 1..116: note = hyper
  source 1..116: mol_type = genomic DNA

SEQ ID NO: 50990 - DNA, 15 bp, Homo sapiens
  misc_feature 1..15: note = chr5:178771967-178771982
  misc_feature 1..15: note = hyper
  source 1..15: mol_type = genomic DNA
cgccagtgctccgag

SEQ ID NO: 50991 - DNA, 21 bp, Homo sapiens
  misc_feature 1..21: note = chr5:178772184-178772205
  misc_feature 1..21: note = hyper
  source 1..21: mol_type = genomic DNA
acctacctggggggtcggcgg

SEQ ID NO: 50992 - DNA, 331 bp, Homo sapiens; identical to SEQ ID NO: 19106
  misc_feature 1..331: note = chr5:178772272-178772603
  misc_feature 1..331: note = hyper
  source 1..331: mol_type = genomic DNA

SEQ ID NO: 50993 - DNA, 58 bp, Homo sapiens; identical to SEQ ID NO: 2722
  misc_feature 1..58: note = chr5:178772778-178772836
  misc_feature 1..58: note = hyper
  source 1..58: mol_type = genomic DNA

SEQ ID NO: 50994 - DNA, 40 bp, Homo sapiens
  misc_feature 1..40: note = chr5:178957597-178957637
  misc_feature 1..40: note = hyper
  source 1..40: mol_type = genomic DNA
cgagggtgatctgagatccaaagtcaggagtcttctgcat

SEQ ID NO: 50995 - skipped

SEQ ID NO: 50996 - DNA, 31 bp, Homo sapiens; identical to SEQ ID NO: 30189
  misc_feature 1..31: note = chr5:179243847-179243878
  misc_feature 1..31: note = hyper
  source 1..31: mol_type = genomic DNA

SEQ ID NO: 50997 - DNA, 22 bp, Homo sapiens
  misc_feature 1..22: note = chr5:179244320-179244342
  misc_feature 1..22: note = hyper
  source 1..22: mol_type = genomic DNA
gggcgttcgtcctccatccctc

SEQ ID NO: 50998 - DNA, 34 bp, Homo sapiens; identical to SEQ ID NO: 30191
  misc_feature 1..34: note = chr5:179498329-179498363
  misc_feature 1..34: note = hyper
  source 1..34: mol_type = genomic DNA

SEQ ID NO: 50999 - DNA, 30 bp, Homo sapiens; identical to SEQ ID NO: 30192
  misc_feature 1..30: note = chr5:179498867-179498897
  misc_feature 1..30: note = hyper
  source 1..30: mol_type = genomic DNA

SEQ ID NO: 51000 - DNA, 55 bp, Homo sapiens; identical to SEQ ID NO: 30193
  misc_feature 1..55: note = chr5:179635756-179635811
  misc_feature 1..55: note = hyper
  source 1..55: mol_type = genomic DNA

SEQ ID NO: 51001 - DNA, 39 bp, Homo sapiens; identical to SEQ ID NO: 30194
  misc_feature 1..39: note = chr5:179636267-179636306
  misc_feature 1..39: note = hyper
  source 1..39: mol_type = genomic DNA

SEQ ID NO: 51002 - DNA, 135 bp, Homo sapiens; identical to SEQ ID NO: 8263
  misc_feature 1..135: note = chr5:179779648-179779783
  misc_feature 1..135: note = hyper
  source 1..135: mol_type = genomic DNA

SEQ ID NO: 51003 - DNA, 173 bp, Homo sapiens; identical to SEQ ID NO: 8264
  misc_feature 1..173: note = chr5:179779840-179780013
  misc_feature 1..173: note = hyper
  source 1..173: mol_type = genomic DNA

SEQ ID NO: 51004 - DNA, 69 bp, Homo sapiens; identical to SEQ ID NO: 19112
  misc_feature 1..69: note = chr5:179780035-179780104
  misc_feature 1..69: note = hyper
  source 1..69: mol_type = genomic DNA

SEQ ID NO: 51005 - DNA, 562 bp, Homo sapiens
  misc_feature 1..562: note = chr5:179780144-179780706
  misc_feature 1..562: note = hyper
  source 1..562: mol_type = genomic DNA
agaggctgcggcgccgggacccgcggacggcgtggaggaggcggctcgggcgggcgcggcactcaccgcacatcgtggctgcttctcgggctccttcgcggctcgagggggtctgcccgttcggacgctggggctcctccgtgggctcctccgtgggctccgtgggctccgtgggctccgcgggctccagctcccgtccgctcggcctccagcccttataacccggagccctccgagagggcggggaagggggcggggaaggggcggggcttcccccgcccgcctgctcccattggcccccggttgtcgtgacaacgacgggacccggcccccaggagccagggaggggggccgaggggcggctcccaggcgcgggtcgggcgtgtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacgggg

SEQ ID NO: 51006 - DNA, 307 bp, Homo sapiens
  misc_feature 1..307: note = chr5:179780985-179781292
  misc_feature 1..307: note = hyper
  source 1..307: mol_type = genomic DNA
ccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcactctgggcccctcgtctcccgaggaaggtcacgagaaccggcccaacgtttgcgcactttgaagttt

SEQ ID NO: 51007 - DNA, 410 bp, Homo sapiens
  misc_feature 1..410: note = chr5:180017198-180017608
  misc_feature 1..410: note = hyper
  source 1..410: mol_type = genomic DNA
ttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggc

SEQ ID NO: 51008 - DNA, 199 bp, Homo sapiens; identical to SEQ ID NO: 19118
  misc_feature 1..199: note = chr5:180017933-180018132
  misc_feature 1..199: note = hyper
  source 1..199: mol_type = genomic DNA

SEQ ID NO: 51009 - DNA, 181 bp, Homo sapiens
  misc_feature 1..181: note = chr5:180018498-180018679
  misc_feature 1..181: note = hyper
  source 1..181: mol_type = genomic DNA
tgcccgggcaaggccacgaggcttcttatacccggtcctcgcccctccagcgccggcctcgcccgcgctcctgagaaagccctgcccgctccgctcacggccgtgccctggccaacttcctgctgcggccggcgggccctgggaagcccgtgcccccttccctgcccgggcctcgaggact

SEQ ID NO: 51010 - DNA, 55 bp, Homo sapiens
  misc_feature 1..55: note = chr5:180075791-180075846
  misc_feature 1..55: note = hyper
  source 1..55: mol_type = genomic DNA
tcctcagctggccttcgaggcccctgtcccctcaaatccggggacccctggcctt

SEQ ID NO: 51011 - DNA, 141 bp, Homo sapiens; identical to SEQ ID NO: 19121
  misc_feature 1..141: note = chr5:180076317-180076458
  misc_feature 1..141: note = hyper
  source 1..141: mol_type = genomic DNA

SEQ ID NO: 51012 - DNA, 35 bp, Homo sapiens; identical to SEQ ID NO: 19122
  misc_feature 1..35: note = chr5:180076532-180076567
  misc_feature 1..35: note = hyper
  source 1..35: mol_type = genomic DNA

SEQ ID NO: 51013 - DNA, 202 bp, Homo sapiens; identical to SEQ ID NO: 19123
  misc_feature 1..202: note = chr5:180076602-180076804
  misc_feature 1..202: note = hyper
  source 1..202: mol_type = genomic DNA

SEQ ID NO: 51014 - DNA, 88 bp, Homo sapiens
  misc_feature 1..88: note = chr5:180076996-180077084
  misc_feature 1..88: note = hyper
  source 1..88: mol_type = genomic DNA
agacccagtctcaaaaataaacaagcaaataaataaaataatacgccgagcttggttgtgcgcgcctgtaatcccagcttctcggggg

SEQ ID NO: 51015 - DNA, 258 bp, Homo sapiens; identical to SEQ ID NO: 30205
  misc_feature 1..258: note = chr5:180100616-180100874
  misc_feature 1..258: note = hyper
  source 1..258: mol_type = genomic DNA

SEQ ID NO: 51016 - DNA, 193 bp, Homo sapiens
  misc_feature 1..193: note = chr5:180527353-180527546
  misc_feature 1..193: note = hyper
  source 1..193: mol_type = genomic DNA
atctcccacccttgccgccctctggatccagcgtccaccgagcactttttccagttccttcattctgcgcgcgagtcagcttgctgtgtagggacagaagatgacgaagtgaattcctgcagcccgccgagctgttgctgtcgccctgggagcagggcacgctcttgaccatccactcgcagatctgcgacag

SEQ ID NO: 51017 - DNA, 46 bp, Homo sapiens; identical to SEQ ID NO: 30208
  misc_feature 1..46: note = chr5:180527793-180527839
  misc_feature 1..46: note = hyper
  source 1..46: mol_type = genomic DNA

SEQ ID NO: 51018 - DNA, 29 bp, Homo sapiens
  misc_feature 1..29: note = chr5:180530748-180530777
  misc_feature 1..29: note = hyper
  source 1..29: mol_type = genomic DNA
gctgggattacaggcgtgagcccccgcgc

SEQ ID NO: 51019 - DNA, 139 bp, Homo sapiens; identical to SEQ ID NO: 30210
  misc_feature 1..139: note = chr5:180531166-180531305
  misc_feature 1..139: note = hyper
  source 1..139: mol_type = genomic DNA

SEQ ID NO: 51020 - DNA, 84 bp, Homo sapiens
  misc_feature 1..84: note = chr5:180600774-180600858
  misc_feature 1..84: note = hyper
  source 1..84: mol_type = genomic DNA
cctacaacactccaccgctatctccacctggttaaggaaaaaaggctatcaagggtatttatacctttgcctttccgcctcaac

SEQ ID NO: 51021 - DNA, 184 bp, Homo sapiens
  misc_feature 1..184: note = chr5:180601218-180601402
  misc_feature 1..184: note = hyper
  source 1..184: mol_type = genomic DNA
tcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggagg

SEQ ID NO: 51022 - DNA, 243 bp, Homo sapiens; identical to SEQ ID NO: 30213
  misc_feature 1..243: note = chr5:180632859-180633102
  misc_feature 1..243: note = hyper
  source 1..243: mol_type = genomic DNA

SEQ ID NO: 51023 - DNA, 89 bp, Homo sapiens
  misc_feature 1..89: note = chr6:711053-711142
  misc_feature 1..89: note = hyper
  source 1..89: mol_type = genomic DNA
tccagtggcatttcccgtcttacacgatgagcttcatccacgttctccataaccccctccccgccacgggaagcgtcagccacctggaa

SEQ ID NO: 51024 - DNA, 189 bp, Homo sapiens; identical to SEQ ID NO: 30222
  misc_feature 1..189: note = chr6:1311809-1311998
  misc_feature 1..189: note = hyper
  source 1..189: mol_type = genomic DNA

SEQ ID NO: 51025 - DNA, 30 bp, Homo sapiens; identical to SEQ ID NO: 30223
  misc_feature 1..30: note = chr6:1312754-1312784
  misc_feature 1..30: note = hyper
  source 1..30: mol_type = genomic DNA

SEQ ID NO: 51026 - DNA, 62 bp, Homo sapiens; identical to SEQ ID NO: 30224
  misc_feature 1..62: note = chr6:1314000-1314062
  misc_feature 1..62: note = hyper
  source 1..62: mol_type = genomic DNA

SEQ ID NO: 51027 - DNA, 23 bp, Homo sapiens
  misc_feature 1..23: note = chr6:1378199-1378222
  misc_feature 1..23: note = hyper
  source 1..23: mol_type = genomic DNA
catattggaggaagtcggccggc

SEQ ID NO: 51028 - DNA, 210 bp, Homo sapiens; identical to SEQ ID NO: 30226
  misc_feature 1..210: note = chr6:1379267-1379477
  misc_feature 1..210: note = hyper
  source 1..210: mol_type = genomic DNA

SEQ ID NO: 51029 - DNA, 210 bp, Homo sapiens
  misc_feature 1..210: note = chr6:1379699-1379909
  misc_feature 1..210: note = hyper
  source 1..210: mol_type = genomic DNA
cggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacc

SEQ ID NO: 51030 - DNA, 191 bp, Homo sapiens; identical to SEQ ID NO: 30228
  misc_feature 1..191: note = chr6:1381893-1382084
  misc_feature 1..191: note = hyper
  source 1..191: mol_type = genomic DNA

SEQ ID NO: 51031 - DNA, 186 bp, Homo sapiens; identical to SEQ ID NO: 30229
  misc_feature 1..186: note = chr6:1382452-1382638
  misc_feature 1..186: note = hyper
  source 1..186: mol_type = genomic DNA

SEQ ID NO: 51032 - DNA, 448 bp, Homo sapiens; identical to SEQ ID NO: 30230
  misc_feature 1..448: note = chr6:1382993-1383441
  misc_feature 1..448: note = hyper
  source 1..448: mol_type = genomic DNA

SEQ ID NO: 51033 - DNA, 147 bp, Homo sapiens
  misc_feature 1..147: note = chr6:1384971-1385118
  misc_feature 1..147: note = hyper
  source 1..147: mol_type = genomic DNA
tctccactcactccccgcaaccccgcaactcgccacccctaaacgcagcgggctgtaggcgaagtcgaagaggtgctccgcctggtaccgcggcctgcgcactgggatcggggcctgcaggccgctgggctggctcctgggatcatc

SEQ ID NO: 51034 - DNA, 126 bp, Homo sapiens
  misc_feature 1..126: note = chr6:1385170-1385296
  misc_feature 1..126: note = hyper
  source 1..126: mol_type = genomic DNA
tgcggaaatggggtgaggccggtcttcgcttgagggtctcgtagattggacccctttttcccccttcaagcaccctcagacctggccagtgggtcatcgagtcgtgcccaccgcccaggccaggag

SEQ ID NO: 51035 - DNA, 33 bp, Homo sapiens; identical to SEQ ID NO: 30236
  misc_feature 1..33: note = chr6:1385653-1385686
  misc_feature 1..33: note = hyper
  source 1..33: mol_type = genomic DNA

SEQ ID NO: 51036 - DNA, 35 bp, Homo sapiens; identical to SEQ ID NO: 30237
  misc_feature 1..35: note = chr6:1386121-1386156
  misc_feature 1..35: note = hyper
  source 1..35: mol_type = genomic DNA

SEQ ID NO: 51037 - DNA, 118 bp, Homo sapiens
  misc_feature 1..118: note = chr6:1389006-1389124
  misc_feature 1..118: note = hyper
  source 1..118: mol_type = genomic DNA
acactaactggggtgcgggggtggggggaagaagtggaagcaaatgcaaccctaagtcccatgagatccaggtttccagagtctttgaaacttggcctaggtttctcagtgtaaatcc

SEQ ID NO: 51038 - DNA, 13 bp, Homo sapiens
  misc_feature 1..13: note = chr6:1389262-1389275
  misc_feature 1..13: note = hyper
  source 1..13: mol_type = genomic DNA
tctggcaccccgg

SEQ ID NO: 51039 - DNA, 291 bp, Homo sapiens
  misc_feature 1..291: note = chr6:1389950-1390241
  misc_feature 1..291: note = hyper
  source 1..291: mol_type = genomic DNA
gctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccc

SEQ ID NO: 51040 - DNA, 283 bp, Homo sapiens; identical to SEQ ID NO: 19133
  misc_feature 1..283: note = chr6:1391035-1391318
  misc_feature 1..283: note = hyper
  source 1..283: mol_type = genomic DNA

SEQ ID NO: 51041 - DNA, 27 bp, Homo sapiens
  misc_feature 1..27: note = chr6:1391379-1391406
  misc_feature 1..27: note = hyper
  source 1..27: mol_type = genomic DNA
agctgggcgcaccgcttctaggcctcc

SEQ ID NO: 51042 - DNA, 86 bp, Homo sapiens
  misc_feature 1..86: note = chr6:1605301-1605387
  misc_feature 1..86: note = hyper
  source 1..86: mol_type = genomic DNA
aaggaaggctggctgcggccccggcgcctgggtccgctgcggcgccgggccggagacctgggaacagccagccacctgcaaggttg

SEQ ID NO: 51043 - DNA, 57 bp, Homo sapiens
  misc_feature 1..57: note = chr6:1605454-1605511
  misc_feature 1..57: note = hyper
  source 1..57: mol_type = genomic DNA
cttcccacacccacagccaaggcgcgtccgtgcaggggcacacgccttctgctccag

SEQ ID NO: 51044 - DNA, 370 bp, Homo sapiens; identical to SEQ ID NO: 30244
  misc_feature 1..370: note = chr6:1611389-1611759
  misc_feature 1..370: note = hyper
  source 1..370: mol_type = genomic DNA

SEQ ID NO: 51045 - DNA, 10 bp, Homo sapiens
  misc_feature 1..10: note = chr6:1614190-1614200
  misc_feature 1..10: note = hyper
  source 1..10: mol_type = genomic DNA
ccgggaagat

SEQ ID NO: 51046 - DNA, 49 bp, Homo sapiens; identical to SEQ ID NO: 30246
  misc_feature 1..49: note = chr6:1614286-1614335
  misc_feature 1..49: note = hyper
  source 1..49: mol_type = genomic DNA

SEQ ID NO: 51047 - DNA, 39 bp, Homo sapiens; identical to SEQ ID NO: 30247
  misc_feature 1..39: note = chr6:1619896-1619935
  misc_feature 1..39: note = hyper
  source 1..39: mol_type = genomic DNA

SEQ ID NO: 51048 - DNA, 500 bp, Homo sapiens; identical to SEQ ID NO: 30249
  misc_feature 1..500: note = chr6:2903017-2903517
  misc_feature 1..500: note = hyper
  source 1..500: mol_type = genomic DNA

SEQ ID NO: 51049 - DNA, 92 bp, Homo sapiens; identical to SEQ ID NO: 30250
  misc_feature 1..92: note = chr6:3228298-3228390
  misc_feature 1..92: note = hyper
  source 1..92: mol_type = genomic DNA

SEQ ID NO: 51050 - DNA, 45 bp, Homo sapiens
  misc_feature 1..45: note = chr6:3228984-3229029
  misc_feature 1..45: note = hyper
  source 1..45: mol_type = genomic DNA
agggtggcccaagcccgagtaacaaactttcttatcttccatcgc

SEQ ID NO: 51051 - DNA, 15 bp, Homo sapiens
  misc_feature 1..15: note = chr6:3229059-3229074
  misc_feature 1..15: note = hyper
  source 1..15: mol_type = genomic DNA
cggttgaagggtggg

SEQ ID NO: 51052 - DNA, 36 bp, Homo sapiens
  misc_feature 1..36: note = chr6:3229387-3229423
  misc_feature 1..36: note = hyper
  source 1..36: mol_type = genomic DNA
acacttcggaagggccgttggcgaggtgacgtgacc

SEQ ID NO: 51053 - DNA, 358 bp, Homo sapiens; identical to SEQ ID NO: 30253
  misc_feature 1..358: note = chr6:3231580-3231938
  misc_feature 1..358: note = hyper
  source 1..358: mol_type = genomic DNA

SEQ ID NO: 51054 - DNA, 37 bp, Homo sapiens; identical to SEQ ID NO: 30254
  misc_feature 1..37: note = chr6:4135160-4135197
  misc_feature 1..37: note = hyper
  source 1..37: mol_type = genomic DNA

SEQ ID NO: 51055 - DNA, 41 bp, Homo sapiens; identical to SEQ ID NO: 8306
  misc_feature 1..41: note = chr6:4775411-4775452
  misc_feature 1..41: note = hyper
  source 1..41: mol_type = genomic DNA

SEQ ID NO: 51056 - DNA, 137 bp, Homo sapiens; identical to SEQ ID NO: 30256
  misc_feature 1..137: note = chr6:5026605-5026742
  misc_feature 1..137: note = hyper
  source 1..137: mol_type = genomic DNA

SEQ ID NO: 51057 - DNA, 591 bp, Homo sapiens; identical to SEQ ID NO: 30257
  misc_feature 1..591: note = chr6:5085738-5086329
  misc_feature 1..591: note = hyper
  source 1..591: mol_type = genomic DNA

SEQ ID NO: 51058 - DNA, 30 bp, Homo sapiens; identical to SEQ ID NO: 30258
  misc_feature 1..30: note = chr6:5851459-5851489
  misc_feature 1..30: note = hyper
  source 1..30: mol_type = genomic DNA

SEQ ID NO: 51059 - DNA, 114 bp, Homo sapiens; identical to SEQ ID NO: 30259
  misc_feature 1..114: note = chr6:5851703-5851817
  misc_feature 1..114: note = hyper
  source 1..114: mol_type = genomic DNA

SEQ ID NO: 51060 - DNA, 683 bp, Homo sapiens; identical to SEQ ID NO: 30260
  misc_feature 1..683: note = chr6:5996021-5996704
  misc_feature 1..683: note = hyper
  source 1..683: mol_type = genomic DNA

SEQ ID NO: 51061 - DNA, 254 bp, Homo sapiens
  misc_feature 1..254: note = chr6:5996989-5997243
  misc_feature 1..254: note = hyper
  source 1..254: mol_type = genomic DNA
aaacgaaaccaacaaaatgcaactattttccaaaaccccgagcgtttgctggtgggtgaccaccccgcgcaggtagcgcggatctgctttggttttgactgagaacccgggttttgactgagacctccgtcgggaggaggggactgggtgggagttagcgggcgaaacgattccccggagtggccccgagcggcgcgtgcgtgaacgcgcggccgtaatatatgctgccattaagaatccgtgcagcttccagc

SEQ ID NO: 51062 - DNA, 245 bp, Homo sapiens
  misc_feature 1..245: note = chr6:5997557-5997802
  misc_feature 1..245: note = hyper
  source 1..245: mol_type = genomic DNA
cagttctttctcccccgcctactccaggcctgcagtccccggacccgggtcgcctctgcccatttactccggaatgtttacttctctttaaggccatgcggggcctataaataggagaggtggaatcagccccactgccagatcaatagggcccgtctcctcgccatttcagctgagctgtcttattaattatgaaaggattcacctgatccctgccagggaacacagcctctcggcccctctgc

SEQ ID NO: 51063 - DNA, 18 bp, Homo sapiens
  misc_feature 1..18: note = chr6:6003269-6003287
  misc_feature 1..18: note = hyper
  source 1..18: mol_type = genomic DNA
aagcctcaggcttggcgc

SEQ ID NO: 51064 - DNA, 16 bp, Homo sapiens
  misc_feature 1..16: note = chr6:6006358-6006374
  misc_feature 1..16: note = hyper
  source 1..16: mol_type = genomic DNA
gttccctatcactctc

SEQ ID NO: 51065 - DNA, 69 bp, Homo sapiens
  misc_feature 1..69: note = chr6:6006883-6006952
  misc_feature 1..69: note = hyper
  source 1..69: mol_type = genomic DNA
tgcctcccgcctccagcctccagccgggctgagcggccacttacctatttgcaccgcgaggatcagtga

SEQ ID NO: 51066 - DNA, 344 bp, Homo sapiens
  misc_feature 1..344: note = chr6:6007249-6007593
  misc_feature 1..344: note = hyper
  source 1..344: mol_type = genomic DNA
acagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcacc

SEQ ID NO: 51067 - DNA, 172 bp, Homo sapiens
  misc_feature 1..172: note = chr6:6008277-6008449
  misc_feature 1..172: note = hyper
  source 1..172: mol_type = genomic DNA
ctgcactgtcttttgatgctcaggcacagaccctgtgtaggtgtagcctaccctgcaacaaaatacttctgcagctggctttgtgctaggtgcaagctgctatcgacgacagcttgagtcaaaaccgaaaaactaacagggctatttcctttctaaacgcctttaagctctg

SEQ ID NO: 51068 - DNA, 294 bp, Homo sapiens; identical to SEQ ID NO: 30270
  misc_feature 1..294: note = chr6:6009258-6009552
  misc_feature 1..294: note = hyper
  source 1..294: mol_type = genomic DNA

SEQ ID NO: 51069 - DNA, 676 bp, Homo sapiens; identical to SEQ ID NO: 30271
  misc_feature 1..676: note = chr6:6546546-6547222
  misc_feature 1..676: note = hyper
  source 1..676: mol_type = genomic DNA

SEQ ID NO: 51070 - DNA, 40 bp, Homo sapiens; identical to SEQ ID NO: 30272
  misc_feature 1..40: note = chr6:7051798-7051838
  misc_feature 1..40: note = hyper
  source 1..40: mol_type = genomic DNA

SEQ ID NO: 51071 - skipped

SEQ ID NO: 51072 - DNA, 26 bp, Homo sapiens
  misc_feature 1..26: note = chr6:7726308-7726334
  misc_feature 1..26: note = hyper
  source 1..26: mol_type = genomic DNA
ggtacctgagccgggcgcgcagcaga

SEQ ID NO: 51073 - DNA, 27 bp, Homo sapiens
  misc_feature 1..27: note = chr6:7726363-7726390
  misc_feature 1..27: note = hyper
  source 1..27: mol_type = genomic DNA
ggcgtggagaggcgggagaccgaattc

SEQ ID NO: 51074 - DNA, 252 bp, Homo sapiens
  misc_feature 1..252: note = chr6:7726700-7726952
  misc_feature 1..252: note = hyper
  source 1..252: mol_type = genomic DNA
gaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctcccct

SEQ ID NO: 51075 - DNA, 718 bp, Homo sapiens
  misc_feature 1..718: note = chr6:7726981-7727699
  misc_feature 1..718: note = hyper
  source 1..718: mol_type = genomic DNA
tcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagc

SEQ ID NO: 51076 - DNA, 707 bp, Homo sapiens
  misc_feature 1..707: note = chr6:7728142-7728849
  misc_feature 1..707: note = hyper
  source 1..707: mol_type = genomic DNA
tccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataa

SEQ ID NO: 51077 - DNA, 180 bp, Homo sapiens
  misc_feature 1..180: note = chr6:7728941-7729121
  misc_feature 1..180: note = hyper
  source 1..180: mol_type = genomic DNA
tgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctggg

SEQ ID NO: 51078 - DNA, 15 bp, Homo sapiens
  misc_feature 1..15: note = chr6:10113574-10113589
  misc_feature 1..15: note = hyper
  source 1..15: mol_type = genomic DNA
gccgactggggagcc

SEQ ID NO: 51079 - DNA, 55 bp, Homo sapiens; identical to SEQ ID NO: 30278
  misc_feature 1..55: note = chr6:10113619-10113674
  misc_feature 1..55: note = hyper
  source 1..55: mol_type = genomic DNA

SEQ ID NO: 51080 - DNA, 46 bp, Homo sapiens; identical to SEQ ID NO: 30281
  misc_feature 1..46: note = chr6:10382321-10382367
  misc_feature 1..46: note = hyper
  source 1..46: mol_type = genomic DNA

SEQ ID NO: 51081 - DNA, 237 bp, Homo sapiens; identical to SEQ ID NO: 30283
  misc_feature 1..237: note = chr6:10383837-10384074
  misc_feature 1..237: note = hyper
  source 1..237: mol_type = genomic DNA

SEQ ID NO: 51082 - DNA, 65 bp, Homo sapiens; identical to SEQ ID NO: 30284
  misc_feature 1..65: note = chr6:10384438-10384503
  misc_feature 1..65: note = hyper
  source 1..65: mol_type = genomic DNA

SEQ ID NO: 51083 - DNA, 271 bp, Homo sapiens
  misc_feature 1..271: note = chr6:10385939-10386210
  misc_feature 1..271: note = hyper
  source 1..271: mol_type = genomic DNA
ctcaaaaacttccctccttggtctccgcattagggaaactgaggtactgctggcatggctgtccatacgtttgctaaatcagctactccagaggcctagagaagggagggaacgccctgggttttccagaacaagacacagatctctccgtagcctaaagaaagtccttgcgccccaggtctgaaagccaaggggagcctgtgtttgctcccagcggggtcgccggccgtctccacaacccttgcttcctacaggcagaattgaatgcagg

SEQ ID NO: 51084 - DNA, 114 bp, Homo sapiens
  misc_feature 1..114: note = chr6:10389909-10390023
  misc_feature 1..114: note = hyper
  source 1..114: mol_type = genomic DNA
ctccacataagcagtcgatttctgtggtttcaaagaaaaaaaaaaaaaagatgaaacatgtcttctctttgagggtgacctttgacctttctttccaatacacctgacacaaag

SEQ ID NO: 51085 - DNA, 29 bp, Homo sapiens
  misc_feature 1..29: note = chr6:10391187-10391216
  misc_feature 1..29: note = hyper
  source 1..29: mol_type = genomic DNA
ggcccttaaaactctgacctggagcctcc

SEQ ID NO: 51086 - DNA, 132 bp, Homo sapiens; identical to SEQ ID NO: 30288
  misc_feature 1..132: note = chr6:10391324-10391456
  misc_feature 1..132: note = hyper
  source 1..132: mol_type = genomic DNA

SEQ ID NO: 51087 - DNA, 370 bp, Homo sapiens
  misc_feature 1..370: note = chr6:10410578-10410948
  misc_feature 1..370: note = hyper
  source 1..370: mol_type = genomic DNA
gcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtc

SEQ ID NO: 51088 - DNA, 103 bp, Homo sapiens
  misc_feature 1..103: note = chr6:10411253-10411356
  misc_feature 1..103: note = hyper
  source 1..103: mol_type = genomic DNA
gagagaggtgcaccccggggctgtggccccccccccccgccccttccaccccagccccaaagggcagaagaaacgcctgactttaggtttctctattgcaatt

SEQ ID NO: 51089 - DNA, 36 bp, Homo sapiens
  misc_feature 1..36: note = chr6:10411510-10411546
  misc_feature 1..36: note = hyper
  source 1..36: mol_type = genomic DNA
actcaaggaaatcaagatgaacgtggggagaaacac

SEQ ID NO: 51090 - DNA, 90 bp, Homo sapiens; identical to SEQ ID NO: 30291
  misc_feature 1..90: note = chr6:10411946-10412036
  misc_feature 1..90: note = hyper
  source 1..90: mol_type = genomic DNA

SEQ ID NO: 51091 - DNA, 310 bp, Homo sapiens; identical to SEQ ID NO: 30292
  misc_feature 1..310: note = chr6:10414201-10414511
  misc_feature 1..310: note = hyper
  source 1..310: mol_type = genomic DNA

SEQ ID NO: 51092 - DNA, 135 bp, Homo sapiens
  misc_feature 1..135: note = chr6:10414978-10415113
  misc_feature 1..135: note = hyper
  source 1..135: mol_type = genomic DNA
agaagggagcatccacgtcctctctctgcagcttctcccccgcgttcttcgggcgaatccgagggacgggcgctgcgctggggaaagtttgtcccacccgcgtttcgcagctggttgcaaggagaggaggaggag

SEQ ID NO: 51093 - DNA, 31 bp, Homo sapiens
  misc_feature 1..31: note = chr6:10415215-10415246
  misc_feature 1..31: note = hyper
  source 1..31: mol_type = genomic DNA
cattttcatggatcggcgtgaacggatatgc

SEQ ID NO: 51094 - DNA, 39 bp, Homo sapiens
  misc_feature 1..39: note = chr6:10415713-10415752
  misc_feature 1..39: note = hyper
  source 1..39: mol_type = genomic DNA
acaccccctctcttaccccaattccgccacattcccctt

SEQ ID NO: 51095 - skipped

SEQ ID NO: 51096 - DNA, 26 bp, Homo sapiens
  misc_feature 1..26: note = chr6:10419506-10419532
  misc_feature 1..26: note = hyper
  source 1..26: mol_type = genomic DNA
gctctcctgggcgctgccaggcgcgc

SEQ ID NO: 51097 - DNA, 61 bp, Homo sapiens
  misc_feature 1..61: note = chr6:10419941-10420002
  misc_feature 1..61: note = hyper
  source 1..61: mol_type = genomic DNA
cagctccagcttttcccaacagccccaacccgctttcccggtcagtccctggcccgggaac

SEQ ID NO: 51098 - DNA, 150 bp, Homo sapiens; identical to SEQ ID NO: 30300
  misc_feature 1..150: note = chr6:10420118-10420268
  misc_feature 1..150: note = hyper
  source 1..150: mol_type = genomic DNA

SEQ ID NO: 51099 - DNA, 37 bp, Homo sapiens; identical to SEQ ID NO: 30301
  misc_feature 1..37: note = chr6:10420718-10420755
  misc_feature 1..37: note = hyper
  source 1..37: mol_type = genomic DNA

SEQ ID NO: 51100 - DNA, 177 bp, Homo sapiens
  misc_feature 1..177: note = chr6:10420876-10421053
  misc_feature 1..177: note = hyper
  source 1..177: mol_type = genomic DNA
cgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaacc

SEQ ID NO: 51101 - DNA, 26 bp, Homo sapiens
  misc_feature 1..26: note = chr6:10422635-10422661
  misc_feature 1..26: note = hyper
  source 1..26: mol_type = genomic DNA
cgctgccaccacgaagcaggttcact

SEQ ID NO: 51102 - DNA, 155 bp, Homo sapiens; identical to SEQ ID NO: 30305
  misc_feature 1..155: note = chr6:10423932-10424087
  misc_feature 1..155: note = hyper
  source 1..155: mol_type = genomic DNA

SEQ ID NO: 51103 - DNA, 15 bp, Homo sapiens
  misc_feature 1..15: note = chr6:10425463-10425478
  misc_feature 1..15: note = hyper
  source 1..15: mol_type = genomic DNA
aaaaacttgagaccc

SEQ ID NO: 51104 - DNA, 183 bp, Homo sapiens
  misc_feature 1..183: note = chr6:10882057-10882240
  misc_feature 1..183: note = hyper
  source 1..183: mol_type = genomic DNA
gttctgaaaaatagaagaaaaaaggacaggtgcgccaggtgggttttttttcttctctttaaagaagaaagtggggtgtgtgaaggggaggtgcagagagagagaaagagagagaggctgtttagatatctggaagctggggacaatggttatggacccgggcggggccttgtccttggccgc

SEQ ID NO: 51105 - DNA, 47 bp, Homo sapiens; identical to SEQ ID NO: 30310
  misc_feature 1..47: note = chr6:10882241-10882288
  misc_feature 1..47: note = hyper
  source 1..47: mol_type = genomic DNA

SEQ ID NO: 51106 - DNA, 72 bp, Homo sapiens; identical to SEQ ID NO: 30312
  misc_feature 1..72: note = chr6:10883114-10883186
  misc_feature 1..72: note = hyper
  source 1..72: mol_type = genomic DNA

SEQ ID NO: 51107 - DNA, 161 bp, Homo sapiens
  misc_feature 1..161: note = chr6:10886917-10887078
  misc_feature 1..161: note = hyper
  source 1..161: mol_type = genomic DNA
attacaggcgtgagccaccgcgcctggccgcccctctggctttttaaggcggggcaaaaacttggaacagctaccacaaagcgaacgcctatctgtttggaatttcgcaaataaggaacgtttaaatgacgtagttcacatcctttgagtgctggctttct

SEQ ID NO: 51108 - DNA, 30 bp, Homo sapiens
  misc_feature 1..30: note = chr6:10887686-10887716
  misc_feature 1..30: note = hyper
  source 1..30: mol_type = genomic DNA
ctttccaccttgctgcgtagaaagtgcaga

SEQ ID NO: 51109 - DNA, 372 bp, Homo sapiens
  misc_feature 1..372: note = chr6:11043690-11044062
  misc_feature 1..372: note = hyper
  source 1..372: mol_type = genomic DNA
acacgggtgaacacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttc

SEQ ID NO: 51110 - DNA, 336 bp, Homo sapiens
  misc_feature 1..336: note = chr6:11044572-11044908
  misc_feature 1..336: note = hyper
  source 1..336: mol_type = genomic DNA
cccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaat

SEQ ID NO: 51111 - DNA, 79 bp, Homo sapiens
  misc_feature 1..79: note = chr6:12749820-12749899
  misc_feature 1..79: note = hyper
  source 1..79: mol_type = genomic DNA
ccctcctcccccttccgcctctctccctctccctccgtctccttctccctctcagctcgccgggcgaccctgctcctgc

SEQ ID NO: 51112 - DNA, 100 bp, Homo sapiens; identical to SEQ ID NO: 30319
  misc_feature 1..100: note = chr6:12750364-12750464
  misc_feature 1..100: note = hyper
  source 1..100: mol_type = genomic DNA

SEQ ID NO: 51113 - DNA, 506 bp, Homo sapiens; identical to SEQ ID NO: 30320
  misc_feature 1..506: note = chr6:13013570-13014076
  misc_feature 1..506: note = hyper
  source 1..506: mol_type = genomic DNA

SEQ ID NO: 51114 - DNA, 176 bp, Homo sapiens; identical to SEQ ID NO: 30321
  misc_feature 1..176: note = chr6:13488419-13488595
  misc_feature 1..176: note = hyper
  source 1..176: mol_type = genomic DNA

SEQ ID NO: 51115 - DNA, 699 bp, Homo sapiens; identical to SEQ ID NO: 30322
  misc_feature 1..699: note = chr6:13924890-13925589
  misc_feature 1..699: note = hyper
  source 1..699: mol_type = genomic DNA

SEQ ID NO: 51116 - DNA, 30 bp, Homo sapiens; identical to SEQ ID NO: 30323
  misc_feature 1..30: note = chr6:17102273-17102303
  misc_feature 1..30: note = hyper
  source 1..30: mol_type = genomic DNA

SEQ ID NO: 51117 - DNA, 37 bp, Homo sapiens; identical to SEQ ID NO: 30324
  misc_feature 1..37: note = chr6:17281225-17281262
  misc_feature 1..37: note = hyper
  source 1..37: mol_type = genomic DNA

SEQ ID NO: 51118 - DNA, 386 bp, Homo sapiens; identical to SEQ ID NO: 30325
  misc_feature 1..386: note = chr6:18122677-18123063
  misc_feature 1..386: note = hyper
  source 1..386: mol_type = genomic DNA

SEQ ID NO: 51119 - DNA, 430 bp, Homo sapiens; identical to SEQ ID NO: 30326
  misc_feature 1..430: note = chr6:18277531-18277961
  misc_feature 1..430: note = hyper
  source 1..430: mol_type = genomic DNA

SEQ ID NO: 51120 - DNA, 64 bp, Homo sapiens; identical to SEQ ID NO: 30327
  misc_feature 1..64: note = chr6:18277979-18278043
  misc_feature 1..64: note = hyper
  source 1..64: mol_type = genomic DNA

SEQ ID NO: 51121 - DNA, 156 bp, Homo sapiens
  misc_feature 1..156: note = chr6:19691841-19691997
  misc_feature 1..156: note = hyper
  source 1..156: mol_type = genomic DNA
tgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaagggg

SEQ ID NO: 51122 - DNA, 81 bp, Homo sapiens
  misc_feature 1..81: note = chr6:21664923-21665004
  misc_feature 1..81: note = hyper
  source 1..81: mol_type = genomic DNA
gggcatctctggtcccgggatgcgattgtcccggtttctccttctggcccactcgccgcgcgcacgaactctaggggaagt

SEQ ID NO: 51123 - DNA, 126 bp, Homo sapiens
  misc_feature 1..126: note = chr6:21665043-21665169
  misc_feature 1..126: note = hyper
  source 1..126: mol_type = genomic DNA
gtgaagcgcggggcgggggaggcgaggacagaagctctcctcgcggcgtctttgttctgctctggaggagagaccttggcaaggagtcgccgggcgggtgcagggacctaccgccaccacattccg

SEQ ID NO: 51124 - DNA, 141 bp, Homo sapiens; identical to SEQ ID NO: 30331
  misc_feature 1..141: note = chr6:21665754-21665895
  misc_feature 1..141: note = hyper
  source 1..141: mol_type = genomic DNA

SEQ ID NO: 51125 - DNA, 42 bp, Homo sapiens; identical to SEQ ID NO: 30332
  misc_feature 1..42: note = chr6:21666457-21666499
  misc_feature 1..42: note = hyper
  source 1..42: mol_type = genomic DNA

SEQ ID NO: 51126 - DNA, 175 bp, Homo sapiens; identical to SEQ ID NO: 30333
  misc_feature 1..175: note = chr6:24126308-24126483
  misc_feature 1..175: note = hyper
  source 1..175: mol_type = genomic DNA

SEQ ID NO: 51127 - DNA, 15 bp, Homo sapiens
  misc_feature 1..15: note = chr6:24494664-24494679
  misc_feature 1..15: note = hyper
  source 1..15: mol_type = genomic DNA
cgcggggtcacactt

SEQ ID NO: 51128 - DNA, 106 bp, Homo sapiens
  misc_feature 1..106: note = chr6:24494766-24494872
  misc_feature 1..106: note = hyper
  source 1..106: mol_type = genomic DNA
gggcaggcaccagcgcatctatggaccgcgcacaaattccggggatgccgaatttgggggatgctaaggggagagagtgggtctctagcagcgattgggggctcag

SEQ ID NO: 51129 - DNA, 94 bp, Homo sapiens; identical to SEQ ID NO: 30335
  misc_feature 1..94: note = chr6:25652379-25652473
  misc_feature 1..94: note = hyper
  source 1..94: mol_type = genomic DNA

SEQ ID NO: 51130 - DNA, 229 bp, Homo sapiens; identical to SEQ ID NO: 30336
  misc_feature 1..229: note = chr6:26020909-26021138
  misc_feature 1..229: note = hyper
  source 1..229: mol_type = genomic DNA

SEQ ID NO: 51131 - DNA, 30 bp, Homo sapiens; identical to SEQ ID NO: 30337
  misc_feature 1..30: note = chr6:26034014-26034044
  misc_feature 1..30: note = hyper
  source 1..30: mol_type = genomic DNA

SEQ ID NO: 51132 - DNA, 90 bp, Homo sapiens; identical to SEQ ID NO: 30338
  misc_feature 1..90: note = chr6:26087615-26087705
  misc_feature 1..90: note = hyper
  source 1..90: mol_type = genomic DNA

SEQ ID NO: 51133 - DNA, 88 bp, Homo sapiens; identical to SEQ ID NO: 30339
  misc_feature 1..88: note = chr6:26088186-26088274
  misc_feature 1..88: note = hyper
  source 1..88: mol_type = genomic DNA

SEQ ID NO: 51134 - DNA, 152 bp, Homo sapiens; identical to SEQ ID NO: 30340
  misc_feature 1..152: note = chr6:26172018-26172170
  misc_feature 1..152: note = hyper
  source 1..152: mol_type = genomic DNA

SEQ ID NO: 51135 - DNA, 74 bp, Homo sapiens; identical to SEQ ID NO: 19182
  misc_feature 1..74: note = chr6:26184021-26184095
  misc_feature 1..74: note = hyper
  source 1..74: mol_type = genomic DNA

SEQ ID NO: 51136 - DNA, 195 bp, Homo sapiens; identical to SEQ ID NO: 30344
  misc_feature 1..195: note = chr6:26197272-26197467
  misc_feature 1..195: note = hyper
  source 1..195: mol_type = genomic DNA

SEQ ID NO: 51137 - DNA, 25 bp, Homo sapiens
  misc_feature 1..25: note = chr6:26198574-26198599
  misc_feature 1..25: note = hyper
  source 1..25: mol_type = genomic DNA
gttttgagacagtctcgctctgtcg

SEQ ID NO: 51138 - DNA, 85 bp, Homo sapiens; identical to SEQ ID NO: 30346
  misc_feature 1..85: note = chr6:26198839-26198924
  misc_feature 1..85: note = hyper
  source 1..85: mol_type = genomic DNA

SEQ ID NO: 51139 - DNA, 450 bp, Homo sapiens; identical to SEQ ID NO: 30347
  misc_feature 1..450: note = chr6:26199182-26199632
  misc_feature 1..450: note = hyper
  source 1..450: mol_type = genomic DNA

SEQ ID NO: 51140 - DNA, 40 bp, Homo sapiens; identical to SEQ ID NO: 30348
  misc_feature 1..40: note = chr6:26199835-26199875
  misc_feature 1..40: note = hyper
  source 1..40: mol_type = genomic DNA

SEQ ID NO: 51141 - DNA, 39 bp, Homo sapiens; identical to SEQ ID NO: 30349
  misc_feature 1..39: note = chr6:26200115-26200154
  misc_feature 1..39: note = hyper
  source 1..39: mol_type = genomic DNA

SEQ ID NO: 51142 - DNA, 613 bp, Homo sapiens; identical to SEQ ID NO: 30350
  misc_feature 1..613: note = chr6:26204685-26205298
  misc_feature 1..613: note = hyper
  source 1..613: mol_type = genomic DNA

SEQ ID NO: 51143 - DNA, 210 bp, Homo sapiens; identical to SEQ ID NO: 30351
  misc_feature 1..210: note = chr6:26205502-26205712
  misc_feature 1..210: note = hyper
  source 1..210: mol_type = genomic DNA

SEQ ID NO: 51144 - DNA, 24 bp, Homo sapiens
  misc_feature 1..24: note = chr6:26216371-26216395
  misc_feature 1..24: note = hyper
  source 1..24: mol_type = genomic DNA
ttacaaaatcggaaaaattattcc

SEQ ID NO: 51145 - DNA, 99 bp, Homo sapiens; identical to SEQ ID NO: 30353
  misc_feature 1..99: note = chr6:26216596-26216695
  misc_feature 1..99: note = hyper
  source 1..99: mol_type = genomic DNA

SEQ ID NO: 51146 - DNA, 98 bp, Homo sapiens; identical to SEQ ID NO: 30354
  misc_feature 1..98: note = chr6:26216755-26216853
  misc_feature 1..98: note = hyper
  source 1..98: mol_type = genomic DNA

SEQ ID NO: 51147 - DNA, 30 bp, Homo sapiens; identical to SEQ ID NO: 30355
  misc_feature 1..30: note = chr6:26217548-26217578
  misc_feature 1..30: note = hyper
  source 1..30: mol_type = genomic DNA

SEQ ID NO: 51148 - DNA, 754 bp, Homo sapiens; identical to SEQ ID NO: 30356
  misc_feature 1..754: note = chr6:26233978-26234732
  misc_feature 1..754: note = hyper
  source 1..754: mol_type = genomic DNA

SEQ ID NO: 51149 - DNA, 191 bp, Homo sapiens; identical to SEQ ID NO: 30357
  misc_feature 1..191: note = chr6:26234942-26235133
  misc_feature 1..191: note = hyper
  source 1..191: mol_type = genomic DNA

SEQ ID NO: 51150 - DNA, 151 bp, Homo sapiens
  misc_feature 1..151: note = chr6:26241118-26241269
  misc_feature 1..151: note = hyper
  source 1..151: mol_type = genomic DNA
gatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgtt

SEQ ID NO: 51151 - DNA, 41 bp, Homo sapiens; identical to SEQ ID NO: 30359
  misc_feature 1..41: note = chr6:26249960-26250001
  misc_feature 1..41: note = hyper
  source 1..41: mol_type = genomic DNA

SEQ ID NO: 51152 - DNA, 287 bp, Homo sapiens
  misc_feature 1..287: note = chr6:26250181-26250468
  misc_feature 1..287: note = hyper
  source 1..287: mol_type = genomic DNA
cgggctcccacagtactgggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttg

SEQ ID NO: 51153 - DNA, 228 bp, Homo sapiens
  misc_feature 1..228: note = chr6:26250826-26251054
  misc_feature 1..228: note = hyper
  source 1..228: mol_type = genomic DNA
gtgccataggaatgggtttcaagcaatggtcacaactgaacaaacagttgttcttactcctatttataaaggcaaagtccttctgattggtccgaatcttccagtttcgcgccctgaattatgtagtgtgataggacttgtgatcagctactaggtctcattttagaaaatcttaacctatctaaatgcttttttcccctagttccttacattttattatgttttatg

SEQ ID NO: 51154 - DNA, 276 bp, Homo sapiens
  misc_feature 1..276: note = chr6:26251540-26251816
  misc_feature 1..276: note = hyper
  source 1..276: mol_type = genomic DNA
tagaaacataatatccgtctttgtttctgtttaaattctcacctaaggagacagaacttataggtagatgttactggcaaggcattagtttttctaatgttttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaa

SEQ ID NO: 51155 - DNA, 29 bp, Homo sapiens
  misc_feature 1..29: note = chr6:26252151-26252180
  misc_feature 1..29: note = hyper
  source 1..29: mol_type = genomic DNA
tccagggagatccagacagccgtgcgcct

SEQ ID NO: 51156 - DNA, 39 bp, Homo sapiens; identical to SEQ ID NO: 30365
  misc_feature 1..39: note = chr6:26252240-26252279
  misc_feature 1..39: note = hyper
  source 1..39: mol_type = genomic DNA

SEQ ID NO: 51157 - DNA, 35 bp, Homo sapiens; identical to SEQ ID NO: 19194
  misc_feature 1..35: note = chr6:26271371-26271406
  misc_feature 1..35: note = hyper
  source 1..35: mol_type = genomic DNA

SEQ ID NO: 51158 - DNA, 54 bp, Homo sapiens
  misc_feature 1..54: note = chr6:26271762-26271816
  misc_feature 1..54: note = hyper
  source 1..54: mol_type = genomic DNA
attactggaaaatctgattggatgaatcacttcatttttgaatcctctcttctc

SEQ ID NO: 51159 - DNA, 24 bp, Homo sapiens
  misc_feature 1..24: note = chr6:26271817-26271841
  misc_feature 1..24: note = hyper
  source 1..24: mol_type = genomic DNA
gttagtctgcgatccaagaacgtt

SEQ ID NO: 51160 - DNA, 46 bp, Homo sapiens; identical to SEQ ID NO: 30368
  misc_feature 1..46: note = chr6:26272059-26272105
  misc_feature 1..46: note = hyper
  source 1..46: mol_type = genomic DNA

SEQ ID NO: 51161 - DNA, 81 bp, Homo sapiens
  misc_feature 1..81: note = chr6:26272431-26272512
  misc_feature 1..81: note = hyper
  source 1..81: mol_type = genomic DNA
gacagggcaacagcacggcctgaatattgggcaggacaccgccctgcgcgatagtaactttgcccaacagcttgttgagct

SEQ ID NO: 51162 - DNA, 236 bp, Homo sapiens
  misc_feature 1..236: note = chr6:26272617-26272853
  misc_feature 1..236: note = hyper
  source 1..236: mol_type = genomic DNA
gcaccgcctccaggtacaccggcgcaccggcccggacccgcttggcgtagttgcccttgcggaggaggcggtgcactcggcccacagaaaactggagaccagccctggaagagtgcgttttagccttggcgcgagctttgctgccctgcattccacatccagacgcagtgaagtatttaaatacttgtttagaagaaggaaagtgattgattctagtaaaacgcaagagctaaact

SEQ ID NO: 51163 - DNA, 159 bp, Homo sapiens; identical to SEQ ID NO: 8394
  misc_feature 1..159: note = chr6:26273111-26273270
  misc_feature 1..159: note = hyper
  source 1..159: mol_type = genomic DNA

SEQ ID NO: 51164 - DNA, 180 bp, Homo sapiens; identical to SEQ ID NO: 8395
  misc_feature 1..180: note = chr6:26273570-26273750
  misc_feature 1..180: note = hyper
  source 1..180: mol_type = genomic DNA

SEQ ID NO: 51165 - DNA, 120 bp, Homo sapiens; identical to SEQ ID NO: 30372
  misc_feature 1..120: note = chr6:26322568-26322688
  misc_feature 1..120: note = hyper
  source 1..120: mol_type = genomic DNA

SEQ ID NO: 51166 - DNA, 108 bp, Homo sapiens; identical to SEQ ID NO: 30375
  misc_feature 1..108: note = chr6:26331703-26331811
  misc_feature 1..108: note = hyper
  source 1..108: mol_type = genomic DNA

SEQ ID NO: 51167 - DNA, 44 bp, Homo sapiens
  misc_feature 1..44: note = chr6:26332134-26332178
  misc_feature 1..44: note = hyper
  source 1..44: mol_type = genomic DNA
ggtgagttttaaattcgtttccaaagttcactgcaggtcacaac

SEQ ID NO: 51168 - DNA, 48 bp, Homo sapiens
  misc_feature 1..48: note = chr6:26332218-26332266
  misc_feature 1..48: note = hyper
  source 1..48: mol_type = genomic DNA
tgtttgtgctgcatcttttctgagagataacggcgcctccctgtagcc

SEQ ID NO: 51169 - DNA, 227 bp, Homo sapiens
  misc_feature 1..227: note = chr6:26550767-26550994
  misc_feature 1..227: note = hyper
  source 1..227: mol_type = genomic DNA
atggcctggaagagccgtactctggatacccgagggcgcggccccagcgccgcgacgccccgcccctctggctgctccgctctgggatgcacttccgacgccctctaggcttgggagttccgcgcctctcggtgtcgcctggggggcgtgctccggttggcgcactgattcccagttgggtaggggaggcttgactgagctcccacccggaatttcaccttagacct

SEQ ID NO: 51170 - DNA, 25 bp, Homo sapiens
  misc_feature 1..25: note = chr6:26551034-26551059
  misc_feature 1..25: note = hyper
  source 1..25: mol_type = genomic DNA
ctagtcctctttagtggagttccgg

SEQ ID NO: 51171 - DNA, 46 bp, Homo sapiens; identical to SEQ ID NO: 30379
  misc_feature 1..46: note = chr6:26551083-26551129
  misc_feature 1..46: note = hyper
  source 1..46: mol_type = genomic DNA

SEQ ID NO: 51172 - DNA, 27 bp, Homo sapiens
  misc_feature 1..27: note = chr6:26577131-26577158
  misc_feature 1..27: note = hyper
  source 1..27: mol_type = genomic DNA
tacacagaatacttccggtgtatgaga

SEQ ID NO: 51173 - DNA, 166 bp, Homo sapiens; identical to SEQ ID NO: 8404
  misc_feature 1..166: note = chr6:26577722-26577888
  misc_feature 1..166: note = hyper
  source 1..166: mol_type = genomic DNA

SEQ ID NO: 51174 - DNA, 97 bp, Homo sapiens
  misc_feature 1..97: note = chr6:27059686-27059783
  misc_feature 1..97: note = hyper
  source 1..97: mol_type = genomic DNA
aattgtctaagcaggcgagtactgaatccggacttcttctaagggcagacaccggaatgttgatgcggctgcagctgcgctctcccacctctgtctg

SEQ ID NO: 51175 - DNA, 51 bp, Homo sapiens
  misc_feature 1..51: note = chr6:27059848-27059899
  misc_feature 1..51: note = hyper
  source 1..51: mol_type = genomic DNA
ccgagtgctggaggggaaacgtgagttgcagtcaaccggttatcttcctct

SEQ ID NO: 51176 - DNA, 54 bp, Homo sapiens
  misc_feature 1..54: note = chr6:27064628-27064682
  misc_feature 1..54: note = hyper
  source 1..54: mol_type = genomic DNA
cgactccggtgtgaacggttttgggaacctcggtctcctgctggctcccaggtg

SEQ ID NO: 51177 - DNA, 70 bp, Homo sapiens; identical to SEQ ID NO: 19205
  misc_feature 1..70: note = chr6:27065198-27065268
  misc_feature 1..70: note = hyper
  source 1..70: mol_type = genomic DNA

SEQ ID NO: 51178 - DNA, 49 bp, Homo sapiens; identical to SEQ ID NO: 30386
  misc_feature 1..49: note = chr6:27094912-27094961
  misc_feature 1..49: note = hyper
  source 1..49: mol_type = genomic DNA

SEQ ID NO: 51179 - DNA, 84 bp, Homo sapiens; identical to SEQ ID NO: 30387
  misc_feature 1..84: note = chr6:27100309-27100393
  misc_feature 1..84: note = hyper
  source 1..84: mol_type = genomic DNA

SEQ ID NO: 51180 - DNA, 600 bp, Homo sapiens; identical to SEQ ID NO: 30388
  misc_feature 1..600: note = chr6:27100453-27101053
  misc_feature 1..600: note = hyper
  source 1..600: mol_type = genomic DNA

SEQ ID NO: 51181 - DNA, 24 bp, Homo sapiens
  misc_feature 1..24: note = chr6:27101113-27101137
  misc_feature 1..24: note = hyper
  source 1..24: mol_type = genomic DNA
ccgcaacgacgaggagctcaacaa

SEQ ID NO: 51182 - DNA, 20 bp, Homo sapiens
  misc_feature 1..20: note = chr6:27173508-27173528
  misc_feature 1..20: note = hyper
  source 1..20: mol_type = genomic DNA
aagagatgaattgcccggct

SEQ ID NO: 51183 - DNA, 91 bp, Homo sapiens
  misc_feature 1..91: note = chr6:27182899-27182990
  misc_feature 1..91: note = hyper
  source 1..91: mol_type = genomic DNA
tagataatcgacagacgcagactgagtggccagtagtcaaaagcgcaaccgagggccagtggcgcaatggataacgcgtctgactacggat

SEQ ID NO: 51184 - DNA, 62 bp, Homo sapiens
  misc_feature 1..62: note = chr6:27203207-27203269
  misc_feature 1..62: note = hyper
  source 1..62: mol_type = genomic DNA
aaagatataccctgacggaacggataaatttaaagttcattttaactaattcaaaactgaaa

SEQ ID NO: 51185 - DNA, 230 bp, Homo sapiens
  misc_feature 1..230: note = chr6:27205441-27205671
  misc_feature 1..230: note = hyper
  source 1..230: mol_type = genomic DNA
ctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctcc

SEQ ID NO: 51186 - DNA, 217 bp, Homo sapiens
  misc_feature 1..217: note = chr6:27206040-27206257
  misc_feature 1..217: note = hyper
  source 1..217: mol_type = genomic DNA
tgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtc

SEQ ID NO: 51187 - skipped

SEQ ID NO: 51188 - DNA, 64 bp, Homo sapiens; identical to SEQ ID NO: 19208
  misc_feature 1..64: note = chr6:27228395-27228459
  misc_feature 1..64: note = hyper
  source 1..64: mol_type = genomic DNA

SEQ ID NO: 51189 - DNA, 197 bp, Homo sapiens; identical to SEQ ID NO: 30398
  misc_feature 1..197: note = chr6:27242926-27243123
  misc_feature 1..197: note = hyper
  source 1..197: mol_type = genomic DNA

SEQ ID NO: 51190 - DNA, 16 bp, Homo sapiens
  misc_feature 1..16: note = chr6:27247620-27247636
  misc_feature 1..16: note = hyper
  source 1..16: mol_type = genomic DNA
ctggcccagtgctccc

SEQ ID NO: 51191 - DNA, 15 bp, Homo sapiens
  misc_feature 1..15: note = chr6:27247724-27247739
  misc_feature 1..15: note = hyper
  source 1..15: mol_type = genomic DNA
cgaaccaagtccttg

SEQ ID NO: 51192 - DNA, 56 bp, Homo sapiens; identical to SEQ ID NO: 30400
  misc_feature 1..56: note = chr6:27248054-27248110
  misc_feature 1..56: note = hyper
  source 1..56: mol_type = genomic DNA

SEQ ID NO: 51193 - DNA, 155 bp, Homo sapiens
  misc_feature 1..155: note = chr6:27255942-27256097
  misc_feature 1..155: note = hyper
  source 1..155: mol_type = genomic DNA
tgctttccttcgccgcggttgcggccgcgaccctgttcttaccaccagcaattcctccagggacttggtcagcagcccaacttgatctgcgtctctctgctaaggtgtttccgcaacagggtcaactccaagtctcacctttctaggaatcccgg

SEQ ID NO: 51194 - DNA, 210 bp, Homo sapiens
  misc_feature 1..210: note = chr6:27256173-27256383
  misc_feature 1..210: note = hyper
  source 1..210: mol_type = genomic DNA
agagattgtcagttatccaactgtcaatagagccgccgctccagcgagtttaatttaggcacagaaaagtcctgcctgggttgaggtgggcttaggatgagtttacttgagtgtgtgatttagaaatagatctatgggacagacagacacgaaatcgggcattggggccctcgcaggcagggtatctagactggcagctgccggtgcagg

SEQ ID NO: 51195 - DNA, 27 bp, Homo sapiens
  misc_feature 1..27: note = chr6:27256420-27256447
  misc_feature 1..27: note = hyper
  source 1..27: mol_type = genomic DNA
tggggacgaagacgtcctggttgcaag

SEQ ID NO: 51196 - DNA, 320 bp, Homo sapiens; identical to SEQ ID NO: 30402
  misc_feature 1..320: note = chr6:27258104-27258424
  misc_feature 1..320: note = hyper
  source 1..320: mol_type = genomic DNA

SEQ ID NO: 51197 - DNA, 50 bp, Homo sapiens; identical to SEQ ID NO: 19213
  misc_feature 1..50: note = chr6:27279795-27279845
  misc_feature 1..50: note = hyper
  source 1..50: mol_type = genomic DNA

SEQ ID NO: 51198 - DNA, 774 bp, Homo sapiens
  misc_feature 1..774: note = chr6:27280012-27280786
  misc_feature 1..774: note = hyper
  source 1..774: mol_type = genomic DNA
ctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcaggactggagatctggaccggtggctgtgccgcccggatggcatttgtggcactagcagtcgggaaagcagctgattgaggatttccgcgtttctctttttttgcagatcgtgacgccgccagtaggtgtcagtcatttgccgcacagccacctttgagatccacctgtgtctcccagcggccgaatccaggtttccttcctattcgcacttggagaactcatgcagattgccgtcaggagtggcctcagagatccggagtgggcgaatg

SEQ ID NO: 51199 - DNA, 328 bp, Homo sapiens; identical to SEQ ID NO: 30404
  misc_feature 1..328: note = chr6:27342701-27343029
  misc_feature 1..328: note = hyper
  source 1..328: mol_type = genomic DNA

SEQ ID NO: 51200 - DNA, 66 bp, Homo sapiens; identical to SEQ ID NO: 30405
  misc_feature 1..66: note = chr6:27356988-27357054
  misc_feature 1..66: note = hyper
  source 1..66: mol_type = genomic DNA

SEQ ID NO: 51201 - DNA, 33 bp, Homo sapiens; identical to SEQ ID NO: 8419
  misc_feature 1..33: note = chr6:27471362-27471395
  misc_feature 1..33: note = hyper
  source 1..33: mol_type = genomic DNA

SEQ ID NO: 51202 - skipped

SEQ ID NO: 51203 - DNA, 36 bp, Homo sapiens; identical to SEQ ID NO: 19216
  misc_feature 1..36: note = chr6:27534341-27534377
  misc_feature 1..36: note = hyper
  source 1..36: mol_type = genomic DNA

SEQ ID NO: 51204 - DNA, 32 bp, Homo sapiens; identical to SEQ ID NO: 30411
  misc_feature 1..32: note = chr6:27551251-27551283
  misc_feature 1..32: note = hyper
  source 1..32: mol_type = genomic DNA

SEQ ID NO: 51205 - DNA, 288 bp, Homo sapiens
  misc_feature 1..288: note = chr6:27572883-27573171
  misc_feature 1..288: note = hyper
  source 1..288: mol_type = genomic DNA
gactgatcagttgaacggctaaggaaaagaactgggtgttaccgtcgttgctagagcggtgtgagtttacgacagttgctggtcagatcaatgtccgactcccctttcagagagacagacgatatacaggaatctggaacattcctacagggctctctgagaacggagacctttttctcgtgccttttttcttttcttttctttttttgtttgtttaatttttatgttagcggattcacagaccaatagatggaaatccgctgcttactttctcgcaggagaaaatga

SEQ ID NO: 51206 - DNA, 223 bp, Homo sapiens
  misc_feature 1..223: note = chr6:27573392-27573615
  misc_feature 1..223: note = hyper
  source 1..223: mol_type = genomic DNA
agggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaatcccagccgcaaaagttctctc

SEQ ID NO: 51207 - DNA, 53 bp, Homo sapiens; identical to SEQ ID NO: 30414
  misc_feature 1..53: note = chr6:27585093-27585146
  misc_feature 1..53: note = hyper
  source 1..53: mol_type = genomic DNA

SEQ ID NO: 51208 - DNA, 66 bp, Homo sapiens; identical to SEQ ID NO: 19219
  misc_feature 1..66: note = chr6:27598672-27598738
  misc_feature 1..66: note = hyper
  source 1..66: mol_type = genomic DNA

SEQ ID NO: 51209 - DNA, 20 bp, Homo sapiens
  misc_feature 1..20: note = chr6:27635245-27635265
  misc_feature 1..20: note = hyper
  source 1..20: mol_type = genomic DNA
aagaatgaaaaacatcgaag

SEQ ID NO: 51210 - DNA, 29 bp, Homo sapiens
  misc_feature 1..29: note = chr6:27635434-27635463
  misc_feature 1..29: note = hyper
  source 1..29: mol_type = genomic DNA
aagttccaaaaacacgaaggaaaccccag

SEQ ID NO: 51211 - DNA, 211 bp, Homo sapiens; identical to SEQ ID NO: 30418
  misc_feature 1..211: note = chr6:27635858-27636069
  misc_feature 1..211: note = hyper
  source 1..211: mol_type = genomic DNA

SEQ ID NO: 51212 - DNA, 161 bp, Homo sapiens; identical to SEQ ID NO: 30419
  misc_feature 1..161: note = chr6:27636349-27636510
  misc_feature 1..161: note = hyper
  source 1..161: mol_type = genomic DNA

SEQ ID NO: 51213 - DNA, 195 bp, Homo sapiens
  misc_feature 1..195: note = chr6:27647517-27647712
  misc_feature 1..195: note = hyper
  source 1..195: mol_type = genomic DNA
gtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagtt

SEQ ID NO: 51214 - DNA, 351 bp, Homo sapiens
  misc_feature 1..351: note = chr6:27647896-27648247
  misc_feature 1..351: note = hyper
  source 1..351: mol_type = genomic DNA
gagctgaacgctcattgctgagtcctgggagaaggtcgcgtttgtacagaaggctcctggcagcgagcaaggccgggagtgggcccagtgcgcacgaagtcgcgccccgaattcccactgggaggaacgcactggaattgaaatgtctgagatcaagccccgctgagaatcaagtcccagaggatcttctcggctggtggaaacgtggaggggaaaggcggtcacgaaaattgaagtctcctagtccaatacagattatccaggccgttgacggcaggaatatatttttatttattcctttacccttctctcctcacagctcttccttctcgtccacgcttgatgggtttt

SEQ ID NO: 51215 - DNA, 76 bp, Homo sapiens; identical to SEQ ID NO: 30422
  misc_feature 1..76: note = chr6:27648814-27648890
  misc_feature 1..76: note = hyper
  source 1..76: mol_type = genomic DNA

SEQ ID NO: 51216 - DNA, 280 bp, Homo sapiens; identical to SEQ ID NO: 30424
  misc_feature 1..280: note = chr6:27661759-27662039
  misc_feature 1..280: note = hyper
  source 1..280: mol_type = genomic DNA

SEQ ID NO: 51217 - DNA, 331 bp, Homo sapiens; identical to SEQ ID NO: 30425
  misc_feature 1..331: note = chr6:27774914-27775245
  misc_feature 1..331: note = hyper
  source 1..331: mol_type = genomic DNA

SEQ ID NO: 51218 - DNA, 441 bp, Homo sapiens; identical to SEQ ID NO: 30426
  misc_feature 1..441: note = chr6:27777715-27778156
  misc_feature 1..441: note = hyper
  source 1..441: mol_type = genomic DNA

SEQ ID NO: 51219 - DNA, 206 bp, Homo sapiens; identical to SEQ ID NO: 30427
  misc_feature 1..206: note = chr6:27782436-27782642
  misc_feature 1..206: note = hyper
  source 1..206: mol_type = genomic DNA

SEQ ID NO: 51220 - DNA, 213 bp, Homo sapiens; identical to SEQ ID NO: 30428
  misc_feature 1..213: note = chr6:27833079-27833292
  misc_feature 1..213: note = hyper
  source 1..213: mol_type = genomic DNA

SEQ ID NO: 51221 - DNA, 279 bp, Homo sapiens; identical to SEQ ID NO: 30429
  misc_feature 1..279: note = chr6:27834035-27834314
  misc_feature 1..279: note = hyper
  source 1..279: mol_type = genomic DNA

SEQ ID NO: 51222 - DNA, 28 bp, Homo sapiens
  misc_feature 1..28: note = chr6:27834835-27834863
  misc_feature 1..28: note = hyper
  source 1..28: mol_type = genomic DNA
tcttcggagtcttcttcactgccttttt

SEQ ID NO: 51223 - DNA, 143 bp, Homo sapiens
  misc_feature 1..143: note = chr6:27834904-27835047
  misc_feature 1..143: note = hyper
  source 1..143: mol_type = genomic DNA
cgggcttcttagctttagcggcgcctgccttcttggctttgggcttggcttccccggaggccgccttcttgttgagtttaaaggagccagaagcaccagtgcccttggtctgcaccagggtgcccttgctcaccaagctcttg

SEQ ID NO: 51224 - DNA, 43 bp, Homo sapiens
  misc_feature 1..43: note = chr6:27839683-27839726
  misc_feature 1..43: note = hyper
  source 1..43: mol_type = genomic DNA
tatgccctctcccctcggatgcggcgcgcaagctggatgtctt

SEQ ID NO: 51225 - DNA, 461 bp, Homo sapiens; identical to SEQ ID NO: 19230
  misc_feature 1..461: note = chr6:27840082-27840543
  misc_feature 1..461: note = hyper
  source 1..461: mol_type = genomic DNA

SEQ ID NO: 51226 - DNA, 107 bp, Homo sapiens; identical to SEQ ID NO: 30434
  misc_feature 1..107: note = chr6:27841143-27841250
  misc_feature 1..107: note = hyper
  source 1..107: mol_type = genomic DNA

SEQ ID NO: 51227 - DNA, 211 bp, Homo sapiens
  misc_feature 1..211: note = chr6:27858304-27858515
  misc_feature 1..211: note = hyper
  source 1..211: mol_type = genomic DNA
gccgagctctggaaacgaaggtcggttttgaaatcctgcgcgatttctcgcaccaggcgctgaaatggcagtttgcggatgagcagctcagtcgacttctgataacggcggatctcacgcaaggccacggtgcctggcctgtagcggtggggcttcttcacaccgccagtcgctggagcgcttttgcgcgctgccttggtggccagctgct

SEQ ID NO: 51228 - DNA, 67 bp, Homo sapiens
  misc_feature 1..67: note = chr6:27858637-27858704
  misc_feature 1..67: note = hyper
  source 1..67: mol_type = genomic DNA
gatgatctgatcctgattggtcagaactgttgtaggaaaaacctggttggttgttaatactatcttc

SEQ ID NO: 51229 - DNA, 96 bp, Homo sapiens; identical to SEQ ID NO: 30436
  misc_feature 1..96: note = chr6:28129482-28129578
  misc_feature 1..96: note = hyper
  source 1..96: mol_type = genomic DNA

SEQ ID NO: 51230 - DNA, 70 bp, Homo sapiens; identical to SEQ ID NO: 19232
  misc_feature 1..70: note = chr6:28176212-28176282
  misc_feature 1..70: note = hyper
  source 1..70: mol_type = genomic DNA

SEQ ID NO: 51231 - DNA, 170 bp, Homo sapiens; identical to SEQ ID NO: 30438
  misc_feature 1..170: note = chr6:28249409-28249579
  misc_feature 1..170: note = hyper
  source 1..170: mol_type = genomic DNA

SEQ ID NO: 51232 - DNA, 38 bp, Homo sapiens; identical to SEQ ID NO: 30439
  misc_feature 1..38: note = chr6:28303451-28303489
  misc_feature 1..38: note = hyper
  source 1..38: mol_type = genomic DNA

SEQ ID NO: 51233 - DNA, 30 bp, Homo sapiens; identical to SEQ ID NO: 30441
  misc_feature 1..30: note = chr6:28304271-28304301
  misc_feature 1..30: note = hyper
  source 1..30: mol_type = genomic DNA

SEQ ID NO: 51234 - DNA, 55 bp, Homo sapiens; identical to SEQ ID NO: 19233
  misc_feature 1..55: note = chr6:28367054-28367109
  misc_feature 1..55: note = hyper
  source 1..55: mol_type = genomic DNA

SEQ ID NO: 51235 - DNA, 104 bp, Homo sapiens
  misc_feature 1..104: note = chr6:28367774-28367878
  misc_feature 1..104: note = hyper
  source 1..104: mol_type = genomic DNA
tgatcttaagacagggaaatcccttgcgtctccattcactttgggattctgtgtctctgaggttagagatgcctcaaagggatgttctccgggggaccttccca

SEQ ID NO: 51236 - DNA, 87 bp, Homo sapiens
  misc_feature 1..87: note = chr6:28410889-28410976
  misc_feature 1..87: note = hyper
  source 1..87: mol_type = genomic DNA
cctaagatgcagatacggagagttcagagtgccatcagtacagggcagagaggttgaagagctcaggaacagacatagggtggggga

SEQ ID NO: 51237 - DNA, 140 bp, Homo sapiens
  misc_feature 1..140: note = chr6:28411353-28411493
  misc_feature 1..140: note = hyper
  source 1..140: mol_type = genomic DNA
ctctgtggtcgtcactctgaatcccgtctgtagtcttaagtgagatactaggtgacacattgtcttccacgcggcaatataataacggccaacatagtgttttaacacgtattaattcattaccccgcataacaaccctg

SEQ ID NO: 51238 - DNA, 35 bp, Homo sapiens
  misc_feature 1..35: note = chr6:28414942-28414977
  misc_feature 1..35: note = hyper
  source 1..35: mol_type = genomic DNA
atccagcattgcagccgccgcggcggtctaagagc

SEQ ID NO: 51239 - DNA, 118 bp, Homo sapiens; identical to SEQ ID NO: 30450
  misc_feature 1..118: note = chr6:28415091-28415209
  misc_feature 1..118: note = hyper
  source 1..118: mol_type = genomic DNA

SEQ ID NO: 51240 - DNA, 36 bp, Homo sapiens
  misc_feature 1..36: note = chr6:28457572-28457608
  misc_feature 1..36: note = hyper
  source 1..36: mol_type = genomic DNA
ttctcctctgtaacccgtccttccacgtcccggtgg

SEQ ID NO: 51241 - DNA, 223 bp, Homo sapiens
  misc_feature 1..223: note = chr6:28457638-28457861
  misc_feature 1..223: note = hyper
  source 1..223: mol_type = genomic DNA
cggggacctgcaaggagccccgcccgcaggctttgaaccgatttcggctccgcgtccaggagcaggccctacgtagggccgggggaattcaggtgcgtctgcggggcccagggcacccagggcaggcggggactgagacgactgagggttgagggacaaggaggttgggactggggaggggagacccgggacccgcccagaacgctttcgtggggttggagag

SEQ ID NO: 51242 - DNA, 34 bp, Homo sapiens
  misc_feature 1..34: note = chr6:28458158-28458192
  misc_feature 1..34: note = hyper
  source 1..34: mol_type = genomic DNA
tgagacgtcaactaagcgccgtttcagtcccaga

SEQ ID NO: 51243 - DNA, 119 bp, Homo sapiens; identical to SEQ ID NO: 30453
  misc_feature 1..119: note = chr6:32632538-32632657
  misc_feature 1..119: note = hyper
  source 1..119: mol_type = genomic DNA

SEQ ID NO: 51244 - DNA, 128 bp, Homo sapiens; identical to SEQ ID NO: 30454
  misc_feature 1..128: note = chr6:34110456-34110584
  misc_feature 1..128: note = hyper
  source 1..128: mol_type = genomic DNA

SEQ ID NO: 51245 - DNA, 87 bp, Homo sapiens; identical to SEQ ID NO: 30455
  misc_feature 1..87: note = chr6:34111685-34111772
  misc_feature 1..87: note = hyper
  source 1..87: mol_type = genomic DNA

SEQ ID NO: 51246 - DNA, 1141 bp, Homo sapiens; identical to SEQ ID NO: 30456
  misc_feature 1..1141: note = chr6:34112299-34113440
  misc_feature 1..1141: note = hyper
  source 1..1141: mol_type = genomic DNA

SEQ ID NO: 51247 - DNA, 80 bp, Homo sapiens; identical to SEQ ID NO: 30457
  misc_feature 1..80: note = chr6:34119186-34119266
  misc_feature 1..80: note = hyper
  source 1..80: mol_type = genomic DNA

SEQ ID NO: 51248 - DNA, 527 bp, Homo sapiens; identical to SEQ ID NO: 30458
  misc_feature 1..527: note = chr6:34433517-34434044
  misc_feature 1..527: note = hyper
  source 1..527: mol_type = genomic DNA

SEQ ID NO: 51249 - DNA, 144 bp, Homo sapiens; identical to SEQ ID NO: 30459
  misc_feature 1..144: note = chr6:35181280-35181424
  misc_feature 1..144: note = hyper
  source 1..144: mol_type = genomic DNA

SEQ ID NO: 51250 - DNA, 58 bp, Homo sapiens; identical to SEQ ID NO: 30460
  misc_feature 1..58: note = chr6:35466126-35466184
  misc_feature 1..58: note = hyper
  source 1..58: mol_type = genomic DNA

SEQ ID NO: 51251 - DNA, 19 bp, Homo sapiens
  misc_feature 1..19: note = chr6:35992409-35992428
  misc_feature 1..19: note = hyper
  source 1..19: mol_type = genomic DNA
gggcgggctgaggagatga

SEQ ID NO: 51252 - DNA, 57 bp, Homo sapiens; identical to SEQ ID NO: 30462
  misc_feature 1..57: note = chr6:36088966-36089023
  misc_feature 1..57: note = hyper
  source 1..57: mol_type = genomic DNA

SEQ ID NO: 51253 - DNA, 118 bp, Homo sapiens
  misc_feature 1..118: note = chr6:36252866-36252984
  misc_feature 1..118: note = hyper
  source 1..118: mol_type = genomic DNA
taacaattattattacgttggggtagggtattcaagatatacccacaggaaaatgcagattacaattcagtctgcaattagggaccagatagcagccaactctcaggtgatccatgca

SEQ ID NO: 51254 - DNA, 165 bp, Homo sapiens; identical to SEQ ID NO: 30464
  misc_feature 1..165: note = chr6:36806918-36807083
  misc_feature 1..165: note = hyper
  source 1..165: mol_type = genomic DNA

SEQ ID NO: 51255 - DNA, 147 bp, Homo sapiens
  misc_feature 1..147: note = chr6:36808176-36808323
  misc_feature 1..147: note = hyper
  source 1..147: mol_type = genomic DNA
tctctgctgagtgtgcgccctactcgggggcgggtctcagttcagaaacagaccctacatctccttctggggaggtgtgtgggggcgaccccagtgccaggagggactacctcggtttcccagtggcccaggtggggtcggtgcatg

SEQ ID NO: 51256 - DNA, 111 bp, Homo sapiens
  misc_feature 1..111: note = chr6:36808441-36808552
  misc_feature 1..111: note = hyper
  source 1..111: mol_type = genomic DNA
ccaggtctagaagctcctgccacccagtctggtggcaaccagactgggagatcggcccgagctccctgggcttctatgcagccagcaccgagtaggcgcgtgctgtgtgcc

SEQ ID NO: 51257 - DNA, 155 bp, Homo sapiens
  misc_feature 1..155: note = chr6:37663985-37664140
  misc_feature 1..155: note = hyper
  source 1..155: mol_type = genomic DNA
agggccaggggatgccggcatcctgatcagggtgtcaagccctgagtagaagaagcgaagccgcagcaacagcggggaaggcgagcccgccgcccggccttggtgctgacagccggctcgcccgcaagccgcgcggcaactccggctcatgcatc

SEQ ID NO: 51258 - DNA, 272 bp, Homo sapiens; identical to SEQ ID NO: 19242
  misc_feature 1..272: note = chr6:37664187-37664459
  misc_feature 1..272: note = hyper
  source 1..272: mol_type = genomic DNA

SEQ ID NO: 51259 - DNA, 71 bp, Homo sapiens; identical to SEQ ID NO: 30467
  misc_feature 1..71: note = chr6:37664481-37664552
  misc_feature 1..71: note = hyper
  source 1..71: mol_type = genomic DNA

SEQ ID NO: 51260 - DNA, 312 bp, Homo sapiens
  misc_feature 1..312: note = chr6:37673008-37673320
  misc_feature 1..312: note = hyper
  source 1..312: mol_type = genomic DNA
gcagccccagtggaacgcatcaagtttcgctgagctggtctttctaactttctccccggcagctccgcgggaagcaggatcaaatgttctccagcctgaaaagcccggctggggtgtgaggagaaaggagaaggggaggaggggcggccaatctgcggtattggaaggggaggggccggggccgggccccagggacaggcctcgtgactctccttgctccctttctgtttaaccctcccagccaattctttttcctttagccattagctctttttgatccacgtaaaagggggtggggggcgggaaatctgg

SEQ ID NO: 51261 - DNA, 79 bp, Homo sapiens; identical to SEQ ID NO: 30469
  misc_feature 1..79: note = chr6:39016246-39016325
  misc_feature 1..79: note = hyper
  source 1..79: mol_type = genomic DNA

SEQ ID NO: 51262 - DNA, 240 bp, Homo sapiens; identical to SEQ ID NO: 30470
  misc_feature 1..240: note = chr6:39016390-39016630
  misc_feature 1..240: note = hyper
  source 1..240: mol_type = genomic DNA

SEQ ID NO: 51263 - DNA, 251 bp, Homo sapiens; identical to SEQ ID NO: 8461
  misc_feature 1..251: note = chr6:39016678-39016929
  misc_feature 1..251: note = hyper
  source 1..251: mol_type = genomic DNA

SEQ ID NO: 51264 - DNA, 190 bp, Homo sapiens; identical to SEQ ID NO: 30472
  misc_feature 1..190: note = chr6:39197136-39197326
  misc_feature 1..190: note = hyper
  source 1..190: mol_type = genomic DNA

SEQ ID NO: 51265 - DNA, 173 bp, Homo sapiens; identical to SEQ ID NO: 19246
  misc_feature 1..173: note = chr6:39281133-39281306
  misc_feature 1..173: note = hyper
  source 1..173: mol_type = genomic DNA

SEQ ID NO: 51266 - DNA, 208 bp, Homo sapiens; identical to SEQ ID NO: 19247
  misc_feature 1..208: note = chr6:39281616-39281824
  misc_feature 1..208: note = hyper
  source 1..208: mol_type = genomic DNA

SEQ ID NO: 51267 - DNA, 124 bp, Homo sapiens
  misc_feature 1..124: note = chr6:39281875-39281999
  misc_feature 1..124: note = hyper
  source 1..124: mol_type = genomic DNA
agcgccgggcggtccagacacgtgaagttctgcaacagctcccacttgtcgcgctggaagctgcggctggagtcctgcgccgcgcggccctccagcgtccagaacacgccggtgcccagcgcca

SEQ ID NO: 51268 - DNA, 388 bp, Homo sapiens; identical to SEQ ID NO: 30475
  misc_feature 1..388: note = chr6:39759800-39760188
  misc_feature 1..388: note = hyper
  source 1..388: mol_type = genomic DNA

SEQ ID NO: 51269 - DNA, 193 bp, Homo sapiens; identical to SEQ ID NO: 30476
  misc_feature 1..193: note = chr6:39902169-39902362
  misc_feature 1..193: note = hyper
  source 1..193: mol_type = genomic DNA

SEQ ID NO: 51270 - DNA, 64 bp, Homo sapiens; identical to SEQ ID NO: 19250
  misc_feature 1..64: note = chr6:40554589-40554653
  misc_feature 1..64: note = hyper
  source 1..64: mol_type = genomic DNA

SEQ ID NO: 51271 - DNA, 161 bp, Homo sapiens
  misc_feature 1..161: note = chr6:40554699-40554860
  misc_feature 1..161: note = hyper
  source 1..161: mol_type = genomic DNA
ccccggctgggtggcaccgaggccggctccgcggggcgcccgggctccccggctcggccacgcatccttccccgcccgagacagactcgagctaaaccctccggcggctccggcgaatgcaggcagatggtggcctcggacgtccacgcggggaaagccct

SEQ ID NO: 51272 - DNA, 29 bp, Homo sapiens
  misc_feature 1..29: note = chr6:40555212-40555241
  misc_feature 1..29: note = hyper
  source 1..29: mol_type = genomic DNA
cccggtttctctctccgctccacacacac

SEQ ID NO: 51273 - DNA, 48 bp, Homo sapiens
  misc_feature 1..48: note = chr6:41337024-41337072
  misc_feature 1..48: note = hyper
  source 1..48: mol_type = genomic DNA
aggcaacaggtgggacggggagccagggagtggaaacgccggaggtcc

SEQ ID NO: 51274 - DNA, 96 bp, Homo sapiens
  misc_feature 1..96: note = chr6:41337128-41337224
  misc_feature 1..96: note = hyper
  source 1..96: mol_type = genomic DNA
ccgggaccctatccatgtcccattccgggcaccttcctcaaaagtaggggtgggaggggcataagccggtcaagtatttcccgggccttccggagc

SEQ ID NO: 51275 - DNA, 38 bp, Homo sapiens
  misc_feature 1..38: note = chr6:41339225-41339263
  misc_feature 1..38: note = hyper
  source 1..38: mol_type = genomic DNA
tccccagagagcgatcgccccggacttgtgcctgtgtt

SEQ ID NO: 51276 - DNA, 168 bp, Homo sapiens
  misc_feature 1..168: note = chr6:41339838-41340006
  misc_feature 1..168: note = hyper
  source 1..168: mol_type = genomic DNA
gaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgc

SEQ ID NO: 51277 - DNA, 28 bp, Homo sapiens
  misc_feature 1..28: note = chr6:41341549-41341577
  misc_feature 1..28: note = hyper
  source 1..28: mol_type = genomic DNA
cctggatcttccgcggcagagaagcctg

SEQ ID NO: 51278 - DNA, 28 bp, Homo sapiens
  misc_feature 1..28: note = chr6:41342779-41342807
  misc_feature 1..28: note = hyper
  source 1..28: mol_type = genomic DNA
gggtccttcaaaaagcgccactttggag

SEQ ID NO: 51279 - DNA, 613 bp, Homo sapiens
  misc_feature 1..613: note = chr6:41342837-41343450
  misc_feature 1..613: note = hyper
  source 1..613: mol_type = genomic DNA
tcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctgg

SEQ ID NO: 51280 - DNA, 52 bp, Homo sapiens; identical to SEQ ID NO: 30486
  misc_feature 1..52: note = chr6:41343650-41343702
  misc_feature 1..52: note = hyper
  source 1..52: mol_type = genomic DNA

SEQ ID NO: 51281 - DNA, 278 bp, Homo sapiens; identical to SEQ ID NO: 30487
  misc_feature 1..278: note = chr6:41438225-41438503
  misc_feature 1..278: note = hyper
  source 1..278: mol_type = genomic DNA

SEQ ID NO: 51282 - DNA, 41 bp, Homo sapiens
  misc_feature 1..41: note = chr6:41605896-41605937
  misc_feature 1..41: note = hyper
  source 1..41: mol_type = genomic DNA
acaggcaaaggaaaacgtgcagcccgcggatctccgggcct

SEQ ID NO: 51283 - DNA, 80 bp, Homo sapiens
  misc_feature 1..80: note = chr6:41606542-41606622
  misc_feature 1..80: note = hyper
  source 1..80: mol_type = genomic DNA
ccagcgcagccccgggcccaggtaggaccgggagtggcgagcgaagctggacaggggcgggtgggcggctgaaggggcca

SEQ ID NO: 51284 - DNA, 161 bp, Homo sapiens
  misc_feature 1..161: note = chr6:42879393-42879554
  misc_feature 1..161: note = hyper
  source 1..161: mol_type = genomic DNA
gggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcc

SEQ ID NO: 51285 - DNA, 42 bp, Homo sapiens
  misc_feature 1..42: note = chr6:42879718-42879760
  misc_feature 1..42: note = hyper
  source 1..42: mol_type = genomic DNA
tattaaaatagccatccagacggaaatcgagtgaggctggca

SEQ ID NO: 51286 - DNA, 151 bp, Homo sapiens
  misc_feature 1..151: note = chr6:43211311-43211462
  misc_feature 1..151: note = hyper
  source 1..151: mol_type = genomic DNA
gccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcgggg

SEQ ID NO: 51287 - DNA, 438 bp, Homo sapiens; identical to SEQ ID NO: 30494
  misc_feature 1..438: note = chr6:43237245-43237683
  misc_feature 1..438: note = hyper
  source 1..438: mol_type = genomic DNA

SEQ ID NO: 51288 - DNA, 116 bp, Homo sapiens; identical to SEQ ID NO: 30495
  misc_feature 1..116: note = chr6:43242817-43242933
  misc_feature 1..116: note = hyper
  source 1..116: mol_type = genomic DNA

SEQ ID NO: 51289 - DNA, 42 bp, Homo sapiens; identical to SEQ ID NO: 30496
  misc_feature 1..42: note = chr6:43243433-43243475
  misc_feature 1..42: note = hyper
  source 1..42: mol_type = genomic DNA

SEQ ID NO: 51290 - DNA, 30 bp, Homo sapiens; identical to SEQ ID NO: 30497
  misc_feature 1..30: note = chr6:43244222-43244252
  misc_feature 1..30: note = hyper
  source 1..30: mol_type = genomic DNA

SEQ ID NO: 51291 - DNA, 165 bp, Homo sapiens
  misc_feature 1..165: note = chr6:43613067-43613232
  misc_feature 1..165: note = hyper
  source 1..165: mol_type = genomic DNA
gaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacgg

SEQ ID NO: 51292 - DNA, 30 bp, Homo sapiens; identical to SEQ ID NO: 30500
  misc_feature 1..30: note = chr6:44264917-44264947
  misc_feature 1..30: note = hyper
  source 1..30: mol_type = genomic DNA

SEQ ID NO: 51293 - DNA, 66 bp, Homo sapiens; identical to SEQ ID NO: 30501
  misc_feature 1..66: note = chr6:44265201-44265267
  misc_feature 1..66: note = hyper
  source 1..66: mol_type = genomic DNA

SEQ ID NO: 51294 - DNA, 238 bp, Homo sapiens; identical to SEQ ID NO: 30502
  misc_feature 1..238: note = chr6:44265569-44265807
  misc_feature 1..238: note = hyper
  source 1..238: mol_type = genomic DNA

SEQ ID NO: 51295 - DNA, 60 bp, Homo sapiens; identical to SEQ ID NO: 30503
  misc_feature 1..60: note = chr6:45387578-45387638
  misc_feature 1..60: note = hyper
  source 1..60: mol_type = genomic DNA

SEQ ID NO: 51296 - DNA, 260 bp, Homo sapiens; identical to SEQ ID NO: 30504
  misc_feature 1..260: note = chr6:45387838-45388098
  misc_feature 1..260: note = hyper
  source 1..260: mol_type = genomic DNA

SEQ ID NO: 51297 - DNA, 38 bp, Homo sapiens; identical to SEQ ID NO: 30505
  misc_feature 1..38: note = chr6:45388359-45388397
  misc_feature 1..38: note = hyper
  source 1..38: mol_type = genomic DNA

SEQ ID NO: 51298 - DNA, 30 bp, Homo sapiens; identical to SEQ ID NO: 30506
  misc_feature 1..30: note = chr6:45388792-45388822
  misc_feature 1..30: note = hyper
  source 1..30: mol_type = genomic DNA

SEQ ID NO: 51299 - DNA, 408 bp, Homo sapiens; identical to SEQ ID NO: 30507
  misc_feature 1..408: note = chr6:45391133-45391541
  misc_feature 1..408: note = hyper
  source 1..408: mol_type = genomic DNA

SEQ ID NO: 51300 - DNA, 178 bp, Homo sapiens; identical to SEQ ID NO: 30508
  misc_feature 1..178: note = chr6:45982792-45982970
  misc_feature 1..178: note = hyper
  source 1..178: mol_type = genomic DNA

SEQ ID NO: 51301 - DNA, 30 bp, Homo sapiens; identical to SEQ ID NO: 30509
  misc_feature 1..30: note = chr6:45983617-45983647
  misc_feature 1..30: note = hyper
  source 1..30: mol_type = genomic DNA

SEQ ID NO: 51302 - DNA, 105 bp, Homo sapiens; identical to SEQ ID NO: 30510
  misc_feature 1..105: note = chr6:46138639-46138744
  misc_feature 1..105: note = hyper
  source 1..105: mol_type = genomic DNA

SEQ ID NO: 51303 - DNA, 388 bp, Homo sapiens; identical to SEQ ID NO: 19264
  misc_feature 1..388: note = chr6:46702594-46702982
  misc_feature 1..388: note = hyper
  source 1..388: mol_type = genomic DNA

SEQ ID NO: 51304 - DNA, 227 bp, Homo sapiens; identical to SEQ ID NO: 19265
  misc_feature 1..227: note = chr6:46703123-46703350
  misc_feature 1..227: note = hyper
  source 1..227: mol_type = genomic DNA

SEQ ID NO: 51305 - DNA, 89 bp, Homo sapiens; identical to SEQ ID NO: 19266
  misc_feature 1..89: note = chr6:46703436-46703525
  misc_feature 1..89: note = hyper
  source 1..89: mol_type = genomic DNA

SEQ ID NO: 51306 - DNA, 192 bp, Homo sapiens; identical to SEQ ID NO: 30512
  misc_feature 1..192: note = chr6:49518808-49519000
  misc_feature 1..192: note = hyper
  source 1..192: mol_type = genomic DNA

SEQ ID NO: 51307 - skipped

SEQ ID NO: 51308 - DNA, 95 bp, Homo sapiens; identical to SEQ ID NO: 19268
  misc_feature 1..95: note = chr6:50681604-50681699
  misc_feature 1..95: note = hyper
  source 1..95: mol_type = genomic DNA

SEQ ID NO: 51309 - DNA, 122 bp, Homo sapiens; identical to SEQ ID NO: 19269
  misc_feature 1..122: note = chr6:50681942-50682064
  misc_feature 1..122: note = hyper
  source 1..122: mol_type = genomic DNA

SEQ ID NO: 51310 - DNA, 54 bp, Homo sapiens
  misc_feature 1..54: note = chr6:50682265-50682319
  misc_feature 1..54: note = hyper
  source 1..54: mol_type = genomic DNA
agggagcaagttgaacgatttgcacagactggattttttaaaatatatggacaa

SEQ ID NO: 51311 - DNA, 211 bp, Homo sapiens; identical to SEQ ID NO: 19270
  misc_feature 1..211: note = chr6:50682448-50682659
  misc_feature 1..211: note = hyper
  source 1..211: mol_type = genomic DNA

SEQ ID NO: 51312 - DNA, 14 bp, Homo sapiens
  misc_feature 1..14: note = chr6:50689899-50689913
  misc_feature 1..14: note = hyper
  source 1..14: mol_type = genomic DNA
ctgcgtgctgactc

SEQ ID NO: 51313 - DNA, 49 bp, Homo sapiens; identical to SEQ ID NO: 8491
  misc_feature 1..49: note = chr6:50690631-50690680
  misc_feature 1..49: note = hyper
  source 1..49: mol_type = genomic DNA

SEQ ID NO: 51314 - DNA, 294 bp, Homo sapiens
  misc_feature 1..294: note = chr6:50691789-50692083
  misc_feature 1..294: note = hyper
  source 1..294: mol_type = genomic DNA
attaatatctgctgccgtggggggagaggtaacatggggggaggggtaacatgggggaggagggttaggaagggtgagaggctagagaggaagcagcagagaataattctccccacccaactcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatc

SEQ ID NO: 51315 - DNA, 31 bp, Homo sapiens; identical to SEQ ID NO: 19273
  misc_feature 1..31: note = chr6:50692481-50692512
  misc_feature 1..31: note = hyper
  source 1..31: mol_type = genomic DNA

SEQ ID NO: 51316 - DNA, 49 bp, Homo sapiens
  misc_feature 1..49: note = chr6:50788352-50788401
  misc_feature 1..49: note = hyper
  source 1..49: mol_type = genomic DNA
tccttaacaggcgggataatggtaaagtccaaggcgctagaactgtcct

SEQ ID NO: 51317 - DNA, 30 bp, Homo sapiens; identical to SEQ ID NO: 30525
  misc_feature 1..30: note = chr6:50789549-50789579
  misc_feature 1..30: note = hyper
  source 1..30: mol_type = genomic DNA

SEQ ID NO: 51318 - DNA, 52 bp, Homo sapiens
  misc_feature 1..52: note = chr6:50791135-50791187
  misc_feature 1..52: note = hyper
  source 1..52: mol_type = genomic DNA
tcccgagccacagctcgcggctctcccagctgggctcggtgtcccaaggacc

SEQ ID NO: 51319 - DNA, 247 bp, Homo sapiens
  misc_feature 1..247: note = chr6:50793404-50793651
  misc_feature 1..247: note = hyper
  source 1..247: mol_type = genomic DNA
gctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccg

SEQ ID NO: 51320 - DNA, 47 bp, Homo sapiens
  misc_feature 1..47: note = chr6:50794693-50794740
  misc_feature 1..47: note = hyper
  source 1..47: mol_type = genomic DNA
tgaatatcctgtacaaaaacccagcaggcggccgtaattagatagaa

SEQ ID NO: 51321 - DNA, 218 bp, Homo sapiens; identical to SEQ ID NO: 30530
  misc_feature 1..218: note = chr6:50798960-50799178
  misc_feature 1..218: note = hyper
  source 1..218: mol_type = genomic DNA

SEQ ID NO: 51322 - DNA, 30 bp, Homo sapiens
  misc_feature 1..30: note = chr6:50803804-50803834
  misc_feature 1..30: note = hyper
  source 1..30: mol_type = genomic DNA
aatgatgaataaagacggcttcctgggagg

SEQ ID NO: 51323 - DNA, 264 bp, Homo sapiens
  misc_feature 1..264: note = chr6:50803867-50804131
  misc_feature 1..264: note = hyper
  source 1..264: mol_type = genomic DNA
cgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtgg

SEQ ID NO: 51324 - DNA, 30 bp, Homo sapiens; identical to SEQ ID NO: 30532
  misc_feature 1..30: note = chr6:50805801-50805831
  misc_feature 1..30: note = hyper
  source 1..30: mol_type = genomic DNA

SEQ ID NO: 51325 - DNA, 47 bp, Homo sapiens
  misc_feature 1..47: note = chr6:50808634-50808681
  misc_feature 1..47: note = hyper
  source 1..47: mol_type = genomic DNA
gcctgcagtgggcggcgctgcgtgcgcccgcacgtttctcttgcagg

SEQ ID NO: 51326 - DNA, 45 bp, Homo sapiens; identical to SEQ ID NO: 30536
  misc_feature 1..45: note = chr6:50811838-50811883
  misc_feature 1..45: note = hyper
  source 1..45: mol_type = genomic DNA

SEQ ID NO: 51327 - DNA, 127 bp, Homo sapiens
  misc_feature 1..127: note = chr6:50817229-50817356
  misc_feature 1..127: note = hyper
  source 1..127: mol_type = genomic DNA
attaaaaatagtgctggaaggaagacccgattatttttttatgaagccacattccttttcttcatttgcaaataacagttccgtagggtcccttcccagggaccctgggcgccgaagttaggggcca

SEQ ID NO: 51328 - DNA, 30 bp, Homo sapiens; identical to SEQ ID NO: 30540
  misc_feature 1..30: note = chr6:50817727-50817757
  misc_feature 1..30: note = hyper
  source 1..30: mol_type = genomic DNA

SEQ ID NO: 51329 - DNA, 214 bp, Homo sapiens; identical to SEQ ID NO: 19278
  misc_feature 1..214: note = chr6:50818706-50818920
  misc_feature 1..214: note = hyper
  source 1..214: mol_type = genomic DNA

SEQ ID NO: 51330 - skipped

SEQ ID NO: 51331 - DNA, 138 bp, Homo sapiens; identical to SEQ ID NO: 30542
  misc_feature 1..138: note = chr6:50819287-50819425
  misc_feature 1..138: note = hyper
  source 1..138: mol_type = genomic DNA

SEQ ID NO: 51332-51333 - skipped (2 entries)

SEQ ID NO: 51334 - DNA, 235 bp, Homo sapiens
  misc_feature 1..235: note = chr6:55443946-55444181
  misc_feature 1..235: note = hyper
  source 1..235: mol_type = genomic DNA
gcgcccctccggtgcactggctgtgaggaccagagctgttctgcgcactgcggcggcgccgagagggcggggagtggggcgtggcaggtggccgcgcctggggcagcgggtgcacggggcacctgcgggaatcgacagaaatgccgagcacctgaacaggagagaaaggagctgagccagaggatgtccaggggtgtctcattttccgcactacactgagcgcccagggctgact

SEQ ID NO: 51335 - DNA, 89 bp, Homo sapiens; identical to SEQ ID NO: 19281
  misc_feature 1..89: note = chr6:56112173-56112262
  misc_feature 1..89: note = hyper
  source 1..89: mol_type = genomic DNA

SEQ ID NO: 51336 - DNA, 20 bp, Homo sapiens
  misc_feature 1..20: note = chr6:56112386-56112406
  misc_feature 1..20: note = hyper
  source 1..20: mol_type = genomic DNA
ggaggcggagcccgggagat

SEQ ID NO: 51337 - DNA, 86 bp, Homo sapiens; identical to SEQ ID NO: 30547
  misc_feature 1..86: note = chr6:56708805-56708891
  misc_feature 1..86: note = hyper
  source 1..86: mol_type = genomic DNA

SEQ ID NO: 51338 - DNA, 113 bp, Homo sapiens; identical to SEQ ID NO: 30548
  misc_feature 1..113: note = chr6:56716187-56716300
  misc_feature 1..113: note = hyper
  source 1..113: mol_type = genomic DNA

SEQ ID NO: 51339 - DNA, 285 bp, Homo sapiens
  misc_feature 1..285: note = chr6:56716410-56716695
  misc_feature 1..285: note = hyper
  source 1..285: mol_type = genomic DNA
aatgacacagaaaaagcattaacagcaaaatactcacatatgctcaatgatttaaacatctcccccaccaaccaccgccgccctccctgcccccaaactgggtctggcatatcctgcaccatcctcggagctgagggaatatgcagaaaccaaaaaaataaaacccggagctcaccatcttttcttggccaagtctccaatcgtaaaaacaatacacaggcagtttcaatacatgaagatttgcacggaagaagtgtgtggcctgtggtccggccaccagctcac

SEQ ID NO: 51340 - DNA, 280 bp, Homo sapiens; identical to SEQ ID NO: 19283
  misc_feature 1..280: note = chr6:56818937-56819217
  misc_feature 1..280: note = hyper
  source 1..280: mol_type = genomic DNA

SEQ ID NO: 51341 - skipped

SEQ ID NO: 51342 - DNA, 82 bp, Homo sapiens; identical to SEQ ID NO: 30551
  misc_feature 1..82: note = chr6:56820782-56820864
  misc_feature 1..82: note = hyper
  source 1..82: mol_type = genomic DNA

SEQ ID NO: 51343 - DNA, 19 bp, Homo sapiens
  misc_feature 1..19: note = chr6:58147428-58147447
  misc_feature 1..19: note = hyper
  source 1..19: mol_type = genomic DNA
gaaaaccgcatctcccgaa

SEQ ID NO: 51344 - DNA, 31 bp, Homo sapiens; identical to SEQ ID NO: 19286
  misc_feature 1..31: note = chr6:58147480-58147511
  misc_feature 1..31: note = hyper
  source 1..31: mol_type = genomic DNA

SEQ ID NO: 51345 - DNA, 28 bp, Homo sapiens
  misc_feature 1..28: note = chr6:58147762-58147790
  misc_feature 1..28: note = hyper
  source 1..28: mol_type = genomic DNA
acaggcccggcggcggagccctgctccc

SEQ ID NO: 51346 - DNA, 30 bp, Homo sapiens; identical to SEQ ID NO: 30554
  misc_feature 1..30: note = chr6:58148921-58148951
  misc_feature 1..30: note = hyper
  source 1..30: mol_type = genomic DNA

SEQ ID NO: 51347 - DNA, 26 bp, Homo sapiens
  misc_feature 1..26: note = chr6:58180231-58180257
  misc_feature 1..26: note = hyper
  source 1..26: mol_type = genomic DNA
ccgcagccctggagccgggcagtgag

SEQ ID NO: 51348 - DNA, 68 bp, Homo sapiens; identical to SEQ ID NO: 19288
  misc_feature 1..68: note = chr6:62996146-62996214
  misc_feature 1..68: note = hyper
  source 1..68: mol_type = genomic DNA

SEQ ID NO: 51349 - DNA, 228 bp, Homo sapiens
  misc_feature 1..228: note = chr6:62996215-62996443
  misc_feature 1..228: note = hyper
  source 1..228: mol_type = genomic DNA
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagat

SEQ ID NO: 51350 - DNA, 152 bp, Homo sapiens
  misc_feature 1..152: note = chr6:62996489-62996641
  misc_feature 1..152: note = hyper
  source 1..152: mol_type = genomic DNA
caggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtattt

SEQ ID NO: 51351 - DNA, 326 bp, Homo sapiens; identical to SEQ ID NO: 30560
  misc_feature 1..326: note = chr6:69344323-69344649
  misc_feature 1..326: note = hyper
  source 1..326: mol_type = genomic DNA

SEQ ID NO: 51352 - DNA, 461 bp, Homo sapiens; identical to SEQ ID NO: 30561
  misc_feature 1..461: note = chr6:69344978-69345439
  misc_feature 1..461: note = hyper
  source 1..461: mol_type = genomic DNA

SEQ ID NO: 51353 - DNA, 32 bp, Homo sapiens; identical to SEQ ID NO: 30562
  misc_feature 1..32: note = chr6:69345820-69345852
  misc_feature 1..32: note = hyper
  source 1..32: mol_type = genomic DNA

SEQ ID NO: 51354 - DNA, 370 bp, Homo sapiens; identical to SEQ ID NO: 30563
  misc_feature 1..370: note = chr6:69942843-69943213
  misc_feature 1..370: note = hyper
  source 1..370: mol_type = genomic DNA

SEQ ID NO: 51355 - DNA, 38 bp, Homo sapiens; identical to SEQ ID NO: 30564
  misc_feature 1..38: note = chr6:70576959-70576997
  misc_feature 1..38: note = hyper
  source 1..38: mol_type = genomic DNA

SEQ ID NO: 51356 - DNA, 30 bp, Homo sapiens; identical to SEQ ID NO: 30565
  misc_feature 1..30: note = chr6:70577378-70577408
  misc_feature 1..30: note = hyper
  source 1..30: mol_type = genomic DNA

SEQ ID NO: 51357 - DNA, 86 bp, Homo sapiens; identical to SEQ ID NO: 30566
  misc_feature 1..86: note = chr6:70991963-70992049
  misc_feature 1..86: note = hyper
  source 1..86: mol_type = genomic DNA

SEQ ID NO: 51358 - DNA, 55 bp, Homo sapiens
  misc_feature 1..55: note = chr6:70992162-70992217
  misc_feature 1..55: note = hyper
  source 1..55: mol_type = genomic DNA
ctggactcggggttagtgcagctacggcgggctggaggagcgggagagggagcgt

SEQ ID NO: 51359 - DNA, 270 bp, Homo sapiens
  misc_feature 1..270: note = chr6:70992560-70992830
  misc_feature 1..270: note = hyper
  source 1..270: mol_type = genomic DNA
tgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccacta

SEQ ID NO: 51360 - DNA, 45 bp, Homo sapiens; identical to SEQ ID NO: 19293
  misc_feature 1..45: note = chr6:70993015-70993060
  misc_feature 1..45: note = hyper
  source 1..45: mol_type = genomic DNA

SEQ ID NO: 51361 - DNA, 32 bp, Homo sapiens; identical to SEQ ID NO: 30569
  misc_feature 1..32: note = chr6:71665985-71666017
  misc_feature 1..32: note = hyper
  source 1..32: mol_type = genomic DNA

SEQ ID NO: 51362 - DNA, 190 bp, Homo sapiens; identical to SEQ ID NO: 8524
  misc_feature 1..190: note = chr6:71666491-71666681
  misc_feature 1..190: note = hyper
  source 1..190: mol_type = genomic DNA

SEQ ID NO: 51363 - DNA, 90 bp, Homo sapiens; identical to SEQ ID NO: 19295
  misc_feature 1..90: note = chr6:71666698-71666788
  misc_feature 1..90: note = hyper
  source 1..90: mol_type = genomic DNA

SEQ ID NO: 51364 - DNA, 57 bp, Homo sapiens
  misc_feature 1..57: note = chr6:72129732-72129789
  misc_feature 1..57: note = hyper
  source 1..57: mol_type = genomic DNA
aaccacttgagcccacggcgcctaaagccgactcacccgcagcccgaggtgcgggag

SEQ ID NO: 51365 - DNA, 21 bp, Homo sapiens
  misc_feature 1..21: note = chr6:72129829-72129850
  misc_feature 1..21: note = hyper
  source 1..21: mol_type = genomic DNA
ccgcgctgcggccccggctga

SEQ ID NO: 51366 - DNA, 119 bp, Homo sapiens; identical to SEQ ID NO: 30573
  misc_feature 1..119: note = chr6:72129926-72130045
  misc_feature 1..119: note = hyper
  source 1..119: mol_type = genomic DNA

SEQ ID NO: 51367 - DNA, 64 bp, Homo sapiens
  misc_feature 1..64: note = chr6:72596056-72596120
  misc_feature 1..64: note = hyper
  source 1..64: mol_type = genomic DNA
cgactgtaggggtagcggccggggcacgcgtggctcggacccggggagtgggcgggtgggtgcc

SEQ ID NO: 51368 - DNA, 107 bp, Homo sapiens; identical to SEQ ID NO: 30577
  misc_feature 1..107: note = chr6:72596541-72596648
  misc_feature 1..107: note = hyper
  source 1..107: mol_type = genomic DNA

SEQ ID NO: 51369 - DNA, 45 bp, Homo sapiens
  misc_feature 1..45: note = chr6:72596980-72597025
  misc_feature 1..45: note = hyper
  source 1..45: mol_type = genomic DNA
ggaaggggctgccagggtgctgggtgcggacggaggcgcccgcct

SEQ ID NO: 51370 - DNA, 214 bp, Homo sapiens
  misc_feature 1..214: note = chr6:73330620-73330834
  misc_feature 1..214: note = hyper
  source 1..214: mol_type = genomic DNA
gaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcc

SEQ ID NO: 51371 - DNA, 211 bp, Homo sapiens; identical to SEQ ID NO: 19301
  misc_feature 1..211: note = chr6:73331304-73331515
  misc_feature 1..211: note = hyper
  source 1..211: mol_type = genomic DNA

SEQ ID NO: 51372 - DNA, 30 bp, Homo sapiens; identical to SEQ ID NO: 30584
  misc_feature 1..30: note = chr6:73972965-73972995
  misc_feature 1..30: note = hyper
  source 1..30: mol_type = genomic DNA

SEQ ID NO: 51373 - DNA, 681 bp, Homo sapiens; identical to SEQ ID NO: 8540
  misc_feature 1..681: note = chr6:74019413-74020094
  misc_feature 1..681: note = hyper
  source 1..681: mol_type = genomic DNA

SEQ ID NO: 51374 - DNA, 84 bp, Homo sapiens; identical to SEQ ID NO: 30586
  misc_feature 1..84: note = chr6:74161237-74161321
  misc_feature 1..84: note = hyper
  source 1..84: mol_type = genomic DNA

SEQ ID NO: 51375 - DNA, 114 bp, Homo sapiens; identical to SEQ ID NO: 30587
  misc_feature 1..114: note = chr6:74161684-74161798
  misc_feature 1..114: note = hyper
  source 1..114: mol_type = genomic DNA

SEQ ID NO: 51376 - DNA, 209 bp, Homo sapiens; identical to SEQ ID NO: 30588
  misc_feature 1..209: note = chr6:74161830-74162039
  misc_feature 1..209: note = hyper
  source 1..209: mol_type = genomic DNA

SEQ ID NO: 51377 - DNA, 38 bp, Homo sapiens; identical to SEQ ID NO: 30589
  misc_feature 1..38: note = chr6:74405585-74405623
  misc_feature 1..38: note = hyper
  source 1..38: mol_type = genomic DNA

SEQ ID NO: 51378 - DNA, 63 bp, Homo sapiens; identical to SEQ ID NO: 8541
  misc_feature 1..63: note = chr6:74405916-74405979
  misc_feature 1..63: note = hyper
  source 1..63: mol_type = genomic DNA

SEQ ID NO: 51379 - DNA, 52 bp, Homo sapiens; identical to SEQ ID NO: 30591
  misc_feature 1..52: note = chr6:75914106-75914158
  misc_feature 1..52: note = hyper
  source 1..52: mol_type = genomic DNA

SEQ ID NO: 51380 - DNA, 138 bp, Homo sapiens; identical to SEQ ID NO: 30592
  misc_feature 1..138: note = chr6:75914461-75914599
  misc_feature 1..138: note = hyper
  source 1..138: mol_type = genomic DNA

SEQ ID NO: 51381 - DNA, 72 bp, Homo sapiens; identical to SEQ ID NO: 8543
  misc_feature 1..72: note = chr6:75915049-75915121
  misc_feature 1..72: note = hyper
  source 1..72: mol_type = genomic DNA

SEQ ID NO: 51382 - DNA, 36 bp, Homo sapiens; identical to SEQ ID NO: 8544
  misc_feature 1..36: note = chr6:75915170-75915206
  misc_feature 1..36: note = hyper
  source 1..36: mol_type = genomic DNA

SEQ ID NO: 51383 - DNA, 327 bp, Homo sapiens; identical to SEQ ID NO: 30595
  misc_feature 1..327: note = chr6:75915601-75915928
  misc_feature 1..327: note = hyper
  source 1..327: mol_type = genomic DNA

SEQ ID NO: 51384 - DNA, 153 bp, Homo sapiens; identical to SEQ ID NO: 8546
  misc_feature 1..153: note = chr6:75916306-75916459
  misc_feature 1..153: note = hyper
  source 1..153: mol_type = genomic DNA

SEQ ID NO: 51385 - skipped

SEQ ID NO: 51386 - DNA, 588 bp, Homo sapiens
  misc_feature 1..588: note = chr6:78172572-78173160
  misc_feature 1..588: note = hyper
  source 1..588: mol_type = genomic DNA
ggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggca

SEQ ID NO: 51387 - DNA, 234 bp, Homo sapiens; identical to SEQ ID NO: 30600
  misc_feature 1..234: note = chr6:78175915-78176149
  misc_feature 1..234: note = hyper
  source 1..234: mol_type = genomic DNA

SEQ ID NO: 51388 - DNA, 13 bp, Homo sapiens
  misc_feature 1..13: note = chr6:78176445-78176458
  misc_feature 1..13: note = hyper
  source 1..13: mol_type = genomic DNA
cctgggtcacccc

SEQ ID NO: 51389 - DNA, 14 bp, Homo sapiens
  misc_feature 1..14: note = chr6:78176820-78176834
  misc_feature 1..14: note = hyper
  source 1..14: mol_type = genomic DNA
ggaggaaccaaaga

SEQ ID NO: 51390 - DNA, 27 bp, Homo sapiens
  misc_feature 1..27: note = chr6:79620315-79620342
  misc_feature 1..27: note = hyper
  source 1..27: mol_type = genomic DNA
aagtgatatcaagcccgggcagaaggg

SEQ ID NO: 51391 - DNA, 178 bp, Homo sapiens
  misc_feature 1..178: note = chr6:79620699-79620877
  misc_feature 1..178: note = hyper
  source 1..178: mol_type = genomic DNA
ttatcttgtgcggtgacgcccatgcctaggtcttgacacttccctcctatgccctttattgccaagggtcgggatggccttcgtgtcctctgcagcctccgccttccttctgctgccagcagctgtagattttacctctttcccctaacttcctctcaggctcctactccattcctat

SEQ ID NO: 51392 - DNA, 257 bp, Homo sapiens; identical to SEQ ID NO: 19312
  misc_feature 1..257: note = chr6:80656673-80656930
  misc_feature 1..257: note = hyper
  source 1..257: mol_type = genomic DNA

SEQ ID NO: 51393 - DNA, 420 bp, Homo sapiens
  misc_feature 1..420: note = chr6:80657180-80657600
  misc_feature 1..420: note = hyper
  source 1..420: mol_type = genomic DNA
ccaagcggaaggcgtcgtcaaggttcccgggagaaagacgaggaggtggaggaggcccagccgccagcacagtgcgctgcaccagtctgcagcctcgcgcagccgcccctccaatctcctcagccggcgtcacgtggccgcgcgcgggggcggggggccggccgcccctcctccctccctccctccctagtattgggactcgctggcgtagggatgctgcgctcaagggtgcgacgccaactgggctcgcgcaggcgcgcgccgtcgagcgggagcgggacacctgggctcctccttggcccctccccgcacaagtcgcctcattagccttccccgcccctgtcccgggcatcggcccctgcggaggagttcaccgcctccccacgggtgatttcttatccgccccggatacgtcctggg

SEQ ID NO: 51394 - DNA, 111 bp, Homo sapiens; identical to SEQ ID NO: 30607
  misc_feature 1..111: note = chr6:82461362-82461473
  misc_feature 1..111: note = hyper
  source 1..111: mol_type = genomic DNA

SEQ ID NO: 51395 - skipped

SEQ ID NO: 51396 - DNA, 23 bp, Homo sapiens
  misc_feature 1..23: note = chr6:84417908-84417931
  misc_feature 1..23: note = hyper
  source 1..23: mol_type = genomic DNA
cgtgacaccgtccccattctccc

SEQ ID NO: 51397 - DNA, 363 bp, Homo sapiens
  misc_feature 1..363: note = chr6:84418281-84418644
  misc_feature 1..363: note = hyper
  source 1..363: mol_type = genomic DNA
gccgaggcccatcgcccgggccccttccccccggttccaaatccctgccgcaggggccgcccgggagctctgcggaggcgccggagtcttggggcgcctcacccttcctggctttggagaggagccgggctgacagcgaagcccagtcccccgcccgccctggagcgctccgcggagctgtcactcggccgctgcccttctccgcaccctgggattatcctctgcggatccccgcgagaccctggcgcggggagggggccgagtacggccgcgggtactcaccccgcccctgagcggcgccgcccgccgcaggatgagcggagcccgggccgccgagggaagccgcgccggtggatgtgtgcg

SEQ ID NO: 51398 - DNA, 86 bp, Homo sapiens
  misc_feature 1..86: note = chr6:84419071-84419157
  misc_feature 1..86: note = hyper
  source 1..86: mol_type = genomic DNA
gggccgcccctccgctgctggcgccgcacccggcacgcactgggctcgcgcaccacgcacacctgcccgccgactgcggggggagc

SEQ ID NO: 51399 - DNA, 101 bp, Homo sapiens
  misc_feature 1..101: note = chr6:84562772-84562873
  misc_feature 1..101: note = hyper
  source 1..101: mol_type = genomic DNA
caaaacgtgtagactcgcttaattccatctcctcctggcctcttcacacggaaattggctgctcgggcgaatgttgtttttctccgcagccatgtgtcgaa

SEQ ID NO: 51400 - DNA, 43 bp, Homo sapiens; identical to SEQ ID NO: 19320
  misc_feature 1..43: note = chr6:84563242-84563285
  misc_feature 1..43: note = hyper
  source 1..43: mol_type = genomic DNA

SEQ ID NO: 51401 - DNA, 73 bp, Homo sapiens; identical to SEQ ID NO: 19321
  misc_feature 1..73: note = chr6:84563416-84563489
  misc_feature 1..73: note = hyper
  source 1..73: mol_type = genomic DNA

SEQ ID NO: 51402 - DNA, 311 bp, Homo sapiens; identical to SEQ ID NO: 19322
  misc_feature 1..311: note = chr6:84563542-84563853
  misc_feature 1..311: note = hyper
  source 1..311: mol_type = genomic DNA

SEQ ID NO: 51403 - DNA, 39 bp, Homo sapiens; identical to SEQ ID NO: 30618
  misc_feature 1..39: note = chr6:85471957-85471996
  misc_feature 1..39: note = hyper
  source 1..39: mol_type = genomic DNA

SEQ ID NO: 51404 - DNA, 52 bp, Homo sapiens
  misc_feature 1..52: note = chr6:85472355-85472407
  misc_feature 1..52: note = hyper
  source 1..52: mol_type = genomic DNA
agggcagaggggtcccgggccgggccagggagcgcgccggagaccccttggg

SEQ ID NO: 51405 - DNA, 225 bp, Homo sapiens; identical to SEQ ID NO: 19325
  misc_feature 1..225: note = chr6:85473703-85473928
  misc_feature 1..225: note = hyper
  source 1..225: mol_type = genomic DNA

SEQ ID NO: 51406 - DNA, 216 bp, Homo sapiens
  misc_feature 1..216: note = chr6:85474378-85474594
  misc_feature 1..216: note = hyper
  source 1..216: mol_type = genomic DNA
cacccagacggccggccaatcaggaggcgccgactccgcgcagcccgcgcccacttccttacaaggtagcgaaaaaccaggagtgaaaagcgccgctgtctggcttggatgtgccagccacacggacgctgaactctgtctctctgacgtccgtagctgagtccagccccgtagtctccagctttcctcaccaggacctggaaaggcggaagttcc

SEQ ID NO: 51407 - DNA, 139 bp, Homo sapiens
  misc_feature 1..139: note = chr6:85477028-85477167
  misc_feature 1..139: note = hyper
  source 1..139: mol_type = genomic DNA
gggcgtcgaatctctcttgggcatgggagggaaagacattccgagttggctgggcggagtggcagccttgagagtgacgagtgacagcaaagcctcgtcctagcaaggccttttaccaacagcgcggcatgccctttcg

SEQ ID NO: 51408 - DNA, 129 bp, Homo sapiens
  misc_feature 1..129: note = chr6:85482401-85482530
  misc_feature 1..129: note = hyper
  source 1..129: mol_type = genomic DNA
agccaaattattccccgacggctccaatattgtgccagagtcccagagtcagttatttttatgtctgactgtatttcacatgtgcagggtgataaataaaatccgtctcaagctacaaactatctgagt

SEQ ID NO: 51409 - DNA, 36 bp, Homo sapiens
  misc_feature 1..36: note = chr6:85483309-85483345
  misc_feature 1..36: note = hyper
  source 1..36: mol_type = genomic DNA
cggggagtcagggagcgcggaacgcgggtttctgtt

SEQ ID NO: 51410 - DNA, 149 bp, Homo sapiens
  misc_feature 1..149: note = chr6:85483375-85483524
  misc_feature 1..149: note = hyper
  source 1..149: mol_type = genomic DNA
taagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggc

SEQ ID NO: 51411 - DNA, 13 bp, Homo sapiens
  misc_feature 1..13: note = chr6:85484920-85484933
  misc_feature 1..13: note = hyper
  source 1..13: mol_type = genomic DNA
agatagactaagt

SEQ ID NO: 51412 - DNA, 125 bp, Homo sapiens; identical to SEQ ID NO: 30627
  misc_feature 1..125: note = chr6:86159778-86159903
  misc_feature 1..125: note = hyper
  source 1..125: mol_type = genomic DNA

SEQ ID NO: 51413 - DNA, 56 bp, Homo sapiens; identical to SEQ ID NO: 30628
  misc_feature 1..56: note = chr6:86160189-86160245
  misc_feature 1..56: note = hyper
  source 1..56: mol_type = genomic DNA

SEQ ID NO: 51414 - DNA, 92 bp, Homo sapiens; identical to SEQ ID NO: 30629
  misc_feature 1..92: note = chr6:87647217-87647309
  misc_feature 1..92: note = hyper
  source 1..92: mol_type = genomic DNA

SEQ ID NO: 51415 - DNA, 54 bp, Homo sapiens; identical to SEQ ID NO: 30630
  misc_feature 1..54: note = chr6:87647316-87647370
  misc_feature 1..54: note = hyper
  source 1..54: mol_type = genomic DNA

SEQ ID NO: 51416 - DNA, 170 bp, Homo sapiens; identical to SEQ ID NO: 30631
  misc_feature 1..170: note = chr6:87647371-87647541
  misc_feature 1..170: note = hyper
  source 1..170: mol_type = genomic DNA

SEQ ID NO: 51417 - DNA, 544 bp, Homo sapiens
  misc_feature 1..544: note = chr6:87861548-87862092
  misc_feature 1..544: note = hyper
  source 1..544: mol_type = genomic DNA
agactccagcatccccggggtgggtttccggaggccccgctccccgccgcgccctggaaaggctccagaatctctcggcctggaggcccctggcggcctctgctcccaagcggggagtcgcagccaggctacagcgggcttgatcctcagtgctgggtggaaaaaccgcggcggcaaacgccgggcctgcaactgctgggtgtcggcgttgctggttcgcgggcggcggcggcggcggctccgcgacaacagaggacgcgagcaaccggcgcagcgcccagcagggccttggcggggtggaggggcgcaggctgggttagcggagcagagcggaccgatctggtgccctccgtggcccgaggcctgcggaccttctccgttctccggcccagggcgagagcggggcaagagacagcgccccgatagtggcgcacgctctccgccatccccgggcctcgcgctttcacctcgcgtgctggggcgagggcggggctgcggggtgtactgggtcgggggtaggaaggacctgccaggccttagccct

SEQ ID NO: 51418 - DNA, 133 bp, Homo sapiens; identical to SEQ ID NO: 30633
  misc_feature 1..133: note = chr6:88875382-88875515
  misc_feature 1..133: note = hyper
  source 1..133: mol_type = genomic DNA

SEQ ID NO: 51419 - DNA, 509 bp, Homo sapiens; identical to SEQ ID NO: 30634
  misc_feature 1..509: note = chr6:88875729-88876238
  misc_feature 1..509: note = hyper
  source 1..509: mol_type = genomic DNA

SEQ ID NO: 51420 - DNA, 193 bp, Homo sapiens; identical to SEQ ID NO: 30635
  misc_feature 1..193: note = chr6:88876284-88876477
  misc_feature 1..193: note = hyper
  source 1..193: mol_type = genomic DNA

SEQ ID NO: 51421 - DNA, 111 bp, Homo sapiens; identical to SEQ ID NO: 2853
  misc_feature 1..111: note = chr6:88876630-88876741
  misc_feature 1..111: note = hyper
  source 1..111: mol_type = genomic DNA

SEQ ID NO: 51422 - DNA, 221 bp, Homo sapiens; identical to SEQ ID NO: 19336
  misc_feature 1..221: note = chr6:88876742-88876963
  misc_feature 1..221: note = hyper
  source 1..221: mol_type = genomic DNA

SEQ ID NO: 51423 - DNA, 46 bp, Homo sapiens; identical to SEQ ID NO: 30639
  misc_feature 1..46: note = chr6:88877474-88877520
  misc_feature 1..46: note = hyper
  source 1..46: mol_type = genomic DNA

SEQ ID NO: 51424 - DNA, 30 bp, Homo sapiens; identical to SEQ ID NO: 30640
  misc_feature 1..30: note = chr6:90120876-90120906
  misc_feature 1..30: note = hyper
  source 1..30: mol_type = genomic DNA

SEQ ID NO: 51425 - DNA, 340 bp, Homo sapiens; identical to SEQ ID NO: 30641
  misc_feature 1..340: note = chr6:90143378-90143718
  misc_feature 1..340: note = hyper
  source 1..340: mol_type = genomic DNA

SEQ ID NO: 51426 - DNA, 399 bp, Homo sapiens; identical to SEQ ID NO: 30642
  misc_feature 1..399: note = chr6:91004780-91005179
  misc_feature 1..399: note = hyper
  source 1..399: mol_type = genomic DNA

SEQ ID NO: 51427 - DNA, 106 bp, Homo sapiens; identical to SEQ ID NO: 8585
  misc_feature 1..106: note = chr6:91005208-91005314
  misc_feature 1..106: note = hyper
  source 1..106: mol_type = genomic DNA

SEQ ID NO: 51428 - DNA, 631 bp, Homo sapiens
  misc_feature 1..631: note = chr6:91320318-91320949
  misc_feature 1..631: note = hyper
  source 1..631: mol_type = genomic DNA
gattatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcag

SEQ ID NO: 51429 - DNA, 247 bp, Homo sapiens; identical to SEQ ID NO: 30645
  misc_feature 1..247: note = chr6:94126366-94126613
  misc_feature 1..247: note = hyper
  source 1..247: mol_type = genomic DNA

SEQ ID NO: 51430 - DNA, 331 bp, Homo sapiens
  misc_feature 1..331: note = chr6:94126642-94126973
  misc_feature 1..331: note = hyper
  source 1..331: mol_type = genomic DNA
cgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaagggggtttcttatcttcctctagccacccccaaatgccccaggaggccc

SEQ ID NO: 51431 - skipped

SEQ ID NO: 51432 - DNA, 46 bp, Homo sapiens; identical to SEQ ID NO: 30647
  misc_feature 1..46: note = chr6:94127085-94127131
  misc_feature 1..46: note = hyper
  source 1..46: mol_type = genomic DNA

SEQ ID NO: 51433 - DNA, 355 bp, Homo sapiens
  misc_feature 1..355: note = chr6:94127544-94127899
  misc_feature 1..355: note = hyper
  source 1..355: mol_type = genomic DNA
gggttcagcatctatacaggttgcagatgtggaaagtggggtcagaaggtcaggctgaaagaaggactagaatttggcgccgggtttgaggggggcttgagcgaactaagaggagtgcacgatgagaataaagaaaaggtgcactaagttttcagaaatagatgaatcaaggacctatatgtaagtcccctcaacaccccgcccgataaccaccatgacctaaatttcataacagattcctctccctctacacatcaggaataagtaattatttctcttctgcttttaacagatcgaaaaatgaaacttagatacacagcctgaaagaccaggggggcgacgggatgaggggggt

SEQ ID NO: 51434 - DNA, 310 bp, Homo sapiens; identical to SEQ ID NO: 30649
  misc_feature 1..310: note = chr6:94128439-94128749
  misc_feature 1..310: note = hyper
  source 1..310: mol_type = genomic DNA

SEQ ID NO: 51435 - DNA, 52 bp, Homo sapiens
  misc_feature 1..52: note = chr6:94129167-94129219
  misc_feature 1..52: note = hyper
  source 1..52: mol_type = genomic DNA
ccccttctcggtccccgatcggctgctccacgtttagctttttttaatttcc

SEQ ID NO: 51436 - DNA, 149 bp, Homo sapiens; identical to SEQ ID NO: 19348
  misc_feature 1..149: note = chr6:94129257-94129406
  misc_feature 1..149: note = hyper
  source 1..149: mol_type = genomic DNA

SEQ ID NO: 51437 - DNA, 32 bp, Homo sapiens; identical to SEQ ID NO: 8594
  misc_feature 1..32: note = chr6:94129782-94129814
  misc_feature 1..32: note = hyper
  source 1..32: mol_type = genomic DNA

SEQ ID NO: 51438 - DNA, 395 bp, Homo sapiens; identical to SEQ ID NO: 30652
  misc_feature 1..395: note = chr6:96463220-96463615
  misc_feature 1..395: note = hyper
  source 1..395: mol_type = genomic DNA

SEQ ID NO: 51439 - DNA, 18 bp, Homo sapiens
  misc_feature 1..18: note = chr6:96464082-96464100
  misc_feature 1..18: note = hyper
  source 1..18: mol_type = genomic DNA
ggaccggtgagtaggcgg

SEQ ID NO: 51440 - DNA, 30 bp, Homo sapiens; identical to SEQ ID NO: 30654
  misc_feature 1..30: note = chr6:96464463-96464493
  misc_feature 1..30: note = hyper
  source 1..30: mol_type = genomic DNA

SEQ ID NO: 51441 - DNA, 32 bp, Homo sapiens; identical to SEQ ID NO: 30655
  misc_feature 1..32: note = chr6:99271691-99271723
  misc_feature 1..32: note = hyper
  source 1..32: mol_type = genomic DNA

SEQ ID NO: 51442 - DNA, 52 bp, Homo sapiens
  misc_feature 1..52: note = chr6:99272810-99272862
  misc_feature 1..52: note = hyper
  source 1..52: mol_type = genomic DNA
cccgccacctcctccaccccccgccccgcattccccccggggcgaccctccc

SEQ ID NO: 51443 - DNA, 189 bp, Homo sapiens
  misc_feature 1..189: note = chr6:99273410-99273599
  misc_feature 1..189: note = hyper
  source 1..189: mol_type = genomic DNA
gtgggaggaggtactgctcccccctactcctcccttttccctgctccctctccatcagcaacaggttgtcaagttgaggagacatcccctccaaactctctcactccccacttgtggccgaggcctgccctgtgttcatcccagacagtcaggcagacgctgagctgtccgcgtcggcgtgggcgcctg

SEQ ID NO: 51444 - DNA, 53 bp, Homo sapiens; identical to SEQ ID NO: 30658
  misc_feature 1..53: note = chr6:99273848-99273901
  misc_feature 1..53: note = hyper
  source 1..53: mol_type = genomic DNA

SEQ ID NO: 51445 - DNA, 30 bp, Homo sapiens; identical to SEQ ID NO: 30659
  misc_feature 1..30: note = chr6:99275545-99275575
  misc_feature 1..30: note = hyper
  source 1..30: mol_type = genomic DNA

SEQ ID NO: 51446 - DNA, 30 bp, Homo sapiens; identical to SEQ ID NO: 30660
  misc_feature 1..30: note = chr6:99276704-99276734
  misc_feature 1..30: note = hyper
  source 1..30: mol_type = genomic DNA

SEQ ID NO: 51447 - DNA, 72 bp, Homo sapiens
  misc_feature 1..72: note = chr6:99277330-99277402
  misc_feature 1..72: note = hyper
  source 1..72: mol_type = genomic DNA
aagccaccaattgtctcctgttctgtttctgagatttttgttctgtttctgagatttcgtataaacaagcta

SEQ ID NO: 51448 - DNA, 201 bp, Homo sapiens; identical to SEQ ID NO: 30663
  misc_feature 1..201: note = chr6:99278897-99279098
  misc_feature 1..201: note = hyper
  source 1..201: mol_type = genomic DNA

SEQ ID NO: 51449 - DNA, 206 bp, Homo sapiens
  misc_feature 1..206: note = chr6:99279350-99279556
  misc_feature 1..206: note = hyper
  source 1..206: mol_type = genomic DNA
agaatggcaggcagacgcgcggactctgccctgacagggtcagcccaaagaatgggccccagagcccggggcgggggaggaaccggtggagaggccccagtctggacctaaaaccagcgagagctcaggtttcgggagccccgaagaggtgccgcgctgggaggcagacaaggaagcccagggtgctcggaacccggcgttcgcgc

SEQ ID NO: 51450 - DNA, 183 bp, Homo sapiens
  misc_feature 1..183: note = chr6:99279612-99279795
  misc_feature 1..183: note = hyper
  source 1..183: mol_type = genomic DNA
ctcagagccgcggtgcgagcccagcctggcccgcccggtgattggccgcgcttgggggtgggggtggggtgcagagactgaggccccgggtaggctatttctttgtgtactcccggggatttattgggtatattaaaccctgttgggaacgtttcggctccttggccgccagcgaaatgagac

SEQ ID NO: 51451 - DNA, 240 bp, Homo sapiens; identical to SEQ ID NO: 30665
  misc_feature 1..240: note = chr6:99279796-99280036
  misc_feature 1..240: note = hyper
  source 1..240: mol_type = genomic DNA

SEQ ID NO: 51452 - DNA, 60 bp, Homo sapiens
  misc_feature 1..60: note = chr6:99280497-99280557
  misc_feature 1..60: note = hyper
  source 1..60: mol_type = genomic DNA
ctagcagcccccaggcgcgcggccagagtggccccgcgcttgcgctgggacggagcgaca

SEQ ID NO: 51453 - DNA, 93 bp, Homo sapiens; identical to SEQ ID NO: 19354
  misc_feature 1..93: note = chr6:99281385-99281478
  misc_feature 1..93: note = hyper
  source 1..93: mol_type = genomic DNA

SEQ ID NO: 51454 - DNA, 37 bp, Homo sapiens; identical to SEQ ID NO: 30669
  misc_feature 1..37: note = chr6:99281946-99281983
  misc_feature 1..37: note = hyper
  source 1..37: mol_type = genomic DNA

SEQ ID NO: 51455 - DNA, 95 bp, Homo sapiens; identical to SEQ ID NO: 8605
  misc_feature 1..95: note = chr6:99282778-99282873
  misc_feature 1..95: note = hyper
  source 1..95: mol_type = genomic DNA

SEQ ID NO: 51456 - DNA, 170 bp, Homo sapiens
  misc_feature 1..170: note = chr6:99283342-99283512
  misc_feature 1..170: note = hyper
  source 1..170: mol_type = genomic DNA
cggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgc

SEQ ID NO: 51457 - DNA, 48 bp, Homo sapiens; identical to SEQ ID NO: 30672
  misc_feature 1..48: note = chr6:99283978-99284026
  misc_feature 1..48: note = hyper
  source 1..48: mol_type = genomic DNA

SEQ ID NO: 51458 - DNA, 30 bp, Homo sapiens; identical to SEQ ID NO: 30673
  misc_feature 1..30: note = chr6:99284652-99284682
  misc_feature 1..30: note = hyper
  source 1..30: mol_type = genomic DNA

SEQ ID NO: 51459 - DNA, 29 bp, Homo sapiens
  misc_feature 1..29: note = chr6:99290331-99290360
  misc_feature 1..29: note = hyper
  source 1..29: mol_type = genomic DNA
gtaccttggccttgccgcgcaccccccac

SEQ ID NO: 51460 - DNA, 75 bp, Homo sapiens; identical to SEQ ID NO: 19357
  misc_feature 1..75: note = chr6:99290398-99290473
  misc_feature 1..75: note = hyper
  source 1..75: mol_type = genomic DNA

SEQ ID NO: 51461 - DNA, 15 bp, Homo sapiens
  misc_feature 1..15: note = chr6:99291682-99291697
  misc_feature 1..15: note = hyper
  source 1..15: mol_type = genomic DNA
tggcctctgcaggct

SEQ ID NO: 51462 - DNA, 15 bp, Homo sapiens
  misc_feature 1..15: note = chr6:99291729-99291744
  misc_feature 1..15: note = hyper
  source 1..15: mol_type = genomic DNA
cgcccgcggccactc

SEQ ID NO: 51463 - DNA, 104 bp, Homo sapiens; identical to SEQ ID NO: 19358
  misc_feature 1..104: note = chr6:99292417-99292521
  misc_feature 1..104: note = hyper
  source 1..104: mol_type = genomic DNA

SEQ ID NO: 51464 - DNA, 44 bp, Homo sapiens
  misc_feature 1..44: note = chr6:99296467-99296511
  misc_feature 1..44: note = hyper
  source 1..44: mol_type = genomic DNA
gctgtggctgcctgagacctccagggcagcgcacattacgggcg

SEQ ID NO: 51465 - DNA, 30 bp, Homo sapiens; identical to SEQ ID NO: 30682
  misc_feature 1..30: note = chr6:100036662-100036692
  misc_feature 1..30: note = hyper
  source 1..30: mol_type = genomic DNA

SEQ ID NO: 51466 - DNA, 110 bp, Homo sapiens; identical to SEQ ID NO: 30683
  misc_feature 1..110: note = chr6:100036959-100037069
  misc_feature 1..110: note = hyper
  source 1..110: mol_type = genomic DNA

SEQ ID NO: 51467 - DNA, 42 bp, Homo sapiens
  misc_feature 1..42: note = chr6:100038640-100038682
  misc_feature 1..42: note = hyper
  source 1..42: mol_type = genomic DNA
tgccttccttcccctcgtcgccttcctcccactgtgcgagct

SEQ ID NO: 51468 - DNA, 190 bp, Homo sapiens; identical to SEQ ID NO: 19360
  misc_feature 1..190: note = chr6:100038964-100039154
  misc_feature 1..190: note = hyper
  source 1..190: mol_type = genomic DNA

SEQ ID NO: 51469 - DNA, 37 bp, Homo sapiens; identical to SEQ ID NO: 30687
  misc_feature 1..37: note = chr6:100050390-100050427
  misc_feature 1..37: note = hyper
  source 1..37: mol_type = genomic DNA

SEQ ID NO: 51470 - DNA, 128 bp, Homo sapiens
  misc_feature 1..128: note = chr6:100051971-100052099
  misc_feature 1..128: note = hyper
  source 1..128: mol_type = genomic DNA
gataaaaaaaaaaaaaaagccgagtggaatgttttgattgagtctcaacattgtctttgaataaggctgagaccatgtaattaatgtgtctttttaataagggacaatacggccgttcaagctattta

SEQ ID NO: 51471 - DNA, 107 bp, Homo sapiens; identical to SEQ ID NO: 30692
  misc_feature 1..107: note = chr6:100052482-100052589
  misc_feature 1..107: note = hyper
  source 1..107: mol_type = genomic DNA

SEQ ID NO: 51472 - DNA, 27 bp, Homo sapiens
  misc_feature 1..27: note = chr6:100054839-100054866
  misc_feature 1..27: note = hyper
  source 1..27: mol_type = genomic DNA
tccagctctgtcactcgcgcccttcca

SEQ ID NO: 51473 - DNA, 315 bp, Homo sapiens
  misc_feature 1..315: note = chr6:100054917-100055232
  misc_feature 1..315: note = hyper
  source 1..315: mol_type = genomic DNA
gagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgccattcgcctctcagtgccctgacccgggaaaggggtacgagagaaagtggaggaagggagtgattgagtcgttacctgctaattctgccgggtggaaggggactcctattattctgagcaagtagcctctttaactgtgagagctgga

SEQ ID NO: 51474 - DNA, 64 bp, Homo sapiens; identical to SEQ ID NO: 30695
  misc_feature 1..64: note = chr6:100055269-100055333
  misc_feature 1..64: note = hyper
  source 1..64: mol_type = genomic DNA

SEQ ID NO: 51475 - DNA, 36 bp, Homo sapiens; identical to SEQ ID NO: 30696
  misc_feature 1..36: note = chr6:100055566-100055602
  misc_feature 1..36: note = hyper
  source 1..36: mol_type = genomic DNA

SEQ ID NO: 51476 - DNA, 26 bp, Homo sapiens
  misc_feature 1..26: note = chr6:100060996-100061022
  misc_feature 1..26: note = hyper
  source 1..26: mol_type = genomic DNA
cagcggcggtggaggcggcgccttcc

SEQ ID NO: 51477 - DNA, 235 bp, Homo sapiens; identical to SEQ ID NO: 19363
  misc_feature 1..235: note = chr6:100061076-100061311
  misc_feature 1..235: note = hyper
  source 1..235: mol_type = genomic DNA

SEQ ID NO: 51478 - DNA, 278 bp, Homo sapiens
  misc_feature 1..278: note = chr6:100061419-100061697
  misc_feature 1..278: note = hyper
  source 1..278: mol_type = genomic DNA
ggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccc

SEQ ID NO: 51479 - DNA, 190 bp, Homo sapiens; identical to SEQ ID NO: 19365
  misc_feature 1..190: note = chr6:100061988-100062178
  misc_feature 1..190: note = hyper
  source 1..190: mol_type = genomic DNA

SEQ ID NO: 51480 - DNA, 84 bp, Homo sapiens; identical to SEQ ID NO: 19366
  misc_feature 1..84: note = chr6:100062586-100062670
  misc_feature 1..84: note = hyper
  source 1..84: mol_type = genomic DNA

SEQ ID NO: 51481 - DNA, 42 bp, Homo sapiens
  misc_feature 1..42: note = chr6:100062902-100062944
  misc_feature 1..42: note = hyper
  source 1..42: mol_type = genomic DNA
gagctcaccctgaaccgcccaggcggtctgctcttggtgttc

SEQ ID NO: 51482 - DNA, 20 bp, Homo sapiens
  misc_feature 1..20: note = chr6:100063068-100063088
  misc_feature 1..20: note = hyper
  source 1..20: mol_type = genomic DNA
tttcacgttagcatttcatt

SEQ ID NO: 51483 - DNA, 196 bp, Homo sapiens; identical to SEQ ID NO: 30700
  misc_feature 1..196: note = chr6:100066823-100067019
  misc_feature 1..196: note = hyper
  source 1..196: mol_type = genomic DNA

SEQ ID NO: 51484 - DNA, 283 bp, Homo sapiens; identical to SEQ ID NO: 30701
  misc_feature 1..283: note = chr6:100067144-100067427
  misc_feature 1..283: note = hyper
  source 1..283: mol_type = genomic DNA

SEQ ID NO: 51485 - skipped

SEQ ID NO: 51486 - DNA, 199 bp, Homo sapiens
  misc_feature 1..199: note = chr6:100441966-100442165
  misc_feature 1..199: note = hyper
  source 1..199: mol_type = genomic DNA
caggttgggagccagccccacctccatttccaaagcgggggtccaggcacaggaacagccaaacgcccgaaccagcggggttacctttgccacttcatccaatccgagcatcgggtgcgtcgtgctcttttctaggagcgtggggtgccttcgcgaataaaatctgaaggcatctctgctctcgcggagcttgttcttt

SEQ ID NO: 51487 - DNA, 169 bp, Homo sapiens; identical to SEQ ID NO: 30705
  misc_feature 1..169: note = chr6:100729528-100729697
  misc_feature 1..169: note = hyper
  source 1..169: mol_type = genomic DNA

SEQ ID NO: 51488 - DNA, 37 bp, Homo sapiens
  misc_feature 1..37: note = chr6:100903347-100903384
  misc_feature 1..37: note = hyper
  source 1..37: mol_type = genomic DNA
caacctattctccttcgtttctgtcacgacctgctct

SEQ ID NO: 51489 - DNA, 150 bp, Homo sapiens
  misc_feature 1..150: note = chr6:100903631-100903781
  misc_feature 1..150: note = hyper
  source 1..150: mol_type = genomic DNA
ctcgcgcggttcccgaagggtgcgaagactgcgctgagcattttgaaggcctcccaaagcggctggaagacaccccgaagcggcctcccaaccagaatgatctgaaaatcccccaggctgggctcgggataaatactagttctgaactcc

SEQ ID NO: 51490 - DNA, 382 bp, Homo sapiens
  misc_feature 1..382: note = chr6:100903832-100904214
  misc_feature 1..382: note = hyper
  source 1..382: mol_type = genomic DNA
cgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgaggg

SEQ ID NO: 51491 - DNA, 167 bp, Homo sapiens
  misc_feature 1..167: note = chr6:100904275-100904442
  misc_feature 1..167: note = hyper
  source 1..167: mol_type = genomic DNA
tgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaa

SEQ ID NO: 51492 - DNA, 76 bp, Homo sapiens; identical to SEQ ID NO: 30709
  misc_feature 1..76: note = chr6:100905783-100905859
  misc_feature 1..76: note = hyper
  source 1..76: mol_type = genomic DNA

SEQ ID NO: 51493 - DNA, 50 bp, Homo sapiens
  misc_feature 1..50: note = chr6:100905919-100905969
  misc_feature 1..50: note = hyper
  source 1..50: mol_type = genomic DNA
ctctctctctctctctctctctctctctgccttcgcggagctccagccct

SEQ ID NO: 51494 - DNA, 151 bp, Homo sapiens
  misc_feature 1..151: note = chr6:100906016-100906167
  misc_feature 1..151: note = hyper
  source 1..151: mol_type = genomic DNA
gcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactc

SEQ ID NO: 51495 - DNA, 302 bp, Homo sapiens
  misc_feature 1..302: note = chr6:100912119-100912421
  misc_feature 1..302: note = hyper
  source 1..302: mol_type = genomic DNA
cgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcgg

SEQ ID NO: 51496 - DNA, 109 bp, Homo sapiens
  misc_feature 1..109: note = chr6:100912480-100912589
  misc_feature 1..109: note = hyper
  source 1..109: mol_type = genomic DNA
ttcacctaccttcagtccccacaagcggcagaggtttcgggggcgcccatctcttaactgttctcatgcctaccgtccaacccagcgacaccgccggcctctccgcttc

SEQ ID NO: 51497 - DNA, 29 bp, Homo sapiens
  misc_feature 1..29: note = chr6:100912890-100912919
  misc_feature 1..29: note = hyper
  source 1..29: mol_type = genomic DNA
cggccaggggcgaggcgctcattggccaa

SEQ ID NO: 51498 - DNA, 30 bp, Homo sapiens; identical to SEQ ID NO: 30714
  misc_feature 1..30: note = chr6:100914823-100914853
  misc_feature 1..30: note = hyper
  source 1..30: mol_type = genomic DNA

SEQ ID NO: 51499 - DNA, 30 bp, Homo sapiens; identical to SEQ ID NO: 8634
  misc_feature 1..30: note = chr6:100915720-100915750
  misc_feature 1..30: note = hyper
  source 1..30: mol_type = genomic DNA

SEQ ID NO: 51500 - DNA, 100 bp, Homo sapiens; identical to SEQ ID NO: 30716
  misc_feature 1..100: note = chr6:100917210-100917310
  misc_feature 1..100: note = hyper
  source 1..100: mol_type = genomic DNA

SEQ ID NO: 51501 - DNA, 1154 bp, Homo sapiens
  misc_feature 1..1154: note = chr6:101840820-101841974
  misc_feature 1..1154: note = hyper
  source 1..1154: mol_type = genomic DNA
gagaggggagtctgctatttaaggcgccatacatacacagagacagcccgcccgacctcctaacactcaggaaaagtcaatttccaagcatctgttctcaataatggtggcagggagcagggcactgtgactcccagcatctgagggaatacccgcagcagcgctaccagagcgcatttgctctatgcgctggaggtcggggtgggagggtgcgcagatcaagatctttttttgcgaacctcagggaaatgaccgtagttggactaagaggtccactttggagactaccagcagccctccaagccctggcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtctagggacaccaggaattctctcgctctagctcctgtggtccaggggtgggagatgcccccgagtggccgcggcggccaggagcgtgcaggggccacggggaaaggagcgcggcgcctttaaagcaagaggcgaggaacccccgccaggaggcgtgtctgtctctgccgccgccgccgccgctgctgctcctcggtcaccgtcttcgccgctgccgtcactcgcgctcggcgccggcggctgcgctggtcggtctggtagctggggacttttccgcccgacctcctccggctgctcctccccgaggaccaccccaccccctccccgcccacctcacccctagctccaggtaaggactccccggctgtgggctgcactccgggctccttcacgaggtgtttgttttcaagaggacgggagggactgcgggtgggcgaggggcattttccacctggagagaaggaagaaggcgaacagtagcgctgcggacgtccgtgcgctcggggcgcccgctggacggattcactgcgagtctttgtcgggcttatctcagccaattcccgtcaagcatgcaagtggctctgttggctgcagtcgcctatgttctcca

SEQ ID NO: 51502 - DNA, 162 bp, Homo sapiens
  misc_feature 1..162: note = chr6:101849985-101850147
  misc_feature 1..162: note = hyper
  source 1..162: mol_type = genomic DNA
gtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacac

SEQ ID NO: 51503 - DNA, 15 bp, Homo sapiens
  misc_feature 1..15: note = chr6:101850524-101850539
  misc_feature 1..15: note = hyper
  source 1..15: mol_type = genomic DNA
tcctgggtgcccacc

SEQ ID NO: 51504 - DNA, 155 bp, Homo sapiens
  misc_feature 1..155: note = chr6:105401007-105401162
  misc_feature 1..155: note = hyper
  source 1..155: mol_type = genomic DNA
agagatcttgccaggggcagagagagatcccgaaaatcgcccccagccttgcgtccagccctttctcgccgacgttttttcttgatcctccgaaggcccagggcgacgtttgccatcgcggcttcccgaaaggacggcgccgggtttgctggaag

SEQ ID NO: 51505 - DNA, 39 bp, Homo sapiens
  misc_feature 1..39: note = chr6:105401581-105401620
  misc_feature 1..39: note = hyper
  source 1..39: mol_type = genomic DNA
tggggtctcaggtctcggccgcctggggagcgacctgcc

SEQ ID NO: 51506 - DNA, 55 bp, Homo sapiens; identical to SEQ ID NO: 19379
  misc_feature 1..55: note = chr6:105404519-105404574
  misc_feature 1..55: note = hyper
  source 1..55: mol_type = genomic DNA

SEQ ID NO: 51507 - DNA, 30 bp, Homo sapiens; identical to SEQ ID NO: 30724
  misc_feature 1..30: note = chr6:105404921-105404951
  misc_feature 1..30: note = hyper
  source 1..30: mol_type = genomic DNA

SEQ ID NO: 51508 - DNA, 80 bp, Homo sapiens
  misc_feature 1..80: note = chr6:105405576-105405656
  misc_feature 1..80: note = hyper
  source 1..80: mol_type = genomic DNA
tttcctcctcgtgcccgccggagagaatagtttcgctgaaaatttctctttgtcaatgggatcagtattaaatcagcaat

SEQ ID NO: 51509 - DNA, 326 bp, Homo sapiens
  misc_feature 1..326: note = chr6:105405772-105406098
  misc_feature 1..326: note = hyper
  source 1..326: mol_type = genomic DNA
gcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattc

SEQ ID NO: 51510 - DNA, 337 bp, Homo sapiens
  misc_feature 1..337: note = chr6:105406128-105406465
  misc_feature 1..337: note = hyper
  source 1..337: mol_type = genomic DNA
ttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatac

SEQ ID NO: 51511 - DNA, 139 bp, Homo sapiens; identical to SEQ ID NO: 30726
  misc_feature 1..139: note = chr6:105584077-105584216
  misc_feature 1..139: note = hyper
  source 1..139: mol_type = genomic DNA

SEQ ID NO: 51512 - DNA, 47 bp, Homo sapiens; identical to SEQ ID NO: 19383
  misc_feature 1..47: note = chr6:105584217-105584264
  misc_feature 1..47: note = hyper
  source 1..47: mol_type = genomic DNA

SEQ ID NO: 51513 - DNA, 34 bp, Homo sapiens
  misc_feature 1..34: note = chr6:105585554-105585588
  misc_feature 1..34: note = hyper
  source 1..34: mol_type = genomic DNA
ggggtcaggcctcctgctgcggaggaagaggggg

SEQ ID NO: 51514 - DNA, 709 bp, Homo sapiens; identical to SEQ ID NO: 30730
  misc_feature 1..709: note = chr6:105627368-105628077
  misc_feature 1..709: note = hyper
  source 1..709: mol_type = genomic DNA

SEQ ID NO: 51515 - DNA, 46 bp, Homo sapiens
  misc_feature 1..46: note = chr6:106429003-106429049
  misc_feature 1..46: note = hyper
  source 1..46: mol_type = genomic DNA
aaactgctatgaattcggtgactgtgcaatgaaattgtcaattatc

SEQ ID NO: 51516 - DNA, 127 bp, Homo sapiens; identical to SEQ ID NO: 30733
  misc_feature 1..127: note = chr6:106434152-106434279
  misc_feature 1..127: note = hyper
  source 1..127: mol_type = genomic DNA

SEQ ID NO: 51517 - DNA, 56 bp, Homo sapiens
  misc_feature 1..56: note = chr6:106441813-106441869
  misc_feature 1..56: note = hyper
  source 1..56: mol_type = genomic DNA
aatgaattgcagagtcggatacagctaatttgggggaatgtaagctggatgtcttt

SEQ ID NO: 51518 - DNA, 141 bp, Homo sapiens; identical to SEQ ID NO: 19387
  misc_feature 1..141: note = chr6:106442979-106443120
  misc_feature 1..141: note = hyper
  source 1..141: mol_type = genomic DNA

SEQ ID NO: 51519 - DNA, 69 bp, Homo sapiens; identical to SEQ ID NO: 30735
  misc_feature 1..69: note = chr6:106809115-106809184
  misc_feature 1..69: note = hyper
  source 1..69: mol_type = genomic DNA

SEQ ID NO: 51520 - DNA, 97 bp, Homo sapiens; identical to SEQ ID NO: 30736
  misc_feature 1..97: note = chr6:106958240-106958337
  misc_feature 1..97: note = hyper
  source 1..97: mol_type = genomic DNA

SEQ ID NO: 51521 - DNA, 83 bp, Homo sapiens; identical to SEQ ID NO: 30737
  misc_feature 1..83: note = chr6:106960311-106960394
  misc_feature 1..83: note = hyper
  source 1..83: mol_type = genomic DNA

SEQ ID NO: 51522 - DNA, 241 bp, Homo sapiens
  misc_feature 1..241: note = chr6:106960667-106960908
  misc_feature 1..241: note = hyper
  source 1..241: mol_type = genomic DNA
gcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagt

SEQ ID NO: 51523 - DNA, 77 bp, Homo sapiens; identical to SEQ ID NO: 30739
  misc_feature 1..77: note = chr6:107809976-107810053
  misc_feature 1..77: note = hyper
  source 1..77: mol_type = genomic DNA

SEQ ID NO: 51524 - DNA, 133 bp, Homo sapiens
  misc_feature 1..133: note = chr6:108434942-108435075
  misc_feature 1..133: note = hyper
  source 1..133: mol_type = genomic DNA
tggtcagcccaagggcgagatgcgcctcggggtcggagtcgcccgagtggagactggacactccatgggggaggctggaaccccctgtgccacagataaatgctcgttctccaccacatgtgaggcatttgaa

SEQ ID NO: 51525 - DNA, 261 bp, Homo sapiens; identical to SEQ ID NO: 19390
  misc_feature 1..261: note = chr6:108436526-108436787
  misc_feature 1..261: note = hyper
  source 1..261: mol_type = genomic DNA

SEQ ID NO: 51526 - DNA, 33 bp, Homo sapiens; identical to SEQ ID NO: 30742
  misc_feature 1..33: note = chr6:108438124-108438157
  misc_feature 1..33: note = hyper
  source 1..33: mol_type = genomic DNA

SEQ ID NO: 51527 - DNA, 98 bp, Homo sapiens; identical to SEQ ID NO: 30744
  misc_feature 1..98: note = chr6:108438779-108438877
  misc_feature 1..98: note = hyper
  source 1..98: mol_type = genomic DNA

SEQ ID NO: 51528 - DNA, 596 bp, Homo sapiens
  misc_feature 1..596: note = chr6:108439495-108440091
  misc_feature 1..596: note = hyper
  source 1..596: mol_type = genomic DNA
gtagcagaaaggaatcgaggcccccgtccataatcgcaggtgtcggcgtggaaaggagccacgcgtgcacactcatgggtctcaccgcgcgggcttccgcggcccggcaagccgctgcgcctgcctcgccggcggcccacggagcccgtccgcgcttgccctgcacacctgcgcccgcgcgaggacccagccgccgaggccgtgcgcccgccgggctgcgggggccgtgggcagggggcgcagggggcgcagggggcggccggcgcggcggctgaacccgggctgacgaggcccagccgcctgcggggcccggagcgggaggtaccggctaggggcgcgtttctttcgcatccacaccccgcccccacccctctctccagggattttttttttttttttttttgtatccaggcacagctgggggctccctcaccacccacccctggcctccccatacagaataaagtcagtctgtatttaatggttatggcggatgtgagggggatttggcagaggcagaagagaggcctttcgctctcaaatatcgtcccttacgtcgtgtgagtctaccaacccaccacgacctcatattcttg

SEQ ID NO: 51529 - skipped

SEQ ID NO: 51530 - DNA, 484 bp, Homo sapiens
  misc_feature 1..484: note = chr6:108478806-108479290
  misc_feature 1..484: note = hyper
  source 1..484: mol_type = genomic DNA
gtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctg

SEQ ID NO: 51531 - DNA, 31 bp, Homo sapiens; identical to SEQ ID NO: 19396
  misc_feature 1..31: note = chr6:108479665-108479696
  misc_feature 1..31: note = hyper
  source 1..31: mol_type = genomic DNA

SEQ ID NO: 51532 - DNA, 37 bp, Homo sapiens; identical to SEQ ID NO: 19397
  misc_feature 1..37: note = chr6:108484872-108484909
  misc_feature 1..37: note = hyper
  source 1..37: mol_type = genomic DNA

SEQ ID NO: 51533 - DNA, 152 bp, Homo sapiens; identical to SEQ ID NO: 19398
  misc_feature 1..152: note = chr6:108485513-108485665
  misc_feature 1..152: note = hyper
  source 1..152: mol_type = genomic DNA

SEQ ID NO: 51534 - DNA, 102 bp, Homo sapiens; identical to SEQ ID NO: 19399
  misc_feature 1..102: note = chr6:108485905-108486007
  misc_feature 1..102: note = hyper
  source 1..102: mol_type = genomic DNA

SEQ ID NO: 51535 - DNA, 150 bp, Homo sapiens; identical to SEQ ID NO: 19400
  misc_feature 1..150: note = chr6:108486008-108486158
  misc_feature 1..150: note = hyper
  source 1..150: mol_type = genomic DNA

SEQ ID NO: 51536 - DNA, 70 bp, Homo sapiens
  misc_feature 1..70: note = chr6:108486394-108486464
  misc_feature 1..70: note = hyper
  source 1..70: mol_type = genomic DNA
cagcgccgcgcacagagcaaggcgcgagagagctcaggaatcgcgggaaggcaagcggaatggggagggg

SEQ ID NO: 51537 - DNA, 160 bp, Homo sapiens; identical to SEQ ID NO: 30751
  misc_feature 1..160: note = chr6:108486846-108487006
  misc_feature 1..160: note = hyper
  source 1..160: mol_type = genomic DNA

SEQ ID NO: 51538 - skipped

SEQ ID NO: 51539 - DNA, 63 bp, Homo sapiens; identical to SEQ ID NO: 30753
  misc_feature 1..63: note = chr6:108487419-108487482
  misc_feature 1..63: note = hyper
  source 1..63: mol_type = genomic DNA

SEQ ID NO: 51540 - DNA, 110 bp, Homo sapiens
  misc_feature 1..110: note = chr6:108488416-108488526
  misc_feature 1..110: note = hyper
  source 1..110: mol_type = genomic DNA
atgctttgcaccccgtttctagctatttcaaataatcctgcaaactgggaagcagaaacaatttaaaagtcacattttccttaatcctaaatccgcgtaggtcataactg

SEQ ID NO: 51541 - DNA, 345 bp, Homo sapiens
  misc_feature 1..345: note = chr6:108490633-108490978
  misc_feature 1..345: note = hyper
  source 1..345: mol_type = genomic DNA
gaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgc

SEQ ID NO: 51542 - DNA, 19 bp, Homo sapiens
  misc_feature 1..19: note = chr6:108492251-108492270
  misc_feature 1..19: note = hyper
  source 1..19: mol_type = genomic DNA
tcaagtttgtctcctcgcg

SEQ ID NO: 51543 - DNA, 90 bp, Homo sapiens; identical to SEQ ID NO: 19405
  misc_feature 1..90: note = chr6:108492451-108492541
  misc_feature 1..90: note = hyper
  source 1..90: mol_type = genomic DNA

SEQ ID NO: 51544 - DNA, 42 bp, Homo sapiens
  misc_feature 1..42: note = chr6:108495639-108495681
  misc_feature 1..42: note = hyper
  source 1..42: mol_type = genomic DNA
tctctggggccaagtcgctgtcttcggtcctgaagtctcgtc

SEQ ID NO: 51545 - DNA, 257 bp, Homo sapiens; identical to SEQ ID NO: 19406
  misc_feature 1..257: note = chr6:108495951-108496208
  misc_feature 1..257: note = hyper
  source 1..257: mol_type = genomic DNA

SEQ ID NO: 51546 - DNA, 173 bp, Homo sapiens; identical to SEQ ID NO: 30763
  misc_feature 1..173: note = chr6:108497294-108497467
  misc_feature 1..173: note = hyper
  source 1..173: mol_type = genomic DNA

SEQ ID NO: 51547 - DNA, 185 bp, Homo sapiens; identical to SEQ ID NO: 30764
  misc_feature 1..185: note = chr6:110299509-110299694
  misc_feature 1..185: note = hyper
  source 1..185: mol_type = genomic DNA

SEQ ID NO: 51548 - DNA, 30 bp, Homo sapiens; identical to SEQ ID NO: 30765
  misc_feature 1..30: note = chr6:110299948-110299978
  misc_feature 1..30: note = hyper
  source 1..30: mol_type = genomic DNA

SEQ ID NO: 51549 - DNA, 232 bp, Homo sapiens
  misc_feature 1..232: note = chr6:110678891-110679123
  misc_feature 1..232: note = hyper
  source 1..232: mol_type = genomic DNA
cggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctgg

SEQ ID NO: 51550 - DNA, 285 bp, Homo sapiens
  misc_feature 1..285: note = chr6:110679414-110679699
  misc_feature 1..285: note = hyper
  source 1..285: mol_type = genomic DNA
ccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggcc

SEQ ID NO: 51551 - DNA, 188 bp, Homo sapiens
  misc_feature 1..188: note = chr6:110797490-110797678
  misc_feature 1..188: note = hyper
  source 1..188: mol_type = genomic DNA
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagaccc

SEQ ID NO: 51552 - DNA, 12 bp, Homo sapiens
  misc_feature 1..12: note = chr6:110797708-110797720
  misc_feature 1..12: note = hyper
  source 1..12: mol_type = genomic DNA
ggcccctccccc

SEQ ID NO: 51553 - DNA, 217 bp, Homo sapiens; identical to SEQ ID NO: 30769
  misc_feature 1..217: note = chr6:111409641-111409858
  misc_feature 1..217: note = hyper
  source 1..217: mol_type = genomic DNA

SEQ ID NO: 51554 - DNA, 167 bp, Homo sapiens; identical to SEQ ID NO: 30770
  misc_feature 1..167: note = chr6:114663194-114663361
  misc_feature 1..167: note = hyper
  source 1..167: mol_type = genomic DNA

SEQ ID NO: 51555 - DNA, 37 bp, Homo sapiens; identical to SEQ ID NO: 30771
  misc_feature 1..37: note = chr6:114663777-114663814
  misc_feature 1..37: note = hyper
  source 1..37: mol_type = genomic DNA

SEQ ID NO: 51556 - DNA, 53 bp, Homo sapiens; identical to SEQ ID NO: 30772
  misc_feature 1..53: note = chr6:116783514-116783567
  misc_feature 1..53: note = hyper
  source 1..53: mol_type = genomic DNA

SEQ ID NO: 51557 - DNA, 48 bp, Homo sapiens; identical to SEQ ID NO: 30773
  misc_feature 1..48: note = chr6:116937976-116938024
  misc_feature 1..48: note = hyper
  source 1..48: mol_type = genomic DNA

SEQ ID NO: 51558 - DNA, 10 bp, Homo sapiens
  misc_feature 1..10: note = chr6:117086239-117086249
  misc_feature 1..10: note = hyper
  source 1..10: mol_type = genomic DNA
gaaggtgggt

SEQ ID NO: 51559 - DNA, 32 bp, Homo sapiens; identical to SEQ ID NO: 30776
  misc_feature 1..32: note = chr6:117197673-117197705
  misc_feature 1..32: note = hyper
  source 1..32: mol_type = genomic DNA

SEQ ID NO: 51560 - skipped

SEQ ID NO: 51561 - DNA, 30 bp, Homo sapiens; identical to SEQ ID NO: 30778
  misc_feature 1..30: note = chr6:117198544-117198574
  misc_feature 1..30: note = hyper
  source 1..30: mol_type = genomic DNA

SEQ ID NO: 51562 - DNA, 85 bp, Homo sapiens
  misc_feature 1..85: note = chr6:117585882-117585967
  misc_feature 1..85: note = hyper
  source 1..85: mol_type = genomic DNA
gaaaagccagacatccgaggccgggtaaagcctcctggactcctcgaaagcagctcacaccgggagcagccggaagcgggcgcga

SEQ ID NO: 51563 - DNA, 194 bp, Homo sapiens
  misc_feature 1..194: note = chr6:117586004-117586198
  misc_feature 1..194: note = hyper
  source 1..194: mol_type = genomic DNA
aagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggta

SEQ ID NO: 51564 - DNA, 243 bp, Homo sapiens; identical to SEQ ID NO: 30780
  misc_feature 1..243: note = chr6:117586401-117586644
  misc_feature 1..243: note = hyper
  source 1..243: mol_type = genomic DNA

SEQ ID NO: 51565 - DNA, 121 bp, Homo sapiens
  misc_feature 1..121: note = chr6:117587169-117587290
  misc_feature 1..121: note = hyper
  source 1..121: mol_type = genomic DNA
gtgcaattagctaacccctttagctcgcctgtttgctctcgggaagcagctaagccctgctaatgtgagcctaggtcttccctggaataatcagaggaagatggcacgggctggattttct

SEQ ID NO: 51566 - DNA, 71 bp, Homo sapiens
  misc_feature 1..71: note = chr6:117587577-117587648
  misc_feature 1..71: note = hyper
  source 1..71: mol_type = genomic DNA
ttttcctttgcgaagttctgggagcattatccggagtgcgaatgacccggcagaggcgagcctgatagaca

SEQ ID NO: 51567 - DNA, 205 bp, Homo sapiens; identical to SEQ ID NO: 19416
  misc_feature 1..205: note = chr6:117591206-117591411
  misc_feature 1..205: note = hyper
  source 1..205: mol_type = genomic DNA

SEQ ID NO: 51568 - DNA, 107 bp, Homo sapiens
  misc_feature 1..107: note = chr6:117591743-117591850
  misc_feature 1..107: note = hyper
  source 1..107: mol_type = genomic DNA
tccttctggaatagcgcgtaccaggcgccagtgcccccgccgctgggcagccctctggccaccgcgcactcggagctgcccttcgccgccgccgacccctactcgcc

SEQ ID NO: 51569 - DNA, 72 bp, Homo sapiens; identical to SEQ ID NO: 30785
  misc_feature 1..72: note = chr6:117592066-117592138
  misc_feature 1..72: note = hyper
  source 1..72: mol_type = genomic DNA

SEQ ID NO: 51570 - DNA, 58 bp, Homo sapiens
  misc_feature 1..58: note = chr6:118228044-118228102
  misc_feature 1..58: note = hyper
  source 1..58: mol_type = genomic DNA
tttgggtttctaatccggggccggcacctgtctcggcgtcctgccgctgtcccaggcc

SEQ ID NO: 51571 - DNA, 81 bp, Homo sapiens; identical to SEQ ID NO: 19419
  misc_feature 1..81: note = chr6:118228151-118228232
  misc_feature 1..81: note = hyper
  source 1..81: mol_type = genomic DNA

SEQ ID NO: 51572 - DNA, 424 bp, Homo sapiens
  misc_feature 1..424: note = chr6:118228323-118228747
  misc_feature 1..424: note = hyper
  source 1..424: mol_type = genomic DNA
cgcccgcgccccgctctgccgccgccgccgccgccgccgccgccgccgccggcgcccccgcccggctctccgggttcaccctcggtctctcactccgtgagacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctc

SEQ ID NO: 51573 - DNA, 41 bp, Homo sapiens; identical to SEQ ID NO: 19421
  misc_feature 1..41: note = chr6:118228828-118228869
  misc_feature 1..41: note = hyper
  source 1..41: mol_type = genomic DNA

SEQ ID NO: 51574 - DNA, 284 bp, Homo sapiens; identical to SEQ ID NO: 19422
  misc_feature 1..284: note = chr6:118228870-118229154
  misc_feature 1..284: note = hyper
  source 1..284: mol_type = genomic DNA

SEQ ID NO: 51575 - skipped

SEQ ID NO: 51576 - DNA, 32 bp, Homo sapiens
  misc_feature 1..32: note = chr6:118229818-118229850
  misc_feature 1..32: note = hyper
  source 1..32: mol_type = genomic DNA
atgaggacctgggttgacgtgaaaatgggggt

SEQ ID NO: 51577 - DNA, 223 bp, Homo sapiens
  misc_feature 1..223: note = chr6:118241005-118241228
  misc_feature 1..223: note = hyper
  source 1..223: mol_type = genomic DNA
tcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtgga

SEQ ID NO: 51578 - DNA, 128 bp, Homo sapiens; identical to SEQ ID NO: 30792
  misc_feature 1..128: note = chr6:119399076-119399204
  misc_feature 1..128: note = hyper
  source 1..128: mol_type = genomic DNA

SEQ ID NO: 51579 - DNA, 51 bp, Homo sapiens
  misc_feature 1..51: note = chr6:121758621-121758672
  misc_feature 1..51: note = hyper
  source 1..51: mol_type = genomic DNA
gttcctgaaacttcccgagaatgaggcggggcggctcaaggggaaagggca

SEQ ID NO: 51580 - DNA, 250 bp, Homo sapiens; identical to SEQ ID NO: 30794
  misc_feature 1..250: note = chr6:122932220-122932470
  misc_feature 1..250: note = hyper
  source 1..250: mol_type = genomic DNA

SEQ ID NO: 51581 - DNA, 114 bp, Homo sapiens; identical to SEQ ID NO: 30795
  misc_feature 1..114: note = chr6:123316893-123317007
  misc_feature 1..114: note = hyper
  source 1..114: mol_type = genomic DNA

SEQ ID NO: 51582 - DNA, 125 bp, Homo sapiens; identical to SEQ ID NO: 19427
  misc_feature 1..125: note = chr6:123317589-123317714
  misc_feature 1..125: note = hyper
  source 1..125: mol_type = genomic DNA

SEQ ID NO: 51583 - DNA, 82 bp, Homo sapiens; identical to SEQ ID NO: 19428
  misc_feature 1..82: note = chr6:123317715-123317797
  misc_feature 1..82: note = hyper
  source 1..82: mol_type = genomic DNA

SEQ ID NO: 51584 - DNA, 38 bp, Homo sapiens; identical to SEQ ID NO: 19429
  misc_feature 1..38: note = chr6:123317833-123317871
  misc_feature 1..38: note = hyper
  source 1..38: mol_type = genomic DNA

SEQ ID NO: 51585 - DNA, 139 bp, Homo sapiens
  misc_feature 1..139: note = chr6:124124293-124124432
  misc_feature 1..139: note = hyper
  source 1..139: mol_type = genomic DNA
gccactcgggctttccggccgctctggatgcctcggttgcacccctgttccatgaccccagcttccttccctaaccctcctcttggtcccttctcccccgagcgcgcgcgcacacacacactcggttcgctcccgcgga

SEQ ID NO: 51586 - DNA, 394 bp, Homo sapiens
  misc_feature 1..394: note = chr6:124124466-124124860
  misc_feature 1..394: note = hyper
  source 1..394: mol_type = genomic DNA
aaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgc

SEQ ID NO: 51587 - DNA, 61 bp, Homo sapiens; identical to SEQ ID NO: 30799
  misc_feature 1..61: note = chr6:125282732-125282793
  misc_feature 1..61: note = hyper
  source 1..61: mol_type = genomic DNA

SEQ ID NO: 51588 - DNA, 269 bp, Homo sapiens; identical to SEQ ID NO: 8704
  misc_feature 1..269: note = chr6:125283133-125283402
  misc_feature 1..269: note = hyper
  source 1..269: mol_type = genomic DNA

SEQ ID NO: 51589 - DNA, 206 bp, Homo sapiens; identical to SEQ ID NO: 19434
  misc_feature 1..206: note = chr6:125283925-125284131
  misc_feature 1..206: note = hyper
  source 1..206: mol_type = genomic DNA

SEQ ID NO: 51590 - DNA, 200 bp, Homo sapiens; identical to SEQ ID NO: 30802
  misc_feature 1..200: note = chr6:125420809-125421009
  misc_feature 1..200: note = hyper
  source 1..200: mol_type = genomic DNA

SEQ ID NO: 51591 - DNA, 43 bp, Homo sapiens; identical to SEQ ID NO: 30803
  misc_feature 1..43: note = chr6:125475547-125475590
  misc_feature 1..43: note = hyper
  source 1..43: mol_type = genomic DNA

SEQ ID NO: 51592 - DNA, 168 bp, Homo sapiens; identical to SEQ ID NO: 30804
  misc_feature 1..168: note = chr6:125684529-125684697
  misc_feature 1..168: note = hyper
  source 1..168: mol_type = genomic DNA

SEQ ID NO: 51593 - DNA, 15 bp, Homo sapiens
  misc_feature 1..15: note = chr6:126068007-126068022
  misc_feature 1..15: note = hyper
  source 1..15: mol_type = genomic DNA
ctaagccttcccttt

SEQ ID NO: 51594 - DNA, 24 bp, Homo sapiens
  misc_feature 1..24: note = chr6:126068068-126068092
  misc_feature 1..24: note = hyper
  source 1..24: mol_type = genomic DNA
cgttccctcattctttctcttttc

SEQ ID NO: 51595 - DNA, 782 bp, Homo sapiens; identical to SEQ ID NO: 30807
  misc_feature 1..782: note = chr6:126068793-126069575
  misc_feature 1..782: note = hyper
  source 1..782: mol_type = genomic DNA

SEQ ID NO: 51596 - DNA, 137 bp, Homo sapiens; identical to SEQ ID NO: 30808
  misc_feature 1..137: note = chr6:126069805-126069942
  misc_feature 1..137: note = hyper
  source 1..137: mol_type = genomic DNA

SEQ ID NO: 51597 - DNA, 86 bp, Homo sapiens; identical to SEQ ID NO: 30809
  misc_feature 1..86: note = chr6:126071232-126071318
  misc_feature 1..86: note = hyper
  source 1..86: mol_type = genomic DNA

SEQ ID NO: 51598 - DNA, 83 bp, Homo sapiens; identical to SEQ ID NO: 30810
  misc_feature 1..83: note = chr6:127439190-127439273
  misc_feature 1..83: note = hyper
  source 1..83: mol_type = genomic DNA

SEQ ID NO: 51599 - DNA, 58 bp, Homo sapiens; identical to SEQ ID NO: 19443
  misc_feature 1..58: note = chr6:127439321-127439379
  misc_feature 1..58: note = hyper
  source 1..58: mol_type = genomic DNA

SEQ ID NO: 51600 - DNA, 34 bp, Homo sapiens; identical to SEQ ID NO: 19444
  misc_feature 1..34: note = chr6:127439453-127439487
  misc_feature 1..34: note = hyper
  source 1..34: mol_type = genomic DNA

SEQ ID NO: 51601 - DNA, 202 bp, Homo sapiens
  misc_feature 1..202: note = chr6:127439783-127439985
  misc_feature 1..202: note = hyper
  source 1..202: mol_type = genomic DNA
cctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccg

SEQ ID NO: 51602 - DNA, 204 bp, Homo sapiens
  misc_feature 1..204: note = chr6:127440127-127440331
  misc_feature 1..204: note = hyper
  source 1..204: mol_type = genomic DNA
ggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgg

SEQ ID NO: 51603 - DNA, 431 bp, Homo sapiens; identical to SEQ ID NO: 19447
  misc_feature 1..431: note = chr6:127441123-127441554
  misc_feature 1..431: note = hyper
  source 1..431: mol_type = genomic DNA

SEQ ID NO: 51604 - DNA, 259 bp, Homo sapiens
  misc_feature 1..259: note = chr6:127441762-127442021
  misc_feature 1..259: note = hyper
  source 1..259: mol_type = genomic DNA
gtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactcccca

SEQ ID NO: 51605 - DNA, 175 bp, Homo sapiens; identical to SEQ ID NO: 19448
  misc_feature 1..175: note = chr6:127442104-127442279
  misc_feature 1..175: note = hyper
  source 1..175: mol_type = genomic DNA

SEQ ID NO: 51606 - DNA, 50 bp, Homo sapiens; identical to SEQ ID NO: 30816
  misc_feature 1..50: note = chr6:127442649-127442699
  misc_feature 1..50: note = hyper
  source 1..50: mol_type = genomic DNA

SEQ ID NO: 51607 - DNA, 30 bp, Homo sapiens; identical to SEQ ID NO: 30817
  misc_feature 1..30: note = chr6:127836173-127836203
  misc_feature 1..30: note = hyper
  source 1..30: mol_type = genomic DNA

SEQ ID NO: 51608 - DNA, 907 bp, Homo sapiens; identical to SEQ ID NO: 30818
  misc_feature 1..907: note = chr6:127836715-127837622
  misc_feature 1..907: note = hyper
  source 1..907: mol_type = genomic DNA

SEQ ID NO: 51609 - DNA, 15 bp, Homo sapiens
  misc_feature 1..15: note = chr6:127839806-127839821
  misc_feature 1..15: note = hyper
  source 1..15: mol_type = genomic DNA
tattgtgcctttctg

SEQ ID NO: 51610 - DNA, 68 bp, Homo sapiens; identical to SEQ ID NO: 30820
  misc_feature 1..68: note = chr6:127839929-127839997
  misc_feature 1..68: note = hyper
  source 1..68: mol_type = genomic DNA

SEQ ID NO: 51611 - DNA, 145 bp, Homo sapiens
  misc_feature 1..145: note = chr6:127840356-127840501
  misc_feature 1..145: note = hyper
  source 1..145: mol_type = genomic DNA
gctttgtcctgggttcggtcattctccatcaattatttacttgagcttcttttccaaggaggcggactagaacagccttccgggcgtgactaacatctcctgatgcagctggctggcggctgctgggagttctctttgttcactc

SEQ ID NO: 51612 - DNA, 12 bp, Homo sapiens
  misc_feature 1..12: note = chr6:127840681-127840693
  misc_feature 1..12: note = hyper
  source 1..12: mol_type = genomic DNA
cccacagagatc

SEQ ID NO: 51613 - DNA, 99 bp, Homo sapiens
  misc_feature 1..99: note = chr6:129204360-129204459
  misc_feature 1..99: note = hyper
  source 1..99: mol_type = genomic DNA
cgagaagtggatccggtcgcggccactacgatgccgggagccgccggggtcctcctccttctgctgctctccggaggcctcgggggcgtacaggcgcag

SEQ ID NO: 51614 - DNA, 112 bp, Homo sapiens
  misc_feature 1..112: note = chr6:129204524-129204636
  misc_feature 1..112: note = hyper
  source 1..112: mol_type = genomic DNA
ggttgcatcctttgccgggaccgagattcctcacttcttccactcttccgagagttgctgtctgtggactgccgtcttgcttcgccttcagagagtgcgctctggggcaaga

SEQ ID NO: 51615 - DNA, 30 bp, Homo sapiens; identical to SEQ ID NO: 30823
  misc_feature 1..30: note = chr6:130088257-130088287
  misc_feature 1..30: note = hyper
  source 1..30: mol_type = genomic DNA

SEQ ID NO: 51616 - DNA, 55 bp, Homo sapiens; identical to SEQ ID NO: 30824
  misc_feature 1..55: note = chr6:130339629-130339684
  misc_feature 1..55: note = hyper
  source 1..55: mol_type = genomic DNA

SEQ ID NO: 51617 - DNA, 127 bp, Homo sapiens
  misc_feature 1..127: note = chr6:130686407-130686534
  misc_feature 1..127: note = hyper
  source 1..127: mol_type = genomic DNA
ttggagtcgaacatccgcactgctcatcgaagacccccgtgcttcagttccctctgtcttccatttcccccgcccatggttctcgcccccccaagccgttctccggaaccccttgccgggccggcgg

SEQ ID NO: 51618 - DNA, 136 bp, Homo sapiens; identical to SEQ ID NO: 19453
  misc_feature 1..136: note = chr6:130687057-130687193
  misc_feature 1..136: note = hyper
  source 1..136: mol_type = genomic DNA

SEQ ID NO: 51619 - DNA, 625 bp, Homo sapiens; identical to SEQ ID NO: 30826
  misc_feature 1..625: note = chr6:130687224-130687849
  misc_feature 1..625: note = hyper
  source 1..625: mol_type = genomic DNA

SEQ ID NO: 51620 - DNA, 30 bp, Homo sapiens; identical to SEQ ID NO: 30827
  misc_feature 1..30: note = chr6:131602928-131602958
  misc_feature 1..30: note = hyper
  source 1..30: mol_type = genomic DNA

SEQ ID NO: 51621 - DNA, 30 bp, Homo sapiens; identical to SEQ ID NO: 30828
  misc_feature 1..30: note = chr6:132271740-132271770
  misc_feature 1..30: note = hyper
  source 1..30: mol_type = genomic DNA

SEQ ID NO: 51622 - DNA, 820 bp, Homo sapiens
  misc_feature 1..820: note = chr6:132722196-132723016
  misc_feature 1..820: note = hyper
  source 1..820: mol_type = genomic DNA
tgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtggg

SEQ ID NO: 51623 - DNA, 198 bp, Homo sapiens
  misc_feature 1..198: note = chr6:133562070-133562268
  misc_feature 1..198: note = hyper
  source 1..198: mol_type = genomic DNA
agaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacg

SEQ ID NO: 51624 - DNA, 26 bp, Homo sapiens
  misc_feature 1..26: note = chr6:133562348-133562374
  misc_feature 1..26: note = hyper
  source 1..26: mol_type = genomic DNA
cgcgtccctggcggcctcccccgagg

SEQ ID NO: 51625 - DNA, 37 bp, Homo sapiens
  misc_feature 1..37: note = chr6:133563058-133563095
  misc_feature 1..37: note = hyper
  source 1..37: mol_type = genomic DNA
cttggaggccgggtgccccacgcctgagggcccgggc

SEQ ID NO: 51626 - DNA, 170 bp, Homo sapiens
  misc_feature 1..170: note = chr6:133563157-133563327
  misc_feature 1..170: note = hyper
  source 1..170: mol_type = genomic DNA
cgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgacccc

SEQ ID NO: 51627 - DNA, 184 bp, Homo sapiens
  misc_feature 1..184: note = chr6:133563918-133564102
  misc_feature 1..184: note = hyper
  source 1..184: mol_type = genomic DNA
gtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtc

SEQ ID NO: 51628 - DNA, 46 bp, Homo sapiens; identical to SEQ ID NO: 30835
  misc_feature 1..46: note = chr6:134175969-134176015
  misc_feature 1..46: note = hyper
  source 1..46: mol_type = genomic DNA

SEQ ID NO: 51629 - DNA, 76 bp, Homo sapiens; identical to SEQ ID NO: 30838
  misc_feature 1..76: note = chr6:134212320-134212396
  misc_feature 1..76: note = hyper
  source 1..76: mol_type = genomic DNA

SEQ ID NO: 51630 - DNA, 97 bp, Homo sapiens; identical to SEQ ID NO: 8736
  misc_feature 1..97: note = chr6:134216904-134217001
  misc_feature 1..97: note = hyper
  source 1..97: mol_type = genomic DNA

SEQ ID NO: 51631 - DNA, 91 bp, Homo sapiens; identical to SEQ ID NO: 30841
  misc_feature 1..91: note = chr6:134217370-134217461
  misc_feature 1..91: note = hyper
  source 1..91: mol_type = genomic DNA

SEQ ID NO: 51632 - DNA, 299 bp, Homo sapiens; identical to SEQ ID NO: 30842
  misc_feature 1..299: note = chr6:134499553-134499852
  misc_feature 1..299: note = hyper
  source 1..299: mol_type = genomic DNA

SEQ ID NO: 51633 - DNA, 224 bp, Homo sapiens
  misc_feature 1..224: note = chr6:134638726-134638950
  misc_feature 1..224: note = hyper
  source 1..224: mol_type = genomic DNA
gctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagct

SEQ ID NO: 51634 - DNA, 110 bp, Homo sapiens
  misc_feature 1..110: note = chr6:137241818-137241928
  misc_feature 1..110: note = hyper
  source 1..110: mol_type = genomic DNA
ctttggctgaagtgtcgcgttcagcacagaggtggaagtaagaggcagaaaacagaagaaccacgagagaaatggatcctgtctattaaggcaacgtgatgcagcgctaa

SEQ ID NO: 51635 - DNA, 395 bp, Homo sapiens
  misc_feature 1..395: note = chr6:137242205-137242600
  misc_feature 1..395: note = hyper
  source 1..395: mol_type = genomic DNA
tctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttc

SEQ ID NO: 51636 - DNA, 259 bp, Homo sapiens
  misc_feature 1..259: note = chr6:137242949-137243208
  misc_feature 1..259: note = hyper
  source 1..259: mol_type = genomic DNA
gctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcg

SEQ ID NO: 51637 - DNA, 68 bp, Homo sapiens; identical to SEQ ID NO: 30847
  misc_feature 1..68: note = chr6:137243566-137243634
  misc_feature 1..68: note = hyper
  source 1..68: mol_type = genomic DNA

SEQ ID NO: 51638 - DNA, 275 bp, Homo sapiens
  misc_feature 1..275: note = chr6:137243839-137244114
  misc_feature 1..275: note = hyper
  source 1..275: mol_type = genomic DNA
acgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagac

SEQ ID NO: 51639 - DNA, 67 bp, Homo sapiens; identical to SEQ ID NO: 30850
  misc_feature 1..67: note = chr6:137310875-137310942
  misc_feature 1..67: note = hyper
  source 1..67: mol_type = genomic DNA

SEQ ID NO: 51640 - DNA, 126 bp, Homo sapiens; identical to SEQ ID NO: 30852
  misc_feature 1..126: note = chr6:137808768-137808894
  misc_feature 1..126: note = hyper
  source 1..126: mol_type = genomic DNA

SEQ ID NO: 51641 - DNA, 141 bp, Homo sapiens
  misc_feature 1..141: note = chr6:137809000-137809141
  misc_feature 1..141: note = hyper
  source 1..141: mol_type = genomic DNA
cgaggaaaagaggggtcttactcaagtcagggccggacagaactccaaaacttacgaggacagctatccaacactgcctcacagacccttaggcgctgccccctctttgcccctgtcctcctgcggtgcgagaaacccgac

SEQ ID NO: 51642 - DNA, 36 bp, Homo sapiens
  misc_feature 1..36: note = chr6:137811088-137811124
  misc_feature 1..36: note = hyper
  source 1..36: mol_type = genomic DNA
gtgggcttctcaaggtgtctccgcccaggaggattt

SEQ ID NO: 51643 - DNA, 100 bp, Homo sapiens; identical to SEQ ID NO: 30856
  misc_feature 1..100: note = chr6:137813941-137814041
  misc_feature 1..100: note = hyper
  source 1..100: mol_type = genomic DNA

SEQ ID NO: 51644 - DNA, 264 bp, Homo sapiens
  misc_feature 1..264: note = chr6:137814340-137814604
  misc_feature 1..264: note = hyper
  source 1..264: mol_type = genomic DNA
agatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccag

SEQ ID NO: 51645 - DNA, 245 bp, Homo sapiens
  misc_feature 1..245: note = chr6:137814763-137815008
  misc_feature 1..245: note = hyper
  source 1..245: mol_type = genomic DNA
gcaccgggtgcacggagttggccgcgtgcgcggggtggccggccgagtggcccacggtcccgcagtgaaaggccgagtggtggcccccatagatctcgccaaccagcctcttcatctcctccagggagctggtgagcatgaggatgtagtttctggcgagcaggagtgtggcgatcttggagagcttgcgcaccgacggcccatgcgcgtagggcatgacttcgcgcagcccgtccatggctagg

SEQ ID NO: 51646 - DNA, 289 bp, Homo sapiens
  misc_feature 1..289: note = chr6:137815662-137815951
  misc_feature 1..289: note = hyper
  source 1..289: mol_type = genomic DNA
tttagcaaggattcctattcatattcattgtggggccgccctgggacacctctgctccgaaccgctaggagcccccaggcacaaaaccctctgattgacacactcaccgctccagcttacgccttcctgattttttttttaactttcttccaccccaccccccttcccaatttctctaaccaaatcacacatcaggaacggaaggaaggcaagagaaggtggccaggcggttggtggaggttcctctgagtttggagagaggaattgaaacattcgctctcctttcttt

SEQ ID NO: 51647 - DNA, 13 bp, Homo sapiens
  misc_feature 1..13: note = chr6:137816459-137816472
  misc_feature 1..13: note = hyper
  source 1..13: mol_type = genomic DNA
cttcctggacctt

SEQ ID NO: 51648 - DNA, 148 bp, Homo sapiens; identical to SEQ ID NO: 30861
  misc_feature 1..148: note = chr6:137817618-137817766
  misc_feature 1..148: note = hyper
  source 1..148: mol_type = genomic DNA

SEQ ID NO: 51649 - DNA, 443 bp, Homo sapiens
  misc_feature 1..443: note = chr6:137818062-137818505
  misc_feature 1..443: note = hyper
  source 1..443: mol_type = genomic DNA
gggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcgg

SEQ ID NO: 51650 - DNA, 180 bp, Homo sapiens; identical to SEQ ID NO: 19472
  misc_feature 1..180: note = chr6:137819368-137819548
  misc_feature 1..180: note = hyper
  source 1..180: mol_type = genomic DNA

SEQ ID NO: 51651 - DNA, 45 bp, Homo sapiens; identical to SEQ ID NO: 30865
  misc_feature 1..45: note = chr6:142409847-142409892
  misc_feature 1..45: note = hyper
  source 1..45: mol_type = genomic DNA

SEQ ID NO: 51652 - DNA, 109 bp, Homo sapiens; identical to SEQ ID NO: 30866
  misc_feature 1..109: note = chr6:143247641-143247750
  misc_feature 1..109: note = hyper
  source 1..109: mol_type = genomic DNA

SEQ ID NO: 51653 - DNA, 91 bp, Homo sapiens; identical to SEQ ID NO: 30867
  misc_feature 1..91: note = chr6:146349205-146349296
  misc_feature 1..91: note = hyper
  source 1..91: mol_type = genomic DNA

SEQ ID NO: 51654 - DNA, 148 bp, Homo sapiens; identical to SEQ ID NO: 8761
  misc_feature 1..148: note = chr6:146349536-146349684
  misc_feature 1..148: note = hyper
  source 1..148: mol_type = genomic DNA

SEQ ID NO: 51655 - DNA, 107 bp, Homo sapiens
  misc_feature 1..107: note = chr6:146755460-146755567
  misc_feature 1..107: note = hyper
  source 1..107: mol_type = genomic DNA
cagcaacttcagtaccgcgatcccggattttcacgcggtgctggcaggccccggtggtcccgggaacgggctgcggtccctgtacccgcccccgccacctccgcagc

SEQ ID NO: 51656 - DNA, 12 bp, Homo sapiens
  misc_feature 1..12: note = chr6:146755649-146755661
  misc_feature 1..12: note = hyper
  source 1..12: mol_type = genomic DNA
gaggtttaagct

SEQ ID NO: 51657 - DNA, 42 bp, Homo sapiens; identical to SEQ ID NO: 30870
  misc_feature 1..42: note = chr6:146864466-146864508
  misc_feature 1..42: note = hyper
  source 1..42: mol_type = genomic DNA

SEQ ID NO: 51658 - DNA, 116 bp, Homo sapiens; identical to SEQ ID NO: 30871
  misc_feature 1..116: note = chr6:146864762-146864878
  misc_feature 1..116: note = hyper
  source 1..116: mol_type = genomic DNA

SEQ ID NO: 51659 - DNA, 30 bp, Homo sapiens; identical to SEQ ID NO: 30872
  misc_feature 1..30: note = chr6:147829471-147829501
  misc_feature 1..30: note = hyper
  source 1..30: mol_type = genomic DNA

SEQ ID NO: 51660 - DNA, 32 bp, Homo sapiens; identical to SEQ ID NO: 30873
  misc_feature 1..32: note = chr6:148663762-148663794
  misc_feature 1..32: note = hyper
  source 1..32: mol_type = genomic DNA

SEQ ID NO: 51661 - DNA, 41 bp, Homo sapiens; identical to SEQ ID NO: 30874
  misc_feature 1..41: note = chr6:148664007-148664048
  misc_feature 1..41: note = hyper
  source 1..41: mol_type = genomic DNA

SEQ ID NO: 51662 - DNA, 303 bp, Homo sapiens; identical to SEQ ID NO: 30875
  misc_feature 1..303: note = chr6:149069188-149069491
  misc_feature 1..303: note = hyper
  source 1..303: mol_type = genomic DNA

SEQ ID NO: 51663 - DNA, 111 bp, Homo sapiens; identical to SEQ ID NO: 30876
  misc_feature 1..111: note = chr6:150284700-150284811
  misc_feature 1..111: note = hyper
  source 1..111: mol_type = genomic DNA

SEQ ID NO: 51664 - skipped

SEQ ID NO: 51665 - DNA, 30 bp, Homo sapiens; identical to SEQ ID NO: 30880
  misc_feature 1..30: note = chr6:150310175-150310205
  misc_feature 1..30: note = hyper
  source 1..30: mol_type = genomic DNA

SEQ ID NO: 51666 - DNA, 324 bp, Homo sapiens; identical to SEQ ID NO: 30881
  misc_feature 1..324: note = chr6:150311072-150311396
  misc_feature 1..324: note = hyper
  source 1..324: mol_type = genomic DNA

SEQ ID NO: 51667 - DNA, 258 bp, Homo sapiens; identical to SEQ ID NO: 30882
  misc_feature 1..258: note = chr6:150311819-150312077
  misc_feature 1..258: note = hyper
  source 1..258: mol_type = genomic DNA

SEQ ID NO: 51668 - DNA, 40 bp, Homo sapiens; identical to SEQ ID NO: 30883
  misc_feature 1..40: note = chr6:150312743-150312783
  misc_feature 1..40: note = hyper
  source 1..40: mol_type = genomic DNA

SEQ ID NO: 51669 - DNA, 90 bp, Homo sapiens
  misc_feature 1..90: note = chr6:150358880-150358970
  misc_feature 1..90: note = hyper
  source 1..90: mol_type = genomic DNA
cctctccgagttctgcgcgctcctcccagggcgcccgctgtccccgagctctggacccgggtcctgcccagtggagaccgcggagttggt

SEQ ID NO: 51670 - DNA, 15 bp, Homo sapiens
  misc_feature 1..15: note = chr6:150359438-150359453
  misc_feature 1..15: note = hyper
  source 1..15: mol_type = genomic DNA
cgggagaaagggaga

SEQ ID NO: 51671 - DNA, 21 bp, Homo sapiens
  misc_feature 1..21: note = chr6:151560995-151561016
  misc_feature 1..21: note = hyper
  source 1..21: mol_type = genomic DNA
tccctgctcttgccacgtgag

SEQ ID NO: 51672 - DNA, 135 bp, Homo sapiens; identical to SEQ ID NO: 19482
  misc_feature 1..135: note = chr6:151561857-151561992
  misc_feature 1..135: note = hyper
  source 1..135: mol_type = genomic DNA

SEQ ID NO: 51673 - DNA, 10 bp, Homo sapiens
  misc_feature 1..10: note = chr6:151562056-151562066
  misc_feature 1..10: note = hyper
  source 1..10: mol_type = genomic DNA
cgcggcgggg

SEQ ID NO: 51674 - DNA, 81 bp, Homo sapiens
  misc_feature 1..81: note = chr6:151814974-151815055
  misc_feature 1..81: note = hyper
  source 1..81: mol_type = genomic DNA
tcccaccgggaggaccgaccgttatccccgccgactccccccaggtcgccctggcagtttcggccgctcagttgcaggccc

SEQ ID NO: 51675 - DNA, 522 bp, Homo sapiens
  misc_feature 1..522: note = chr6:151815089-151815611
  misc_feature 1..522: note = hyper
  source 1..522: mol_type = genomic DNA
caccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccc

SEQ ID NO: 51676 - DNA, 101 bp, Homo sapiens
  misc_feature 1..101: note = chr6:152622914-152623015
  misc_feature 1..101: note = hyper
  source 1..101: mol_type = genomic DNA
ccctgaaatcagccacggagagggaacatggagccactcgccaggctccagtcaaagagcaaagccgcggggacccactggatccttaccatgaccacaga

SEQ ID NO: 51677 - DNA, 293 bp, Homo sapiens; identical to SEQ ID NO: 30892
  misc_feature 1..293: note = chr6:152957488-152957781
  misc_feature 1..293: note = hyper
  source 1..293: mol_type = genomic DNA

SEQ ID NO: 51678 - DNA, 80 bp, Homo sapiens
  misc_feature 1..80: note = chr6:152957815-152957895
  misc_feature 1..80: note = hyper
  source 1..80: mol_type = genomic DNA
cgagcgaacgcttcctcccggctctctgcgcccaggctcggcgggaccccggggatgcgcggctgtccgcccgccctgtc

SEQ ID NO: 51679 - DNA, 409 bp, Homo sapiens
  misc_feature 1..409: note = chr6:152958076-152958485
  misc_feature 1..409: note = hyper
  source 1..409: mol_type = genomic DNA
gttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggag

SEQ ID NO: 51680 - DNA, 259 bp, Homo sapiens; identical to SEQ ID NO: 19488
  misc_feature 1..259: note = chr6:153450977-153451236
  misc_feature 1..259: note = hyper
  source 1..259: mol_type = genomic DNA

SEQ ID NO: 51681 - DNA, 390 bp, Homo sapiens
  misc_feature 1..390: note = chr6:153451500-153451890
  misc_feature 1..390: note = hyper
  source 1..390: mol_type = genomic DNA
ccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccg

SEQ ID NO: 51682 - DNA, 162 bp, Homo sapiens
  misc_feature 1..162: note = chr6:153451968-153452130
  misc_feature 1..162: note = hyper
  source 1..162: mol_type = genomic DNA
cccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatggg

SEQ ID NO: 51683 - DNA, 145 bp, Homo sapiens
  misc_feature 1..145: note = chr6:153452568-153452713
  misc_feature 1..145: note = hyper
  source 1..145: mol_type = genomic DNA
tccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccc

SEQ ID NO: 51684 - skipped

SEQ ID NO: 51685 - DNA, 66 bp, Homo sapiens; identical to SEQ ID NO: 19492
  misc_feature 1..66: note = chr6:154360584-154360650
  misc_feature 1..66: note = hyper
  source 1..66: mol_type = genomic DNA

SEQ ID NO: 51686 - DNA, 106 bp, Homo sapiens; identical to SEQ ID NO: 30898
  misc_feature 1..106: note = chr6:155316115-155316221
  misc_feature 1..106: note = hyper
  source 1..106: mol_type = genomic DNA

SEQ ID NO: 51687 - DNA, 87 bp, Homo sapiens
  misc_feature 1..87: note = chr6:155316265-155316352
  misc_feature 1..87: note = hyper
  source 1..87: mol_type = genomic DNA
ttgaattgttttatttgtgttgttccaaagaaagcgcgagggacatggtccgggaccagccgggagctggcgcgggggtcctgggcc

SEQ ID NO: 51688 - DNA, 295 bp, Homo sapiens; identical to SEQ ID NO: 30900
  misc_feature 1..295: note = chr6:155317032-155317327
  misc_feature 1..295: note = hyper
  source 1..295: mol_type = genomic DNA

SEQ ID NO: 51689 - DNA, 40 bp, Homo sapiens
  misc_feature 1..40: note = chr6:157556724-157556764
  misc_feature 1..40: note = hyper
  source 1..40: mol_type = genomic DNA
aggcatgagccaccacgccggaccaaatataaccatttct

SEQ ID NO: 51690 - DNA, 65 bp, Homo sapiens; identical to SEQ ID NO: 30902
  misc_feature 1..65: note = chr6:158430625-158430690
  misc_feature 1..65: note = hyper
  source 1..65: mol_type = genomic DNA

SEQ ID NO: 51691 - DNA, 188 bp, Homo sapiens; identical to SEQ ID NO: 30903
  misc_feature 1..188: note = chr6:158957782-158957970
  misc_feature 1..188: note = hyper
  source 1..188: mol_type = genomic DNA

SEQ ID NO: 51692 - DNA, 109 bp, Homo sapiens; identical to SEQ ID NO: 30904
  misc_feature 1..109: note = chr6:158958375-158958484
  misc_feature 1..109: note = hyper
  source 1..109: mol_type = genomic DNA

SEQ ID NO: 51693 - DNA, 49 bp, Homo sapiens
  misc_feature 1..49: note = chr6:159589999-159590048
  misc_feature 1..49: note = hyper
  source 1..49: mol_type = genomic DNA
tgggcgcgccgggtgcgggtagggacgtggaaggactgggctagccaca

SEQ ID NO: 51694 - DNA, 275 bp, Homo sapiens
  misc_feature 1..275: note = chr6:159590986-159591261
  misc_feature 1..275: note = hyper
  source 1..275: mol_type = genomic DNA
gtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaa

SEQ ID NO: 51695 - DNA, 26 bp, Homo sapiens
  misc_feature 1..26: note = chr6:159654897-159654923
  misc_feature 1..26: note = hyper
  source 1..26: mol_type = genomic DNA
cgcaggggcaggtggcgaccacaggt

SEQ ID NO: 51696 - DNA, 30 bp, Homo sapiens; identical to SEQ ID NO: 30909
  misc_feature 1..30: note = chr6:160402852-160402882
  misc_feature 1..30: note = hyper
  source 1..30: mol_type = genomic DNA

SEQ ID NO: 51697 - DNA, 55 bp, Homo sapiens; identical to SEQ ID NO: 30910
  misc_feature 1..55: note = chr6:160769518-160769573
  misc_feature 1..55: note = hyper
  source 1..55: mol_type = genomic DNA

SEQ ID NO: 51698 - DNA, 98 bp, Homo sapiens; identical to SEQ ID NO: 30911
  misc_feature 1..98: note = chr6:160769827-160769925
  misc_feature 1..98: note = hyper
  source 1..98: mol_type = genomic DNA

SEQ ID NO: 51699 - DNA, 103 bp, Homo sapiens
  misc_feature 1..103: note = chr6:161188410-161188513
  misc_feature 1..103: note = hyper
  source 1..103: mol_type = genomic DNA
cgaccctggattgctctccccattctcagcctcaccccccactccttccaccccatattttgccgcctcgaaggacatgaaccatctgctggctgaaggcgct

SEQ ID NO: 51700 - DNA, 187 bp, Homo sapiens; identical to SEQ ID NO: 8792
  misc_feature 1..187: note = chr6:161351859-161352046
  misc_feature 1..187: note = hyper
  source 1..187: mol_type = genomic DNA

SEQ ID NO: 51701 - DNA, 44 bp, Homo sapiens; identical to SEQ ID NO: 30914
  misc_feature 1..44: note = chr6:161352264-161352308
  misc_feature 1..44: note = hyper
  source 1..44: mol_type = genomic DNA

SEQ ID NO: 51702 - DNA, 119 bp, Homo sapiens; identical to SEQ ID NO: 30917
  misc_feature 1..119: note = chr6:163834710-163834829
  misc_feature 1..119: note = hyper
  source 1..119: mol_type = genomic DNA

SEQ ID NO: 51703 - DNA, 24 bp, Homo sapiens
  misc_feature 1..24: note = chr6:163836544-163836568
  misc_feature 1..24: note = hyper
  source 1..24: mol_type = genomic DNA
gggccggggtggacccgccggtgc

SEQ ID NO: 51704 - DNA, 331 bp, Homo sapiens
  misc_feature 1..331: note = chr6:163836900-163837231
  misc_feature 1..331: note = hyper
  source 1..331: mol_type = genomic DNA
ggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcg

SEQ ID NO: 51705 - DNA, 97 bp, Homo sapiens; identical to SEQ ID NO: 30919
  misc_feature 1..97: note = chr6:163837469-163837566
  misc_feature 1..97: note = hyper
  source 1..97: mol_type = genomic DNA

SEQ ID NO: 51706 - DNA, 99 bp, Homo sapiens
  misc_feature 1..99: note = chr6:166074020-166074119
  misc_feature 1..99: note = hyper
  source 1..99: mol_type = genomic DNA
aggagcggccgatcccggcgcgaatacgctcgccagcccgggggctgcaccccaaaggtgcctgagcgggcggtgagcccggagcagcttcggccgcag

SEQ ID NO: 51707 - DNA, 713 bp, Homo sapiens
  misc_feature 1..713: note = chr6:166074412-166075125
  misc_feature 1..713: note = hyper
  source 1..713: mol_type = genomic DNA
ccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 51708 - DNA, 231 bp, Homo sapiens; identical to SEQ ID NO: 30921
  misc_feature 1..231: note = chr6:166075258-166075489
  misc_feature 1..231: note = hyper
  source 1..231: mol_type = genomic DNA

SEQ ID NO: 51709 - DNA, 107 bp, Homo sapiens; identical to SEQ ID NO: 30922
  misc_feature 1..107: note = chr6:166076095-166076202
  misc_feature 1..107: note = hyper
  source 1..107: mol_type = genomic DNA

SEQ ID NO: 51710 - DNA, 98 bp, Homo sapiens; identical to SEQ ID NO: 30923
  misc_feature 1..98: note = chr6:166076501-166076599
  misc_feature 1..98: note = hyper
  source 1..98: mol_type = genomic DNA

SEQ ID NO: 51711 - DNA, 38 bp, Homo sapiens
  misc_feature 1..38: note = chr6:166077021-166077059
  misc_feature 1..38: note = hyper
  source 1..38: mol_type = genomic DNA
tcctggtagcgggccagcagctccgacccagctgtgct

SEQ ID NO: 51712 - DNA, 43 bp, Homo sapiens
  misc_feature 1..43: note = chr6:166077335-166077378
  misc_feature 1..43: note = hyper
  source 1..43: mol_type = genomic DNA
acccccacccccttccgtagccatgaatccaggcagttgccac

SEQ ID NO: 51713 - DNA, 332 bp, Homo sapiens; identical to SEQ ID NO: 30926
  misc_feature 1..332: note = chr6:166077668-166078000
  misc_feature 1..332: note = hyper
  source 1..332: mol_type = genomic DNA

SEQ ID NO: 51714 - DNA, 52 bp, Homo sapiens; identical to SEQ ID NO: 30927
  misc_feature 1..52: note = chr6:166218127-166218179
  misc_feature 1..52: note = hyper
  source 1..52: mol_type = genomic DNA

SEQ ID NO: 51715 - DNA, 244 bp, Homo sapiens; identical to SEQ ID NO: 30928
  misc_feature 1..244: note = chr6:166218546-166218790
  misc_feature 1..244: note = hyper
  source 1..244: mol_type = genomic DNA

SEQ ID NO: 51716 - DNA, 57 bp, Homo sapiens
  misc_feature 1..57: note = chr6:166267525-166267582
  misc_feature 1..57: note = hyper
  source 1..57: mol_type = genomic DNA
gtggtgagcaggctgcgctggacccagacagacgcgcggggtcctagggaagagccc

SEQ ID NO: 51717 - DNA, 30 bp, Homo sapiens; identical to SEQ ID NO: 30930
  misc_feature 1..30: note = chr6:166399418-166399448
  misc_feature 1..30: note = hyper
  source 1..30: mol_type = genomic DNA

SEQ ID NO: 51718 - DNA, 349 bp, Homo sapiens; identical to SEQ ID NO: 30931
  misc_feature 1..349: note = chr6:166400601-166400950
  misc_feature 1..349: note = hyper
  source 1..349: mol_type = genomic DNA

SEQ ID NO: 51719 - DNA, 193 bp, Homo sapiens
  misc_feature 1..193: note = chr6:166401307-166401500
  misc_feature 1..193: note = hyper
  source 1..193: mol_type = genomic DNA
cctccttccctcctttccatctgggggtctcggggaaagctgcacccagcgccttgggcgcccatgaagaccagtccatctcagctcaagctcccagcagcagcaacttcggactcagacctctctctttagaacatgagtgcttgtgtgtgcgtgcgtgtgtgtgtgtgtgtgtgtccgagtgcacttcaca

SEQ ID NO: 51720 - DNA, 291 bp, Homo sapiens
  misc_feature 1..291: note = chr6:166401949-166402240
  misc_feature 1..291: note = hyper
  source 1..291: mol_type = genomic DNA
cgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggcca

SEQ ID NO: 51721 - DNA, 105 bp, Homo sapiens; identical to SEQ ID NO: 19507
  misc_feature 1..105: note = chr6:166402546-166402651
  misc_feature 1..105: note = hyper
  source 1..105: mol_type = genomic DNA

SEQ ID NO: 51722 - DNA, 30 bp, Homo sapiens; identical to SEQ ID NO: 30934
  misc_feature 1..30: note = chr6:166420026-166420056
  misc_feature 1..30: note = hyper
  source 1..30: mol_type = genomic DNA

SEQ ID NO: 51723 - DNA, 34 bp, Homo sapiens
  misc_feature 1..34: note = chr6:166422185-166422219
  misc_feature 1..34: note = hyper
  source 1..34: mol_type = genomic DNA
gcgccggaggggtgggtcccgggacagaccagtg

SEQ ID NO: 51724 - skipped

SEQ ID NO: 51725 - DNA, 200 bp, Homo sapiens; identical to SEQ ID NO: 19509
  misc_feature 1..200: note = chr6:166580144-166580344
  misc_feature 1..200: note = hyper
  source 1..200: mol_type = genomic DNA

SEQ ID NO: 51726 - DNA, 30 bp, Homo sapiens
  misc_feature 1..30: note = chr6:166582797-166582827
  misc_feature 1..30: note = hyper
  source 1..30: mol_type = genomic DNA
aagccgaaggagggatccccgcccgggact

SEQ ID NO: 51727 - DNA, 155 bp, Homo sapiens; identical to SEQ ID NO: 30939
  misc_feature 1..155: note = chr6:166582941-166583096
  misc_feature 1..155: note = hyper
  source 1..155: mol_type = genomic DNA

SEQ ID NO: 51728 - DNA, 88 bp, Homo sapiens; identical to SEQ ID NO: 8811
  misc_feature 1..88: note = chr6:166583152-166583240
  misc_feature 1..88: note = hyper
  source 1..88: mol_type = genomic DNA

SEQ ID NO: 51729 - DNA, 114 bp, Homo sapiens; identical to SEQ ID NO: 30941
  misc_feature 1..114: note = chr6:166666746-166666860
  misc_feature 1..114: note = hyper
  source 1..114: mol_type = genomic DNA

SEQ ID NO: 51730 - DNA, 184 bp, Homo sapiens; identical to SEQ ID NO: 30942
  misc_feature 1..184: note = chr6:166666879-166667063
  misc_feature 1..184: note = hyper
  source 1..184: mol_type = genomic DNA

SEQ ID NO: 51731 - DNA, 83 bp, Homo sapiens; identical to SEQ ID NO: 30943
  misc_feature 1..83: note = chr6:166721361-166721444
  misc_feature 1..83: note = hyper
  source 1..83: mol_type = genomic DNA

SEQ ID NO: 51732 - DNA, 442 bp, Homo sapiens; identical to SEQ ID NO: 30944
  misc_feature 1..442: note = chr6:166721677-166722119
  misc_feature 1..442: note = hyper
  source 1..442: mol_type = genomic DNA

SEQ ID NO: 51733 - DNA, 165 bp, Homo sapiens; identical to SEQ ID NO: 30945
  misc_feature 1..165: note = chr6:167040127-167040292
  misc_feature 1..165: note = hyper
  source 1..165: mol_type = genomic DNA

SEQ ID NO: 51734 - DNA, 88 bp, Homo sapiens; identical to SEQ ID NO: 30946
  misc_feature 1..88: note = chr6:167041866-167041954
  misc_feature 1..88: note = hyper
  source 1..88: mol_type = genomic DNA

SEQ ID NO: 51735 - DNA, 291 bp, Homo sapiens; identical to SEQ ID NO: 30947
  misc_feature 1..291: note = chr6:167275668-167275959
  misc_feature 1..291: note = hyper
  source 1..291: mol_type = genomic DNA

SEQ ID NO: 51736 - DNA, 149 bp, Homo sapiens; identical to SEQ ID NO: 30948
  misc_feature 1..149: note = chr6:167276322-167276471
  misc_feature 1..149: note = hyper
  source 1..149: mol_type = genomic DNA

SEQ ID NO: 51737 - DNA, 124 bp, Homo sapiens; identical to SEQ ID NO: 30949
  misc_feature 1..124: note = chr6:167764978-167765102
  misc_feature 1..124: note = hyper
  source 1..124: mol_type = genomic DNA

SEQ ID NO: 51738 - DNA, 19 bp, Homo sapiens
  misc_feature 1..19: note = chr6:168719889-168719908
  misc_feature 1..19: note = hyper
  source 1..19: mol_type = genomic DNA
cgcgcggggcctccatgtc

SEQ ID NO: 51739 - DNA, 59 bp, Homo sapiens; identical to SEQ ID NO: 30951
  misc_feature 1..59: note = chr6:168841594-168841653
  misc_feature 1..59: note = hyper
  source 1..59: mol_type = genomic DNA

SEQ ID NO: 51740 - DNA, 490 bp, Homo sapiens; identical to SEQ ID NO: 30952
  misc_feature 1..490: note = chr6:168842028-168842518
  misc_feature 1..490: note = hyper
  source 1..490: mol_type = genomic DNA

SEQ ID NO: 51741 - skipped

SEQ ID NO: 51742 - DNA, 164 bp, Homo sapiens; identical to SEQ ID NO: 30954
  misc_feature 1..164: note = chr6:168843080-168843244
  misc_feature 1..164: note = hyper
  source 1..164: mol_type = genomic DNA

SEQ ID NO: 51743 - DNA, 124 bp, Homo sapiens; identical to SEQ ID NO: 30955
  misc_feature 1..124: note = chr6:169653925-169654049
  misc_feature 1..124: note = hyper
  source 1..124: mol_type = genomic DNA

SEQ ID NO: 51744 - DNA, 30 bp, Homo sapiens; identical to SEQ ID NO: 30956
  misc_feature 1..30: note = chr6:170598584-170598614
  misc_feature 1..30: note = hyper
  source 1..30: mol_type = genomic DNA

SEQ ID NO: 51745 - DNA, 262 bp, Homo sapiens; identical to SEQ ID NO: 30957
  misc_feature 1..262: note = chr6:170605558-170605820
  misc_feature 1..262: note = hyper
  source 1..262: mol_type = genomic DNA

SEQ ID NO: 51746 - DNA, 32 bp, Homo sapiens; identical to SEQ ID NO: 30958
  misc_feature 1..32: note = chr6:170921693-170921725
  misc_feature 1..32: note = hyper
  source 1..32: mol_type = genomic DNA

SEQ ID NO: 51747 - DNA, 30 bp, Homo sapiens; identical to SEQ ID NO: 30959
  misc_feature 1..30: note = chr7:191863-191893
  misc_feature 1..30: note = hyper
  source 1..30: mol_type = genomic DNA

SEQ ID NO: 51748 - DNA, 71 bp, Homo sapiens; identical to SEQ ID NO: 30960
  misc_feature 1..71: note = chr7:192430-192501
  misc_feature 1..71: note = hyper
  source 1..71: mol_type = genomic DNA

SEQ ID NO: 51749 - DNA, 52 bp, Homo sapiens; identical to SEQ ID NO: 30961
  misc_feature 1..52: note = chr7:192976-193028
  misc_feature 1..52: note = hyper
  source 1..52: mol_type = genomic DNA

SEQ ID NO: 51750 - DNA, 72 bp, Homo sapiens; identical to SEQ ID NO: 30962
  misc_feature 1..72: note = chr7:193612-193684
  misc_feature 1..72: note = hyper
  source 1..72: mol_type = genomic DNA

SEQ ID NO: 51751 - DNA, 17 bp, Homo sapiens
  misc_feature 1..17: note = chr7:329838-329855
  misc_feature 1..17: note = hyper
  source 1..17: mol_type = genomic DNA
gccgcctcctcctccct

SEQ ID NO: 51752 - DNA, 253 bp, Homo sapiens; identical to SEQ ID NO: 30964
  misc_feature 1..253: note = chr7:330425-330678
  misc_feature 1..253: note = hyper
  source 1..253: mol_type = genomic DNA

SEQ ID NO: 51753 - DNA, 27 bp, Homo sapiens
  misc_feature 1..27: note = chr7:330720-330747
  misc_feature 1..27: note = hyper
  source 1..27: mol_type = genomic DNA
cgccaaccagcgcgcctggcagaactc

SEQ ID NO: 51754 - DNA, 30 bp, Homo sapiens; identical to SEQ ID NO: 30966
  misc_feature 1..30: note = chr7:560245-560275
  misc_feature 1..30: note = hyper
  source 1..30: mol_type = genomic DNA

SEQ ID NO: 51755 - DNA, 134 bp, Homo sapiens; identical to SEQ ID NO: 19518
  misc_feature 1..134: note = chr7:751986-752120
  misc_feature 1..134: note = hyper
  source 1..134: mol_type = genomic DNA

SEQ ID NO: 51756 - DNA, 85 bp, Homo sapiens
  misc_feature 1..85: note = chr7:752221-752306
  misc_feature 1..85: note = hyper
  source 1..85: mol_type = genomic DNA
cccgtctccccccgaccgcctccccgcggggcccccaaccccggcccccacccccggctctccccgcccccgccccatcccccac

SEQ ID NO: 51757 - DNA, 78 bp, Homo sapiens; identical to SEQ ID NO: 30969
  misc_feature 1..78: note = chr7:752350-752428
  misc_feature 1..78: note = hyper
  source 1..78: mol_type = genomic DNA

SEQ ID NO: 51758 - DNA, 104 bp, Homo sapiens; identical to SEQ ID NO: 30970
  misc_feature 1..104: note = chr7:1126563-1126667
  misc_feature 1..104: note = hyper
  source 1..104: mol_type = genomic DNA

SEQ ID NO: 51759 - DNA, 54 bp, Homo sapiens
  misc_feature 1..54: note = chr7:1263707-1263761
  misc_feature 1..54: note = hyper
  source 1..54: mol_type = genomic DNA
cccaggttcggttcccggcttcctggtctttgtttaccaggctccgaggaggac

SEQ ID NO: 51760 - DNA, 313 bp, Homo sapiens
  misc_feature 1..313: note = chr7:1263960-1264273
  misc_feature 1..313: note = hyper
  source 1..313: mol_type = genomic DNA
ccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 51761 - DNA, 321 bp, Homo sapiens; identical to SEQ ID NO: 30972
  misc_feature 1..321: note = chr7:1265151-1265472
  misc_feature 1..321: note = hyper
  source 1..321: mol_type = genomic DNA

SEQ ID NO: 51762 - DNA, 108 bp, Homo sapiens
  misc_feature 1..108: note = chr7:1269197-1269305
  misc_feature 1..108: note = hyper
  source 1..108: mol_type = genomic DNA
cgctccggccgcccccgacccggacccggactccgggcccccagctgggcccaagcgcaggaggccggtcctcacggtgcgcccgggaagggaagggccgagcggcct

SEQ ID NO: 51763 - DNA, 244 bp, Homo sapiens
  misc_feature 1..244: note = chr7:1270162-1270406
  misc_feature 1..244: note = hyper
  source 1..244: mol_type = genomic DNA
aggaggttttcggagcgcgagccggcccgacagcatgaaaaacacagggcgattgaaatgcgagcattgggacgcacggagccgccgcggcgcggactcgctcttgaggtcaagtgacggacggattgtatgcttcttcataataatattaattaaacaatttgcatgctaataaggtaacaattatcagggcctctgttgaaagattcgggttattacaacacgccaatctgaaggccagggg

SEQ ID NO: 51764 - DNA, 177 bp, Homo sapiens
  misc_feature 1..177: note = chr7:1270440-1270617
  misc_feature 1..177: note = hyper
  source 1..177: mol_type = genomic DNA
aattaacattctgtcagctccagaaaatgggataaataaagtcgaattaattcattataataaagagagatgggcgagggagctcggccggcgcgcgcccctcctctgccctccccccgggccgaatagattacagctctgtattcagaaacacgcgccgcgcgcattcctcctcgc

SEQ ID NO: 51765 - DNA, 82 bp, Homo sapiens; identical to SEQ ID NO: 30976
  misc_feature 1..82: note = chr7:1271057-1271139
  misc_feature 1..82: note = hyper
  source 1..82: mol_type = genomic DNA

SEQ ID NO: 51766 - DNA, 30 bp, Homo sapiens; identical to SEQ ID NO: 30977
  misc_feature 1..30: note = chr7:1272309-1272339
  misc_feature 1..30: note = hyper
  source 1..30: mol_type = genomic DNA

SEQ ID NO: 51767 - DNA, 443 bp, Homo sapiens; identical to SEQ ID NO: 30978
  misc_feature 1..443: note = chr7:1272543-1272986
  misc_feature 1..443: note = hyper
  source 1..443: mol_type = genomic DNA

SEQ ID NO: 51768 - DNA, 366 bp, Homo sapiens; identical to SEQ ID NO: 30980
  misc_feature 1..366: note = chr7:1273589-1273955
  misc_feature 1..366: note = hyper
  source 1..366: mol_type = genomic DNA

SEQ ID NO: 51769 - DNA, 168 bp, Homo sapiens
  misc_feature 1..168: note = chr7:1274473-1274641
  misc_feature 1..168: note = hyper
  source 1..168: mol_type = genomic DNA
ggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtg

SEQ ID NO: 51770 - DNA, 248 bp, Homo sapiens
  misc_feature 1..248: note = chr7:1274677-1274925
  misc_feature 1..248: note = hyper
  source 1..248: mol_type = genomic DNA
gctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccgga

SEQ ID NO: 51771 - DNA, 12 bp, Homo sapiens
  misc_feature 1..12: note = chr7:1275567-1275579
  misc_feature 1..12: note = hyper
  source 1..12: mol_type = genomic DNA
gcgagcccatgg

SEQ ID NO: 51772 - skipped

SEQ ID NO: 51773 - DNA, 104 bp, Homo sapiens; identical to SEQ ID NO: 30984
  misc_feature 1..104: note = chr7:1276436-1276540
  misc_feature 1..104: note = hyper
  source 1..104: mol_type = genomic DNA

SEQ ID NO: 51774 - DNA, 382 bp, Homo sapiens; identical to SEQ ID NO: 30985
  misc_feature 1..382: note = chr7:1277174-1277556
  misc_feature 1..382: note = hyper
  source 1..382: mol_type = genomic DNA

SEQ ID NO: 51775 - DNA, 111 bp, Homo sapiens
  misc_feature 1..111: note = chr7:1277865-1277976
  misc_feature 1..111: note = hyper
  source 1..111: mol_type = genomic DNA
ccaaagtgaaccgccacccgtcctccatctccccccacccccccaaaaaccccaacccactggcctcaattttcctgggccctgggtcctcgttgccgcaaaagccaccaa

SEQ ID NO: 51776 - DNA, 431 bp, Homo sapiens; identical to SEQ ID NO: 30987
  misc_feature 1..431: note = chr7:1280395-1280826
  misc_feature 1..431: note = hyper
  source 1..431: mol_type = genomic DNA

SEQ ID NO: 51777 - DNA, 56 bp, Homo sapiens
  misc_feature 1..56: note = chr7:1281075-1281131
  misc_feature 1..56: note = hyper
  source 1..56: mol_type = genomic DNA
gtttatctcacttagcggtggagggactggagggaaggggcggcccgaagggaggc

SEQ ID NO: 51778 - DNA, 22 bp, Homo sapiens
  misc_feature 1..22: note = chr7:1281471-1281493
  misc_feature 1..22: note = hyper
  source 1..22: mol_type = genomic DNA
cgcccctcgcccagccgtgact

SEQ ID NO: 51779 - DNA, 166 bp, Homo sapiens
  misc_feature 1..166: note = chr7:1281876-1282042
  misc_feature 1..166: note = hyper
  source 1..166: mol_type = genomic DNA
tcggaaagtttgcagcgtttcccgagcagcgcgggcaaggccggacctgcggtggagccggcacctgccgctccgcccgggattagggagctcccggcttgtggggggtgcgggcggccggtggtccagctcgcccgccccggccgagacgctgggcccggccccc

SEQ ID NO: 51780 - DNA, 37 bp, Homo sapiens; identical to SEQ ID NO: 19531
  misc_feature 1..37: note = chr7:1282644-1282681
  misc_feature 1..37: note = hyper
  source 1..37: mol_type = genomic DNA

SEQ ID NO: 51781 - DNA, 170 bp, Homo sapiens; identical to SEQ ID NO: 30992
  misc_feature 1..170: note = chr7:1283626-1283796
  misc_feature 1..170: note = hyper
  source 1..170: mol_type = genomic DNA

SEQ ID NO: 51782 - DNA, 30 bp, Homo sapiens; identical to SEQ ID NO: 30993
  misc_feature 1..30: note = chr7:1284194-1284224
  misc_feature 1..30: note = hyper
  source 1..30: mol_type = genomic DNA

SEQ ID NO: 51783 - DNA, 104 bp, Homo sapiens; identical to SEQ ID NO: 30994
  misc_feature 1..104: note = chr7:1286007-1286111
  misc_feature 1..104: note = hyper
  source 1..104: mol_type = genomic DNA

SEQ ID NO: 51784 - DNA, 287 bp, Homo sapiens; identical to SEQ ID NO: 30995
  misc_feature 1..287: note = chr7:1286886-1287173
  misc_feature 1..287: note = hyper
  source 1..287: mol_type = genomic DNA

SEQ ID NO: 51785 - DNA, 30 bp, Homo sapiens; identical to SEQ ID NO: 30996
  misc_feature 1..30: note = chr7:1288109-1288139
  misc_feature 1..30: note = hyper
  source 1..30: mol_type = genomic DNA

SEQ ID NO: 51786 - DNA, 30 bp, Homo sapiens; identical to SEQ ID NO: 19534
  misc_feature 1..30: note = chr7:1288552-1288582
  misc_feature 1..30: note = hyper
  source 1..30: mol_type = genomic DNA

SEQ ID NO: 51787 - DNA, 82 bp, Homo sapiens
  misc_feature 1..82: note = chr7:1288753-1288835
  misc_feature 1..82: note = hyper
  source 1..82: mol_type = genomic DNA
gtgcggtggagtcgggactgctgggggcacctgctgatgaggtgggagggtaaagccacgggggatgcgggtttctggactt

SEQ ID NO: 51788 - DNA, 122 bp, Homo sapiens; identical to SEQ ID NO: 8836
  misc_feature 1..122: note = chr7:1289414-1289536
  misc_feature 1..122: note = hyper
  source 1..122: mol_type = genomic DNA

SEQ ID NO: 51789 - DNA, 270 bp, Homo sapiens; identical to SEQ ID NO: 30999
  misc_feature 1..270: note = chr7:1408501-1408771
  misc_feature 1..270: note = hyper
  source 1..270: mol_type = genomic DNA

SEQ ID NO: 51790 - DNA, 201 bp, Homo sapiens; identical to SEQ ID NO: 31000
  misc_feature 1..201: note = chr7:1408874-1409075
  misc_feature 1..201: note = hyper
  source 1..201: mol_type = genomic DNA

SEQ ID NO: 51791 - DNA, 144 bp, Homo sapiens; identical to SEQ ID NO: 31001
  misc_feature 1..144: note = chr7:1443541-1443685
  misc_feature 1..144: note = hyper
  source 1..144: mol_type = genomic DNA

SEQ ID NO: 51792 - DNA, 15 bp, Homo sapiens
  misc_feature 1..15: note = chr7:1443733-1443748
  misc_feature 1..15: note = hyper
  source 1..15: mol_type = genomic DNA
cggctggtctctttc

SEQ ID NO: 51793 - DNA, 616 bp, Homo sapiens; identical to SEQ ID NO: 31003
  misc_feature 1..616: note = chr7:1704139-1704755
  misc_feature 1..616: note = hyper
  source 1..616: mol_type = genomic DNA

SEQ ID NO: 51794 - DNA, 138 bp, Homo sapiens; identical to SEQ ID NO: 31004
  misc_feature 1..138: note = chr7:1704984-1705122
  misc_feature 1..138: note = hyper
  source 1..138: mol_type = genomic DNA

SEQ ID NO: 51795 - DNA, 198 bp, Homo sapiens; identical to SEQ ID NO: 31005
  misc_feature 1..198: note = chr7:1705412-1705610
  misc_feature 1..198: note = hyper
  source 1..198: mol_type = genomic DNA

SEQ ID NO: 51796 - DNA, 183 bp, Homo sapiens; identical to SEQ ID NO: 31006
  misc_feature 1..183: note = chr7:1706209-1706392
  misc_feature 1..183: note = hyper
  source 1..183: mol_type = genomic DNA

SEQ ID NO: 51797 - DNA, 82 bp, Homo sapiens; identical to SEQ ID NO: 31007
  misc_feature 1..82: note = chr7:1706634-1706716
  misc_feature 1..82: note = hyper
  source 1..82: mol_type = genomic DNA

SEQ ID NO: 51798 - DNA, 274 bp, Homo sapiens; identical to SEQ ID NO: 31008
  misc_feature 1..274: note = chr7:1706985-1707259
  misc_feature 1..274: note = hyper
  source 1..274: mol_type = genomic DNA

SEQ ID NO: 51799 - DNA, 64 bp, Homo sapiens
  misc_feature 1..64: note = chr7:1709074-1709138
  misc_feature 1..64: note = hyper
  source 1..64: mol_type = genomic DNA
ccgccggggcctgcccggcccgagcgtggagtcccgaggctcctgccgggggtccaggctgccc

SEQ ID NO: 51800 - DNA, 239 bp, Homo sapiens
  misc_feature 1..239: note = chr7:1709235-1709474
  misc_feature 1..239: note = hyper
  source 1..239: mol_type = genomic DNA
aggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgtt

SEQ ID NO: 51801 - DNA, 306 bp, Homo sapiens; identical to SEQ ID NO: 31010
  misc_feature 1..306: note = chr7:1709617-1709923
  misc_feature 1..306: note = hyper
  source 1..306: mol_type = genomic DNA

SEQ ID NO: 51802 - DNA, 289 bp, Homo sapiens; identical to SEQ ID NO: 8844
  misc_feature 1..289: note = chr7:1709955-1710244
  misc_feature 1..289: note = hyper
  source 1..289: mol_type = genomic DNA

SEQ ID NO: 51803 - DNA, 46 bp, Homo sapiens; identical to SEQ ID NO: 31012
  misc_feature 1..46: note = chr7:1710324-1710370
  misc_feature 1..46: note = hyper
  source 1..46: mol_type = genomic DNA

SEQ ID NO: 51804 - DNA, 202 bp, Homo sapiens
  misc_feature 1..202: note = chr7:2727866-2728068
  misc_feature 1..202: note = hyper
  source 1..202: mol_type = genomic DNA
ctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggcta

SEQ ID NO: 51805 - DNA, 87 bp, Homo sapiens
  misc_feature 1..87: note = chr7:2728165-2728252
  misc_feature 1..87: note = hyper
  source 1..87: mol_type = genomic DNA
agggaaggccgggccagggaagggccacgcgccccctccccgccatcctctcccaggccagggcgacctgcgcgcttcccgatggga

SEQ ID NO: 51806 - DNA, 45 bp, Homo sapiens; identical to SEQ ID NO: 31014
  misc_feature 1..45: note = chr7:3083160-3083205
  misc_feature 1..45: note = hyper
  source 1..45: mol_type = genomic DNA

SEQ ID NO: 51807 - DNA, 34 bp, Homo sapiens; identical to SEQ ID NO: 31015
  misc_feature 1..34: note = chr7:3083407-3083441
  misc_feature 1..34: note = hyper
  source 1..34: mol_type = genomic DNA

SEQ ID NO: 51808 - DNA, 213 bp, Homo sapiens
  misc_feature 1..213: note = chr7:3340231-3340444
  misc_feature 1..213: note = hyper
  source 1..213: mol_type = genomic DNA
cccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcg

SEQ ID NO: 51809 - DNA, 342 bp, Homo sapiens
  misc_feature 1..342: note = chr7:3340473-3340815
  misc_feature 1..342: note = hyper
  source 1..342: mol_type = genomic DNA
gcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggc

SEQ ID NO: 51810 - DNA, 123 bp, Homo sapiens; identical to SEQ ID NO: 31017
  misc_feature 1..123: note = chr7:3341286-3341409
  misc_feature 1..123: note = hyper
  source 1..123: mol_type = genomic DNA

SEQ ID NO: 51811 - DNA, 389 bp, Homo sapiens
  misc_feature 1..389: note = chr7:3341597-3341986
  misc_feature 1..389: note = hyper
  source 1..389: mol_type = genomic DNA
ggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagc

SEQ ID NO: 51812 - DNA, 68 bp, Homo sapiens; identical to SEQ ID NO: 31019
  misc_feature 1..68: note = chr7:4785735-4785803
  misc_feature 1..68: note = hyper
  source 1..68: mol_type = genomic DNA

SEQ ID NO: 51813 - DNA, 112 bp, Homo sapiens; identical to SEQ ID NO: 31020
  misc_feature 1..112: note = chr7:4837872-4837984
  misc_feature 1..112: note = hyper
  source 1..112: mol_type = genomic DNA

SEQ ID NO: 51814 - DNA, 135 bp, Homo sapiens; identical to SEQ ID NO: 31022
  misc_feature 1..135: note = chr7:4922839-4922974
  misc_feature 1..135: note = hyper
  source 1..135: mol_type = genomic DNA

SEQ ID NO: 51815 - DNA, 232 bp, Homo sapiens
  misc_feature 1..232: note = chr7:4923397-4923629
  misc_feature 1..232: note = hyper
  source 1..232: mol_type = genomic DNA
gggctggagctgggcctcggcgcccaataggcagaaagaaagcctcgaggaggcggggtctccaggagaggggcggggccaacctgctagaaaaggcgggctgtgctctggcgcctcctgccggccgcccaatggacggggatgcagcctcgagggggcggggcctcaccggagaggcggggttttgaagaaaggggtggggctggttgtggagaggcgggacttgcagccc

SEQ ID NO: 51816 - DNA, 199 bp, Homo sapiens; identical to SEQ ID NO: 19550
  misc_feature 1..199: note = chr7:4998388-4998587
  misc_feature 1..199: note = hyper
  source 1..199: mol_type = genomic DNA

SEQ ID NO: 51817 - DNA, 121 bp, Homo sapiens; identical to SEQ ID NO: 31025
  misc_feature 1..121: note = chr7:4998770-4998891
  misc_feature 1..121: note = hyper
  source 1..121: mol_type = genomic DNA

SEQ ID NO: 51818 - DNA, 30 bp, Homo sapiens; identical to SEQ ID NO: 31026
  misc_feature 1..30: note = chr7:5459075-5459105
  misc_feature 1..30: note = hyper
  source 1..30: mol_type = genomic DNA

SEQ ID NO: 51819 - DNA, 30 bp, Homo sapiens; identical to SEQ ID NO: 31027
  misc_feature 1..30: note = chr7:5467207-5467237
  misc_feature 1..30: note = hyper
  source 1..30: mol_type = genomic DNA

SEQ ID NO: 51820 - DNA, 400 bp, Homo sapiens; identical to SEQ ID NO: 31028
  misc_feature 1..400: note = chr7:5467505-5467905
  misc_feature 1..400: note = hyper
  source 1..400: mol_type = genomic DNA

SEQ ID NO: 51821 - DNA, 105 bp, Homo sapiens; identical to SEQ ID NO: 31029
  misc_feature 1..105: note = chr7:5526299-5526404
  misc_feature 1..105: note = hyper
  source 1..105: mol_type = genomic DNA

SEQ ID NO: 51822 - DNA, 22 bp, Homo sapiens
  misc_feature 1..22: note = chr7:5632917-5632939
  misc_feature 1..22: note = hyper
  source 1..22: mol_type = genomic DNA
ccgcctgtcctgcttcgcgcag

SEQ ID NO: 51823 - DNA, 35 bp, Homo sapiens; identical to SEQ ID NO: 31031
  misc_feature 1..35: note = chr7:5635640-5635675
  misc_feature 1..35: note = hyper
  source 1..35: mol_type = genomic DNA

SEQ ID NO: 51824 - skipped

SEQ ID NO: 51825 - DNA, 107 bp, Homo sapiens; identical to SEQ ID NO: 31033
  misc_feature 1..107: note = chr7:6566129-6566236
  misc_feature 1..107: note = hyper
  source 1..107: mol_type = genomic DNA

SEQ ID NO: 51826 - DNA, 167 bp, Homo sapiens
  misc_feature 1..167: note = chr7:6566246-6566413
  misc_feature 1..167: note = hyper
  source 1..167: mol_type = genomic DNA
cgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgagga

SEQ ID NO: 51827 - DNA, 409 bp, Homo sapiens; identical to SEQ ID NO: 31035
  misc_feature 1..409: note = chr7:6570454-6570863
  misc_feature 1..409: note = hyper
  source 1..409: mol_type = genomic DNA

SEQ ID NO: 51828 - DNA, 59 bp, Homo sapiens
  misc_feature 1..59: note = chr7:6570900-6570959
  misc_feature 1..59: note = hyper
  source 1..59: mol_type = genomic DNA
cgccccctccaggtagccccgcctctgccctgctgggacccttttggtcgctctggggt

SEQ ID NO: 51829 - DNA, 47 bp, Homo sapiens; identical to SEQ ID NO: 19554
  misc_feature 1..47: note = chr7:6571130-6571177
  misc_feature 1..47: note = hyper
  source 1..47: mol_type = genomic DNA

SEQ ID NO: 51830 - DNA, 48 bp, Homo sapiens; identical to SEQ ID NO: 31037
  misc_feature 1..48: note = chr7:6576049-6576097
  misc_feature 1..48: note = hyper
  source 1..48: mol_type = genomic DNA

SEQ ID NO: 51831 - DNA, 357 bp, Homo sapiens; identical to SEQ ID NO: 31038
  misc_feature 1..357: note = chr7:6654798-6655155
  misc_feature 1..357: note = hyper
  source 1..357: mol_type = genomic DNA

SEQ ID NO: 51832 - DNA, 30 bp, Homo sapiens; identical to SEQ ID NO: 31039
  misc_feature 1..30: note = chr7:6655418-6655448
  misc_feature 1..30: note = hyper
  source 1..30: mol_type = genomic DNA

SEQ ID NO: 51833 - DNA, 30 bp, Homo sapiens; identical to SEQ ID NO: 31040
  misc_feature 1..30: note = chr7:6655736-6655766
  misc_feature 1..30: note = hyper
  source 1..30: mol_type = genomic DNA

SEQ ID NO: 51834 - DNA, 129 bp, Homo sapiens; identical to SEQ ID NO: 19556
  misc_feature 1..129: note = chr7:6703959-6704088
  misc_feature 1..129: note = hyper
  source 1..129: mol_type = genomic DNA

SEQ ID NO: 51835 - DNA, 282 bp, Homo sapiens; identical to SEQ ID NO: 19557
  misc_feature 1..282: note = chr7:8473674-8473956
  misc_feature 1..282: note = hyper
  source 1..282: mol_type = genomic DNA

SEQ ID NO: 51836 - DNA, 53 bp, Homo sapiens
  misc_feature 1..53: note = chr7:8475057-8475110
  misc_feature 1..53: note = hyper
  source 1..53: mol_type = genomic DNA
ggaccgcgcgcttgctggtctcaggcgctggatttactcgcttttcaattttt

SEQ ID NO: 51837 - DNA, 119 bp, Homo sapiens; identical to SEQ ID NO: 31049
  misc_feature 1..119: note = chr7:8475321-8475440
  misc_feature 1..119: note = hyper
  source 1..119: mol_type = genomic DNA

SEQ ID NO: 51838 - DNA, 107 bp, Homo sapiens; identical to SEQ ID NO: 31050
  misc_feature 1..107: note = chr7:8476614-8476721
  misc_feature 1..107: note = hyper
  source 1..107: mol_type = genomic DNA

SEQ ID NO: 51839 - DNA, 303 bp, Homo sapiens
  misc_feature 1..303: note = chr7:8481339-8481642
  misc_feature 1..303: note = hyper
  source 1..303: mol_type = genomic DNA
gataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggtt

SEQ ID NO: 51840 - DNA, 223 bp, Homo sapiens
  misc_feature 1..223: note = chr7:8481833-8482056
  misc_feature 1..223: note = hyper
  source 1..223: mol_type = genomic DNA
gacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcg

SEQ ID NO: 51841 - DNA, 226 bp, Homo sapiens
  misc_feature 1..226: note = chr7:8482921-8483147
  misc_feature 1..226: note = hyper
  source 1..226: mol_type = genomic DNA
cccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacgg

SEQ ID NO: 51842 - DNA, 41 bp, Homo sapiens
  misc_feature 1..41: note = chr7:8483950-8483991
  misc_feature 1..41: note = hyper
  source 1..41: mol_type = genomic DNA
gaagagaaggtttaggcgcaacgcctcggaggtattctctg

SEQ ID NO: 51843 - DNA, 465 bp, Homo sapiens; identical to SEQ ID NO: 31055
  misc_feature 1..465: note = chr7:11871392-11871857
  misc_feature 1..465: note = hyper
  source 1..465: mol_type = genomic DNA

SEQ ID NO: 51844 - DNA, 270 bp, Homo sapiens
  misc_feature 1..270: note = chr7:12151170-12151440
  misc_feature 1..270: note = hyper
  source 1..270: mol_type = genomic DNA
gggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgctt

SEQ ID NO: 51845 - DNA, 30 bp, Homo sapiens
  misc_feature 1..30: note = chr7:12151678-12151708
  misc_feature 1..30: note = hyper
  source 1..30: mol_type = genomic DNA
ccccatgtcccattgcgagggtcccacaga

SEQ ID NO: 51846 - DNA, 23 bp, Homo sapiens
  misc_feature 1..23: note = chr7:12443294-12443317
  misc_feature 1..23: note = hyper
  source 1..23: mol_type = genomic DNA
ggccaggaacatcagcgcgatca

SEQ ID NO: 51847 - DNA, 315 bp, Homo sapiens
  misc_feature 1..315: note = chr7:12443403-12443718
  misc_feature 1..315: note = hyper
  source 1..315: mol_type = genomic DNA
tggggccacagcagcccctcgggcctcctttcttggattttctcagtctgttgctgcttggaacagggaagctccgcgtcctcgttctggggtgcacccagtcctttcgtgggatagagccttcgcgtaatccgtctgcgactcctcccttcccattttggctgctggctgacctgaaagccacgcccaacctgtccccatagcccagcgtgtaccggcagtggctccgccgccttggatgtcaccgtgcagtcgcacagccaggagtcaagctacagggatgtagctctccgcccgctgcgtcttgctgttcta

SEQ ID NO: 51848 - DNA, 30 bp, Homo sapiens; identical to SEQ ID NO: 31059
  misc_feature 1..30: note = chr7:12610212-12610242
  misc_feature 1..30: note = hyper
  source 1..30: mol_type = genomic DNA

SEQ ID NO: 51849 - DNA, 34 bp, Homo sapiens; identical to SEQ ID NO: 31060
  misc_feature 1..34: note = chr7:14029885-14029919
  misc_feature 1..34: note = hyper
  source 1..34: mol_type = genomic DNA

SEQ ID NO: 51850 - DNA, 261 bp, Homo sapiens; identical to SEQ ID NO: 31061
  misc_feature 1..261: note = chr7:15725085-15725346
  misc_feature 1..261: note = hyper
  source 1..261: mol_type = genomic DNA

SEQ ID NO: 51851 - DNA, 34 bp, Homo sapiens; identical to SEQ ID NO: 19568
  misc_feature 1..34: note = chr7:15725949-15725983
  misc_feature 1..34: note = hyper
  source 1..34: mol_type = genomic DNA

SEQ ID NO: 51852 - DNA, 109 bp, Homo sapiens
  misc_feature 1..109: note = chr7:15726081-15726190
  misc_feature 1..109: note = hyper
  source 1..109: mol_type = genomic DNA
ccaccctctgtcactttttcactggaaaccgtgtgattttttttttaacctcccaaagcaatagcggtgcacttctgcagagctcggataatcccggtcctgagcccca

SEQ ID NO: 51853 - DNA, 24 bp, Homo sapiens
  misc_feature 1..24: note = chr7:15727320-15727344
  misc_feature 1..24: note = hyper
  source 1..24: mol_type = genomic DNA
ttcactcaccgtgggcacttggtt

SEQ ID NO: 51854 - DNA, 30 bp, Homo sapiens; identical to SEQ ID NO: 31065
  misc_feature 1..30: note = chr7:16460326-16460356
  misc_feature 1..30: note = hyper
  source 1..30: mol_type = genomic DNA

SEQ ID NO: 51855 - DNA, 33 bp, Homo sapiens; identical to SEQ ID NO: 31066
  misc_feature 1..33: note = chr7:16461245-16461278
  misc_feature 1..33: note = hyper
  source 1..33: mol_type = genomic DNA

SEQ ID NO: 51856 - DNA, 82 bp, Homo sapiens; identical to SEQ ID NO: 8881
  misc_feature 1..82: note = chr7:18125980-18126062
  misc_feature 1..82: note = hyper
  source 1..82: mol_type = genomic DNA

SEQ ID NO: 51857 - DNA, 76 bp, Homo sapiens; identical to SEQ ID NO: 31068
  misc_feature 1..76: note = chr7:18126082-18126158
  misc_feature 1..76: note = hyper
  source 1..76: mol_type = genomic DNA

SEQ ID NO: 51858 - DNA, 549 bp, Homo sapiens; identical to SEQ ID NO: 31069
  misc_feature 1..549: note = chr7:18126466-18127015
  misc_feature 1..549: note = hyper
  source 1..549: mol_type = genomic DNA

SEQ ID NO: 51859 - DNA, 253 bp, Homo sapiens; identical to SEQ ID NO: 19572
  misc_feature 1..253: note = chr7:19146249-19146502
  misc_feature 1..253: note = hyper
  source 1..253: mol_type = genomic DNA

SEQ ID NO: 51860 - DNA, 24 bp, Homo sapiens
  misc_feature 1..24: note = chr7:19146558-19146582
  misc_feature 1..24: note = hyper
  source 1..24: mol_type = genomic DNA
ttaggcgcgcgggctcccatcctc

SEQ ID NO: 51861 - DNA, 180 bp, Homo sapiens; identical to SEQ ID NO: 19574
  misc_feature 1..180: note = chr7:19146942-19147122
  misc_feature 1..180: note = hyper
  source 1..180: mol_type = genomic DNA

SEQ ID NO: 51862 - DNA, 101 bp, Homo sapiens
  misc_feature 1..101: note = chr7:19147798-19147899
  misc_feature 1..101: note = hyper
  source 1..101: mol_type = genomic DNA
tgctcccccccttcccaaatgctgttgctttttctctggcggtccccaccccctgcttcttcgttctccttccctacccccaaccccgtttgctgtcttag

SEQ ID NO: 51863 - DNA, 62 bp, Homo sapiens; identical to SEQ ID NO: 31074
  misc_feature 1..62: note = chr7:19156000-19156062
  misc_feature 1..62: note = hyper
  source 1..62: mol_type = genomic DNA

SEQ ID NO: 51864 - DNA, 89 bp, Homo sapiens; identical to SEQ ID NO: 19576
  misc_feature 1..89: note = chr7:19157055-19157144
  misc_feature 1..89: note = hyper
  source 1..89: mol_type = genomic DNA

SEQ ID NO: 51865 - DNA, 30 bp, Homo sapiens; identical to SEQ ID NO: 8895
  misc_feature 1..30: note = chr7:19183647-19183677
  misc_feature 1..30: note = hyper
  source 1..30: mol_type = genomic DNA

SEQ ID NO: 51866 - DNA, 171 bp, Homo sapiens
  misc_feature 1..171: note = chr7:19184255-19184426
  misc_feature 1..171: note = hyper
  source 1..171: mol_type = genomic DNA
ccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctcacccagtgcc

SEQ ID NO: 51867 - DNA, 166 bp, Homo sapiens; identical to SEQ ID NO: 31083
  misc_feature 1..166: note = chr7:19184669-19184835
  misc_feature 1..166: note = hyper
  source 1..166: mol_type = genomic DNA

SEQ ID NO: 51868 - DNA, 129 bp, Homo sapiens
  misc_feature 1..129: note = chr7:20816447-20816576
  misc_feature 1..129: note = hyper
  source 1..129: mol_type = genomic DNA
ccccactgtgggggattggggtcagtggagcccgtggatttagccacgaggggacatgactggagccctgtcacgcgcaggtgtgcgtctccgagagctctttcaatataagtgcgggagaagatttat

SEQ ID NO: 51869 - DNA, 83 bp, Homo sapiens; identical to SEQ ID NO: 31085
  misc_feature 1..83: note = chr7:20817170-20817253
  misc_feature 1..83: note = hyper
  source 1..83: mol_type = genomic DNA

SEQ ID NO: 51870 - DNA, 309 bp, Homo sapiens; identical to SEQ ID NO: 31086
  misc_feature 1..309: note = chr7:20817648-20817957
  misc_feature 1..309: note = hyper
  source 1..309: mol_type = genomic DNA

SEQ ID NO: 51871 - DNA, 148 bp, Homo sapiens; identical to SEQ ID NO: 19582
  misc_feature 1..148: note = chr7:20817982-20818130
  misc_feature 1..148: note = hyper
  source 1..148: mol_type = genomic DNA

SEQ ID NO: 51872 - DNA, 31 bp, Homo sapiens; identical to SEQ ID NO: 19583
  misc_feature 1..31: note = chr7:20823261-20823292
  misc_feature 1..31: note = hyper
  source 1..31: mol_type = genomic DNA

SEQ ID NO: 51873 - DNA, 447 bp, Homo sapiens; identical to SEQ ID NO: 19584
  misc_feature 1..447: note = chr7:20823432-20823879
  misc_feature 1..447: note = hyper
  source 1..447: mol_type = genomic DNA

SEQ ID NO: 51874 - DNA, 20 bp, Homo sapiens
  misc_feature 1..20: note = chr7:20824946-20824966
  misc_feature 1..20: note = hyper
  source 1..20: mol_type = genomic DNA
gccgccgcccccgccgccgc

SEQ ID NO: 51875 - DNA, 227 bp, Homo sapiens; identical to SEQ ID NO: 31093
  misc_feature 1..227: note = chr7:20826611-20826838
  misc_feature 1..227: note = hyper
  source 1..227: mol_type = genomic DNA

SEQ ID NO: 51876 - DNA, 99 bp, Homo sapiens; identical to SEQ ID NO: 31094
  misc_feature 1..99: note = chr7:20827355-20827454
  misc_feature 1..99: note = hyper
  source 1..99: mol_type = genomic DNA

SEQ ID NO: 51877 - DNA, 93 bp, Homo sapiens; identical to SEQ ID NO: 31095
  misc_feature 1..93: note = chr7:20828502-20828595
  misc_feature 1..93: note = hyper
  source 1..93: mol_type = genomic DNA

SEQ ID NO: 51878 - DNA, 235 bp, Homo sapiens
  misc_feature 1..235: note = chr7:20830700-20830935
  misc_feature 1..235: note = hyper
  source 1..235: mol_type = genomic DNA
gcgtccctggcctgcgcctctcccagaatgggaagacgacccccaaccccttgactagtgtgcggggtcctcgcacgcggacgtgttggctactaaataaagcgtgaagagggatcgctgggtagctgagcgccgccggcggccgccgggagcagcgagctgagccaggttgggtgggggtgtttcctcgtcgagagctctctggtcaaagtttccttcccgctggaaaacaaaa

SEQ ID NO: 51879 - DNA, 30 bp, Homo sapiens; identical to SEQ ID NO: 31097
  misc_feature 1..30: note = chr7:20831186-20831216
  misc_feature 1..30: note = hyper
  source 1..30: mol_type = genomic DNA

SEQ ID NO: 51880 - DNA, 78 bp, Homo sapiens
  misc_feature 1..78: note = chr7:20833089-20833167
  misc_feature 1..78: note = hyper
  source 1..78: mol_type = genomic DNA
tgctttagaatcattcgactctgagtccaggaaaagcagggggtgtggtggcagtgggggtggctagggaggggtgta

SEQ ID NO: 51881 - DNA, 30 bp, Homo sapiens; identical to SEQ ID NO: 31099
  misc_feature 1..30: note = chr7:20833492-20833522
  misc_feature 1..30: note = hyper
  source 1..30: mol_type = genomic DNA

SEQ ID NO: 51882 - DNA, 30 bp, Homo sapiens; identical to SEQ ID NO: 31100
  misc_feature 1..30: note = chr7:20834600-20834630
  misc_feature 1..30: note = hyper
  source 1..30: mol_type = genomic DNA

SEQ ID NO: 51883 - DNA, 30 bp, Homo sapiens; identical to SEQ ID NO: 8910
  misc_feature 1..30: note = chr7:20836099-20836129
  misc_feature 1..30: note = hyper
  source 1..30: mol_type = genomic DNA

SEQ ID NO: 51884 - DNA, 208 bp, Homo sapiens; identical to SEQ ID NO: 31102
  misc_feature 1..208: note = chr7:20836779-20836987
  misc_feature 1..208: note = hyper
  source 1..208: mol_type = genomic DNA

SEQ ID NO: 51885 - DNA, 50 bp, Homo sapiens; identical to SEQ ID NO: 8912
  misc_feature 1..50: note = chr7:20838460-20838510
  misc_feature 1..50: note = hyper
  source 1..50: mol_type = genomic DNA

SEQ ID NO: 51886 - DNA, 57 bp, Homo sapiens
  misc_feature 1..57: note = chr7:21582536-21582593
  misc_feature 1..57: note = hyper
  source 1..57: mol_type = genomic DNA
gagggcctctcccctcggccttggccttggcgtatactgggcggtggcgcggtgcgc

SEQ ID NO: 51887 - DNA, 84 bp, Homo sapiens
  misc_feature 1..84: note = chr7:21582868-21582952
  misc_feature 1..84: note = hyper
  source 1..84: mol_type = genomic DNA
agcccaggtggcagcccgggaggcgcgagacttcagagaagccccgacccttcgcctaacctcgggggccggcctggaggcagt

SEQ ID NO: 51888 - DNA, 61 bp, Homo sapiens
  misc_feature 1..61: note = chr7:21583326-21583387
  misc_feature 1..61: note = hyper
  source 1..61: mol_type = genomic DNA
acttggcttgaagtccccatcctgaggcccgcaggactcctccccacgtgcacccactctg

SEQ ID NO: 51889 - skipped

SEQ ID NO: 51890 - DNA, 58 bp, Homo sapiens
  misc_feature 1..58: note = chr7:22589298-22589356
  misc_feature 1..58: note = hyper
  source 1..58: mol_type = genomic DNA
ctcaaactatctcgacggtcaggcccctttcccaggtggtgccgtggtggccgtgggg

SEQ ID NO: 51891 - DNA, 25 bp, Homo sapiens
  misc_feature 1..25: note = chr7:23287228-23287253
  misc_feature 1..25: note = hyper
  source 1..25: mol_type = genomic DNA
ggaagagagctgagccgctgtaacc

SEQ ID NO: 51892 - DNA, 1569 bp, Homo sapiens; identical to SEQ ID NO: 31112
  misc_feature 1..1569: note = chr7:23508102-23509671
  misc_feature 1..1569: note = hyper
  source 1..1569: mol_type = genomic DNA

SEQ ID NO: 51893 - DNA, 108 bp, Homo sapiens; identical to SEQ ID NO: 31113
  misc_feature 1..108: note = chr7:23510878-23510986
  misc_feature 1..108: note = hyper
  source 1..108: mol_type = genomic DNA

SEQ ID NO: 51894 - DNA, 906 bp, Homo sapiens; identical to SEQ ID NO: 31114
  misc_feature 1..906: note = chr7:23513519-23514425
  misc_feature 1..906: note = hyper
  source 1..906: mol_type = genomic DNA

SEQ ID NO: 51895 - DNA, 36 bp, Homo sapiens; identical to SEQ ID NO: 8922
  misc_feature 1..36: note = chr7:23514666-23514702
  misc_feature 1..36: note = hyper
  source 1..36: mol_type = genomic DNA

SEQ ID NO: 51896 - DNA, 67 bp, Homo sapiens
  misc_feature 1..67: note = chr7:24796567-24796634
  misc_feature 1..67: note = hyper
  source 1..67: mol_type = genomic DNA
tgcacacacgcccccgagccgggagagcctccgcagcacccagagaagagaccggaacacaaaggat

SEQ ID NO: 51897 - DNA, 15 bp, Homo sapiens
  misc_feature 1..15: note = chr7:24797022-24797037
  misc_feature 1..15: note = hyper
  source 1..15: mol_type = genomic DNA
ccgctgctgggtccc

SEQ ID NO: 51898 - DNA, 543 bp, Homo sapiens; identical to SEQ ID NO: 31118
  misc_feature 1..543: note = chr7:24797067-24797610
  misc_feature 1..543: note = hyper
  source 1..543: mol_type = genomic DNA

SEQ ID NO: 51899 - DNA, 297 bp, Homo sapiens; identical to SEQ ID NO: 31119
  misc_feature 1..297: note = chr7:25891946-25892243
  misc_feature 1..297: note = hyper
  source 1..297: mol_type = genomic DNA

SEQ ID NO: 51900 - DNA, 101 bp, Homo sapiens
  misc_feature 1..101: note = chr7:25896420-25896521
  misc_feature 1..101: note = hyper
  source 1..101: mol_type = genomic DNA
aaattccttccagatcgacctcagtgtgggtgagagcgcagtctgtgaccaccagcgcttctgactcagcggaaaacgccggcaaacaggactacacctca

SEQ ID NO: 51901 - DNA, 74 bp, Homo sapiens; identical to SEQ ID NO: 19602
  misc_feature 1..74: note = chr7:25896864-25896938
  misc_feature 1..74: note = hyper
  source 1..74: mol_type = genomic DNA

SEQ ID NO: 51902 - DNA, 304 bp, Homo sapiens; identical to SEQ ID NO: 31122
  misc_feature 1..304: note = chr7:25902345-25902649
  misc_feature 1..304: note = hyper
  source 1..304: mol_type = genomic DNA

SEQ ID NO: 51903 - DNA, 36 bp, Homo sapiens; identical to SEQ ID NO: 31123
  misc_feature 1..36: note = chr7:25990174-25990210
  misc_feature 1..36: note = hyper
  source 1..36: mol_type = genomic DNA

SEQ ID NO: 51904 - DNA, 41 bp, Homo sapiens; identical to SEQ ID NO: 31124
  misc_feature 1..41: note = chr7:26192685-26192726
  misc_feature 1..41: note = hyper
  source 1..41: mol_type = genomic DNA

SEQ ID NO: 51905 - DNA, 310 bp, Homo sapiens; identical to SEQ ID NO: 31125
  misc_feature 1..310: note = chr7:26415774-26416084
  misc_feature 1..310: note = hyper
  source 1..310: mol_type = genomic DNA

SEQ ID NO: 51906 - DNA, 138 bp, Homo sapiens; identical to SEQ ID NO: 31126
  misc_feature 1..138: note = chr7:26416380-26416518
  misc_feature 1..138: note = hyper
  source 1..138: mol_type = genomic DNA

SEQ ID NO: 51907 - DNA, 34 bp, Homo sapiens; identical to SEQ ID NO: 31127
  misc_feature 1..34: note = chr7:27128016-27128050
  misc_feature 1..34: note = hyper
  source 1..34: mol_type = genomic DNA

SEQ ID NO: 51908 - DNA, 61 bp, Homo sapiens; identical to SEQ ID NO: 19605
  misc_feature 1..61: note = chr7:27135266-27135327
  misc_feature 1..61: note = hyper
  source 1..61: mol_type = genomic DNA

SEQ ID NO: 51909 - DNA, 34 bp, Homo sapiens; identical to SEQ ID NO: 19606
  misc_feature 1..34: note = chr7:27135979-27136013
  misc_feature 1..34: note = hyper
  source 1..34: mol_type = genomic DNA

SEQ ID NO: 51910 - DNA, 372 bp, Homo sapiens
  misc_feature 1..372: note = chr7:27190219-27190591
  misc_feature 1..372: note = hyper
  source 1..372: mol_type = genomic DNA
tacaggtagtctctccgattgcagaatcccaaagccagagtgttccctgaaccagcgtgcgcccccagaacgccttgggacgcgcagtttggacagaagcagccatgacgtgccaggcggcctgtgcaaccagtctccatggtgctggagtgggggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggcc

SEQ ID NO: 51911 - DNA, 47 bp, Homo sapiens; identical to SEQ ID NO: 31132
  misc_feature 1..47: note = chr7:27191507-27191554
  misc_feature 1..47: note = hyper
  source 1..47: mol_type = genomic DNA

SEQ ID NO: 51912 - DNA, 85 bp, Homo sapiens
  misc_feature 1..85: note = chr7:27204402-27204487
  misc_feature 1..85: note = hyper
  source 1..85: mol_type = genomic DNA
ggacgaaggcaggctcgagagaaacctggcgggccagcagatccgggaggccggcgtggaggcggcggcggatttgaagggagga

SEQ ID NO: 51913 - DNA, 36 bp, Homo sapiens
  misc_feature 1..36: note = chr7:27205642-27205678
  misc_feature 1..36: note = hyper
  source 1..36: mol_type = genomic DNA
agccacacaggctggcgggaagtcggaaacgaccaa

SEQ ID NO: 51914 - DNA, 91 bp, Homo sapiens
  misc_feature 1..91: note = chr7:27209582-27209673
  misc_feature 1..91: note = hyper
  source 1..91: mol_type = genomic DNA
ggctccctgtctggccccggcctcccgcctctcgctctccccctctccctcctagctgcccgcccgccggggcgcgcgctcctgcgccccc

SEQ ID NO: 51915 - DNA, 85 bp, Homo sapiens; identical to SEQ ID NO: 19610
  misc_feature 1..85: note = chr7:27212899-27212984
  misc_feature 1..85: note = hyper
  source 1..85: mol_type = genomic DNA

SEQ ID NO: 51916 - DNA, 37 bp, Homo sapiens; identical to SEQ ID NO: 31146
  misc_feature 1..37: note = chr7:27214329-27214366
  misc_feature 1..37: note = hyper
  source 1..37: mol_type = genomic DNA

SEQ ID NO: 51917 - DNA, 448 bp, Homo sapiens; identical to SEQ ID NO: 8945
  misc_feature 1..448: note = chr7:27219396-27219844
  misc_feature 1..448: note = hyper
  source 1..448: mol_type = genomic DNA

SEQ ID NO: 51918 - DNA, 42 bp, Homo sapiens
  misc_feature 1..42: note = chr7:27223151-27223193
  misc_feature 1..42: note = hyper
  source 1..42: mol_type = genomic DNA
ctgagtcctggccaccagcttctgcctccccggccagccttc

SEQ ID NO: 51919 - DNA, 59 bp, Homo sapiens; identical to SEQ ID NO: 8947
  misc_feature 1..59: note = chr7:27223221-27223280
  misc_feature 1..59: note = hyper
  source 1..59: mol_type = genomic DNA

SEQ ID NO: 51920 - DNA, 27 bp, Homo sapiens
  misc_feature 1..27: note = chr7:27223574-27223601
  misc_feature 1..27: note = hyper
  source 1..27: mol_type = genomic DNA
actttatctgttaaacgcgctcctagc

SEQ ID NO: 51921 - DNA, 373 bp, Homo sapiens
  misc_feature 1..373: note = chr7:27223696-27224069
  misc_feature 1..373: note = hyper
  source 1..373: mol_type = genomic DNA
tcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggcct

SEQ ID NO: 51922 - DNA, 129 bp, Homo sapiens
  misc_feature 1..129: note = chr7:27224906-27225035
  misc_feature 1..129: note = hyper
  source 1..129: mol_type = genomic DNA
gctggtcatgtgacccgatgttgaaattgacaagctgctagctagtccgggccttttccccccccctttccttttttttttttcctcctctcccctccctcccggcttcctttctttgtagccacctca

SEQ ID NO: 51923 - DNA, 98 bp, Homo sapiens; identical to SEQ ID NO: 31152
  misc_feature 1..98: note = chr7:27227776-27227874
  misc_feature 1..98: note = hyper
  source 1..98: mol_type = genomic DNA

SEQ ID NO: 51924 - DNA, 30 bp, Homo sapiens; identical to SEQ ID NO: 31153
  misc_feature 1..30: note = chr7:27228676-27228706
  misc_feature 1..30: note = hyper
  source 1..30: mol_type = genomic DNA

SEQ ID NO: 51925 - DNA, 33 bp, Homo sapiens
  misc_feature 1..33: note = chr7:27232256-27232289
  misc_feature 1..33: note = hyper
  source 1..33: mol_type = genomic DNA
gcctcgggctgcgggcggcttcggggcctacag

SEQ ID NO: 51926 - DNA, 18 bp, Homo sapiens
  misc_feature 1..18: note = chr7:27232962-27232980
  misc_feature 1..18: note = hyper
  source 1..18: mol_type = genomic DNA
ctccgagttcacacccca

SEQ ID NO: 51927 - DNA, 30 bp, Homo sapiens; identical to SEQ ID NO: 31155
  misc_feature 1..30: note = chr7:27237273-27237303
  misc_feature 1..30: note = hyper
  source 1..30: mol_type = genomic DNA

SEQ ID NO: 51928 - DNA, 88 bp, Homo sapiens; identical to SEQ ID NO: 31156
  misc_feature 1..88: note = chr7:27238082-27238170
  misc_feature 1..88: note = hyper
  source 1..88: mol_type = genomic DNA

SEQ ID NO: 51929 - DNA, 78 bp, Homo sapiens; identical to SEQ ID NO: 31157
  misc_feature 1..78: note = chr7:27238793-27238871
  misc_feature 1..78: note = hyper
  source 1..78: mol_type = genomic DNA

SEQ ID NO: 51930 - DNA, 32 bp, Homo sapiens; identical to SEQ ID NO: 8952
  misc_feature 1..32: note = chr7:27239141-27239173
  misc_feature 1..32: note = hyper
  source 1..32: mol_type = genomic DNA

SEQ ID NO: 51931 - DNA, 609 bp, Homo sapiens
  misc_feature 1..609: note = chr7:27239234-27239843
  misc_feature 1..609: note = hyper
  source 1..609: mol_type = genomic DNA
gctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccgg

SEQ ID NO: 51932 - DNA, 181 bp, Homo sapiens; identical to SEQ ID NO: 31161
  misc_feature 1..181: note = chr7:27240992-27241173
  misc_feature 1..181: note = hyper
  source 1..181: mol_type = genomic DNA

SEQ ID NO: 51933 - DNA, 64 bp, Homo sapiens; identical to SEQ ID NO: 31164
  misc_feature 1..64: note = chr7:27245526-27245590
  misc_feature 1..64: note = hyper
  source 1..64: mol_type = genomic DNA

SEQ ID NO: 51934 - DNA, 165 bp, Homo sapiens; identical to SEQ ID NO: 31165
  misc_feature 1..165: note = chr7:27250066-27250231
  misc_feature 1..165: note = hyper
  source 1..165: mol_type = genomic DNA

SEQ ID NO: 51935 - DNA, 145 bp, Homo sapiens
  misc_feature 1..145: note = chr7:27252410-27252555
  misc_feature 1..145: note = hyper
  source 1..145: mol_type = genomic DNA
cttctgcccctccgaggtggggtgggggtgttctgaaataacggtggctgcagttagatggctgaggacatagaaagcggttgttatttattccaggcaccatcacaaaaggcttccaaaaatatcgagccgagatattttattg

SEQ ID NO: 51936 - DNA, 24 bp, Homo sapiens
  misc_feature 1..24: note = chr7:27252795-27252819
  misc_feature 1..24: note = hyper
  source 1..24: mol_type = genomic DNA
tttttctttctctcccggattgtt

SEQ ID NO: 51937 - DNA, 284 bp, Homo sapiens; identical to SEQ ID NO: 31168
  misc_feature 1..284: note = chr7:27252895-27253179
  misc_feature 1..284: note = hyper
  source 1..284: mol_type = genomic DNA

SEQ ID NO: 51938 - DNA, 78 bp, Homo sapiens
  misc_feature 1..78: note = chr7:27264797-27264875
  misc_feature 1..78: note = hyper
  source 1..78: mol_type = genomic DNA
agttcttttacacaacgtgaattatattgaaattgggctacttcatagagcttcgcctcagtggaggacagcctggaa

SEQ ID NO: 51939 - DNA, 213 bp, Homo sapiens
  misc_feature 1..213: note = chr7:27265325-27265538
  misc_feature 1..213: note = hyper
  source 1..213: mol_type = genomic DNA
tcggcctctacttcctcggatctgagccagcgccgctaatccgcaggctgcagcagaacctgtcgccagcttggagagtccctcgcgctgccctggcttcccggtccgcgggcgactcgcgctgctcccgggtttgtcgggaccccaggagggcgctcaagcctgtcggcccctacttgtgtgtagagaataggcccgggtacaccacctcag

SEQ ID NO: 51940 - DNA, 57 bp, Homo sapiens; identical to SEQ ID NO: 31170
  misc_feature 1..57: note = chr7:27275040-27275097
  misc_feature 1..57: note = hyper
  source 1..57: mol_type = genomic DNA

SEQ ID NO: 51941 - DNA, 62 bp, Homo sapiens; identical to SEQ ID NO: 31172
  misc_feature 1..62: note = chr7:27279453-27279515
  misc_feature 1..62: note = hyper
  source 1..62: mol_type = genomic DNA

SEQ ID NO: 51942 - DNA, 282 bp, Homo sapiens; identical to SEQ ID NO: 19624
  misc_feature 1..282: note = chr7:27283013-27283295
  misc_feature 1..282: note = hyper
  source 1..282: mol_type = genomic DNA

SEQ ID NO: 51943 - DNA, 15 bp, Homo sapiens
  misc_feature 1..15: note = chr7:27284655-27284670
  misc_feature 1..15: note = hyper
  source 1..15: mol_type = genomic DNA
tcgctgtgcagggtc

SEQ ID NO: 51944 - DNA, 84 bp, Homo sapiens; identical to SEQ ID NO: 31176
  misc_feature 1..84: note = chr7:27289482-27289566
  misc_feature 1..84: note = hyper
  source 1..84: mol_type = genomic DNA

SEQ ID NO: 51945 - DNA, 55 bp, Homo sapiens; identical to SEQ ID NO: 31177
  misc_feature 1..55: note = chr7:27289813-27289868
  misc_feature 1..55: note = hyper
  source 1..55: mol_type = genomic DNA

SEQ ID NO: 51946 - DNA, 173 bp, Homo sapiens; identical to SEQ ID NO: 667
  misc_feature 1..173: note = chr7:27290946-27291119
  misc_feature 1..173: note = hyper
  source 1..173: mol_type = genomic DNA

SEQ ID NO: 51947 - DNA, 340 bp, Homo sapiens
  misc_feature 1..340: note = chr7:27291851-27292191
  misc_feature 1..340: note = hyper
  source 1..340: mol_type = genomic DNA
aggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacgagccctactcttg

SEQ ID NO: 51948 - DNA, 356 bp, Homo sapiens
  misc_feature 1..356: note = chr7:28448920-28449276
  misc_feature 1..356: note = hyper
  source 1..356: mol_type = genomic DNA
cccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccag

SEQ ID NO: 51949 - DNA, 26 bp, Homo sapiens
  misc_feature 1..26: note = chr7:28450015-28450041
  misc_feature 1..26: note = hyper
  source 1..26: mol_type = genomic DNA
cggcagattctcggcagaatcacttg

SEQ ID NO: 51950 - DNA, 221 bp, Homo sapiens; identical to SEQ ID NO: 31183
  misc_feature 1..221: note = chr7:28893380-28893601
  misc_feature 1..221: note = hyper
  source 1..221: mol_type = genomic DNA

SEQ ID NO: 51951 - DNA, 14 bp, Homo sapiens
  misc_feature 1..14: note = chr7:28995978-28995992
  misc_feature 1..14: note = hyper
  source 1..14: mol_type = genomic DNA
gctcctggtgctcc

SEQ ID NO: 51952 - DNA, 56 bp, Homo sapiens; identical to SEQ ID NO: 31185
  misc_feature 1..56: note = chr7:28996341-28996397
  misc_feature 1..56: note = hyper
  source 1..56: mol_type = genomic DNA

SEQ ID NO: 51953 - DNA, 217 bp, Homo sapiens; identical to SEQ ID NO: 19630
  misc_feature 1..217: note = chr7:28996623-28996840
  misc_feature 1..217: note = hyper
  source 1..217: mol_type = genomic DNA

SEQ ID NO: 51954 - DNA, 220 bp, Homo sapiens
  misc_feature 1..220: note = chr7:28996916-28997136
  misc_feature 1..220: note = hyper
  source 1..220: mol_type = genomic DNA
aagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggag

SEQ ID NO: 51955 - DNA, 21 bp, Homo sapiens
  misc_feature 1..21: note = chr7:28997625-28997646
  misc_feature 1..21: note = hyper
  source 1..21: mol_type = genomic DNA
ccacgagcaggaggcgcaagg

SEQ ID NO: 51956 - DNA, 377 bp, Homo sapiens; identical to SEQ ID NO: 19633
  misc_feature 1..377: note = chr7:28997676-28998053
  misc_feature 1..377: note = hyper
  source 1..377: mol_type = genomic DNA

SEQ ID NO: 51957 - DNA, 68 bp, Homo sapiens
  misc_feature 1..68: note = chr7:28998119-28998187
  misc_feature 1..68: note = hyper
  source 1..68: mol_type = genomic DNA
gcaccttctcgctcgcggtcccggacggggagggcggctccagtgcaatagctcggggagcacgcggg

SEQ ID NO: 51958 - DNA, 382 bp, Homo sapiens; identical to SEQ ID NO: 31189
  misc_feature 1..382: note = chr7:29185815-29186197
  misc_feature 1..382: note = hyper
  source 1..382: mol_type = genomic DNA

SEQ ID NO: 51959 - DNA, 141 bp, Homo sapiens; identical to SEQ ID NO: 31190
  misc_feature 1..141: note = chr7:29603652-29603793
  misc_feature 1..141: note = hyper
  source 1..141: mol_type = genomic DNA

SEQ ID NO: 51960 - DNA, 441 bp, Homo sapiens; identical to SEQ ID NO: 31191
  misc_feature 1..441: note = chr7:29604285-29604726
  misc_feature 1..441: note = hyper
  source 1..441: mol_type = genomic DNA

SEQ ID NO: 51961 - DNA, 495 bp, Homo sapiens; identical to SEQ ID NO: 31192
  misc_feature 1..495: note = chr7:29846202-29846697
  misc_feature 1..495: note = hyper
  source 1..495: mol_type = genomic DNA

SEQ ID NO: 51962 - DNA, 78 bp, Homo sapiens; identical to SEQ ID NO: 19638
  misc_feature 1..78: note = chr7:30721202-30721280
  misc_feature 1..78: note = hyper
  source 1..78: mol_type = genomic DNA

SEQ ID NO: 51963 - DNA, 41 bp, Homo sapiens
  misc_feature 1..41: note = chr7:30721902-30721943
  misc_feature 1..41: note = hyper
  source 1..41: mol_type = genomic DNA
ccgcagccgcgtgcggagagggagtgggagtgcgcgcccgg

SEQ ID NO: 51964 - DNA, 96 bp, Homo sapiens; identical to SEQ ID NO: 31194
  misc_feature 1..96: note = chr7:30722018-30722114
  misc_feature 1..96: note = hyper
  source 1..96: mol_type = genomic DNA

SEQ ID NO: 51965 - DNA, 175 bp, Homo sapiens; identical to SEQ ID NO: 19640
  misc_feature 1..175: note = chr7:30722115-30722290
  misc_feature 1..175: note = hyper
  source 1..175: mol_type = genomic DNA

SEQ ID NO: 51966 - DNA, 72 bp, Homo sapiens
  misc_feature 1..72: note = chr7:30722375-30722447
  misc_feature 1..72: note = hyper
  source 1..72: mol_type = genomic DNA
ctgcccgaggagaacaccgcagctctgctaatcgagggacagccgcaacccaaagttcggcagctttccgcc

SEQ ID NO: 51967 - DNA, 222 bp, Homo sapiens; identical to SEQ ID NO: 31196
  misc_feature 1..222: note = chr7:31091945-31092167
  misc_feature 1..222: note = hyper
  source 1..222: mol_type = genomic DNA

SEQ ID NO: 51968 - DNA, 458 bp, Homo sapiens; identical to SEQ ID NO: 31197
  misc_feature 1..458: note = chr7:31092241-31092699
  misc_feature 1..458: note = hyper
  source 1..458: mol_type = genomic DNA

SEQ ID NO: 51969 - DNA, 167 bp, Homo sapiens; identical to SEQ ID NO: 8988
  misc_feature 1..167: note = chr7:31092713-31092880
  misc_feature 1..167: note = hyper
  source 1..167: mol_type = genomic DNA

SEQ ID NO: 51970 - DNA, 109 bp, Homo sapiens; identical to SEQ ID NO: 19644
  misc_feature 1..109: note = chr7:31092894-31093003
  misc_feature 1..109: note = hyper
  source 1..109: mol_type = genomic DNA

SEQ ID NO: 51971 - DNA, 57 bp, Homo sapiens; identical to SEQ ID NO: 19645
  misc_feature 1..57: note = chr7:31093133-31093190
  misc_feature 1..57: note = hyper
  source 1..57: mol_type = genomic DNA

SEQ ID NO: 51972 - DNA, 30 bp, Homo sapiens; identical to SEQ ID NO: 31200
  misc_feature 1..30: note = chr7:31232688-31232718
  misc_feature 1..30: note = hyper
  source 1..30: mol_type = genomic DNA

SEQ ID NO: 51973 - DNA, 83 bp, Homo sapiens
  misc_feature 1..83: note = chr7:31376135-31376218
  misc_feature 1..83: note = hyper
  source 1..83: mol_type = genomic DNA
ccccctttctccctctccgagcgagtgcggggcagagcctccaggcccgcgcgcggcggtgcgctcgccgctctccatgccac

SEQ ID NO: 51974 - DNA, 128 bp, Homo sapiens; identical to SEQ ID NO: 31202
  misc_feature 1..128: note = chr7:31528357-31528485
  misc_feature 1..128: note = hyper
  source 1..128: mol_type = genomic DNA

SEQ ID NO: 51975 - DNA, 143 bp, Homo sapiens; identical to SEQ ID NO: 31203
  misc_feature 1..143: note = chr7:32110353-32110496
  misc_feature 1..143: note = hyper
  source 1..143: mol_type = genomic DNA

SEQ ID NO: 51976 - DNA, 30 bp, Homo sapiens
  misc_feature 1..30: note = chr7:32110772-32110802
  misc_feature 1..30: note = hyper
  source 1..30: mol_type = genomic DNA
gccaccaccgacctgcggagctgcgtgggc

SEQ ID NO: 51977 - DNA, 146 bp, Homo sapiens
  misc_feature 1..146: note = chr7:32337837-32337983
  misc_feature 1..146: note = hyper
  source 1..146: mol_type = genomic DNA
ctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaat

SEQ ID NO: 51978 - DNA, 45 bp, Homo sapiens
  misc_feature 1..45: note = chr7:32338043-32338088
  misc_feature 1..45: note = hyper
  source 1..45: mol_type = genomic DNA
cgccgggtcggagcccgcgaggggtgccgggggggacagcccagg

SEQ ID NO: 51979 - DNA, 276 bp, Homo sapiens
  misc_feature 1..276: note = chr7:32338410-32338686
  misc_feature 1..276: note = hyper
  source 1..276: mol_type = genomic DNA
cggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgc

SEQ ID NO: 51980 - DNA, 138 bp, Homo sapiens
  misc_feature 1..138: note = chr7:32338930-32339068
  misc_feature 1..138: note = hyper
  source 1..138: mol_type = genomic DNA
acaaggaagtcgggaaaatcgccacgcccacttccttctagccactgcccccagcactggcctggagccccgatagtgtttcttctccactgtccctgccaggaaggtaattgtcaaagtcaccggaggctctatgat

SEQ ID NO: 51981 - DNA, 30 bp, Homo sapiens; identical to SEQ ID NO: 31209
  misc_feature 1..30: note = chr7:32467165-32467195
  misc_feature 1..30: note = hyper
  source 1..30: mol_type = genomic DNA

SEQ ID NO: 51982 - DNA, 42 bp, Homo sapiens; identical to SEQ ID NO: 19650
  misc_feature 1..42: note = chr7:32467419-32467461
  misc_feature 1..42: note = hyper
  source 1..42: mol_type = genomic DNA

SEQ ID NO: 51983 - DNA, 30 bp, Homo sapiens; identical to SEQ ID NO: 8997
  misc_feature 1..30: note = chr7:32468472-32468502
  misc_feature 1..30: note = hyper
  source 1..30: mol_type = genomic DNA

SEQ ID NO: 51984 - DNA, 36 bp, Homo sapiens; identical to SEQ ID NO: 31213
  misc_feature 1..36: note = chr7:32801612-32801648
  misc_feature 1..36: note = hyper
  source 1..36: mol_type = genomic DNA

SEQ ID NO: 51985 - DNA, 690 bp, Homo sapiens
  misc_feature 1..690: note = chr7:33943759-33944449
  misc_feature 1..690: note = hyper
  source 1..690: mol_type = genomic DNA
cttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcgacggagctccgagctgcagaggccgccgcgcggcggcccccgccagagatgagcggtggggcgggggttcctccctcttttcgggtgaatgaatgattagtcaaacaccacctccccgccccggtccgcccgagattggaagggaggagtctcggagcgactgttcattttttaaggacgaaaggcgtttgcctcggtacgtttttaaatcgaccttgtgtgtgtttcaacttcggtcatccctagtgtcaggacgcgcagacagctaagcacagaacacatctctaaggccacttgcccctctgtccgctcagccccctgagttcgctgtcgcgcccccgccagagggaagcaaagcagggcatgaaaagttgcgggggccctactgccccgggtgtgtcgctccttcccaaaggtggggcacccgggagcgagcagggtggtggggcgcccctgcgtcccgtttgctgctccctcgctggattggggca

SEQ ID NO: 51986 - DNA, 497 bp, Homo sapiens; identical to SEQ ID NO: 31216
  misc_feature 1..497: note = chr7:33944650-33945147
  misc_feature 1..497: note = hyper
  source 1..497: mol_type = genomic DNA

SEQ ID NO: 51987 - DNA, 198 bp, Homo sapiens; identical to SEQ ID NO: 31217
  misc_feature 1..198: note = chr7:33945356-33945554
  misc_feature 1..198: note = hyper
  source 1..198: mol_type = genomic DNA

SEQ ID NO: 51988 - DNA, 536 bp, Homo sapiens
  misc_feature 1..536: note = chr7:35225273-35225809
  misc_feature 1..536: note = hyper
  source 1..536: mol_type = genomic DNA
aagactcaagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtg

SEQ ID NO: 51989 - DNA, 149 bp, Homo sapiens; identical to SEQ ID NO: 19657
  misc_feature 1..149: note = chr7:35226044-35226193
  misc_feature 1..149: note = hyper
  source 1..149: mol_type = genomic DNA

SEQ ID NO: 51990 - DNA, 93 bp, Homo sapiens
  misc_feature 1..93: note = chr7:35292877-35292970
  misc_feature 1..93: note = hyper
  source 1..93: mol_type = genomic DNA
gacaacttaggagaccgacgggcccagatataagatgcacattcacagcattcaacagactgaagcctccaaagaaaacttggacccaaaaga

SEQ ID NO: 51991 - DNA, 185 bp, Homo sapiens; identical to SEQ ID NO: 19658
  misc_feature 1..185: note = chr7:35293293-35293478
  misc_feature 1..185: note = hyper
  source 1..185: mol_type = genomic DNA

SEQ ID NO: 51992 - DNA, 361 bp, Homo sapiens
  misc_feature 1..361: note = chr7:35294141-35294502
  misc_feature 1..361: note = hyper
  source 1..361: mol_type = genomic DNA
aagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtg

SEQ ID NO: 51993 - DNA, 136 bp, Homo sapiens
  misc_feature 1..136: note = chr7:35294536-35294672
  misc_feature 1..136: note = hyper
  source 1..136: mol_type = genomic DNA
cagacccctctggttttacaaaggcggctgtgacgaggacttcccacggccttgttggagggcgtcctgttagccctgctcagcctgaataactcaaattctccgaattcgcagggtaatccgcttcgcttggagc

SEQ ID NO: 51994 - DNA, 27 bp, Homo sapiens
  misc_feature 1..27: note = chr7:35295077-35295104
  misc_feature 1..27: note = hyper
  source 1..27: mol_type = genomic DNA
gctggaaggaatttacgctgtcttcta

SEQ ID NO: 51995 - DNA, 196 bp, Homo sapiens
  misc_feature 1..196: note = chr7:35296739-35296935
  misc_feature 1..196: note = hyper
  source 1..196: mol_type = genomic DNA
ccgtttaaactttggcgcctaagaatgtaaaattttgttatacatctgagtttgtttatatggaatttgattatatggaagactggaagatgtctccttatatacaccactctttcaaattctcatttgtagctcccggaactcagaagacagtcgacccccaaaactgtccaggaagtaatcggtttccggcttt

SEQ ID NO: 51996 - DNA, 27 bp, Homo sapiens
  misc_feature 1..27: note = chr7:35298121-35298148
  misc_feature 1..27: note = hyper
  source 1..27: mol_type = genomic DNA
cgagctcactaccgcagggaccggccc

SEQ ID NO: 51997 - DNA, 164 bp, Homo sapiens
  misc_feature 1..164: note = chr7:35300787-35300951
  misc_feature 1..164: note = hyper
  source 1..164: mol_type = genomic DNA
gccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtg

SEQ ID NO: 51998 - DNA, 87 bp, Homo sapiens; identical to SEQ ID NO: 31232
  misc_feature 1..87: note = chr7:35839940-35840027
  misc_feature 1..87: note = hyper
  source 1..87: mol_type = genomic DNA

SEQ ID NO: 51999 - DNA, 51 bp, Homo sapiens; identical to SEQ ID NO: 19660
  misc_feature 1..51: note = chr7:37487113-37487164
  misc_feature 1..51: note = hyper
  source 1..51: mol_type = genomic DNA

SEQ ID NO: 52000 - DNA, 140 bp, Homo sapiens
  misc_feature 1..140: note = chr7:37487826-37487966
  misc_feature 1..140: note = hyper
  source 1..140: mol_type = genomic DNA
ataggaatcttgactccaagatcccagccccacatcccccgtccccagtaaccccgcgccagcgtcgcaaccctcccgcgccccccctcccgcagaccctggtcgaaatgtctcggcgggctcccgggccccgggccctg

SEQ ID NO: 52001 - DNA, 273 bp, Homo sapiens
  misc_feature 1..273: note = chr7:37487984-37488257
  misc_feature 1..273: note = hyper
  source 1..273: mol_type = genomic DNA
cgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgcca

SEQ ID NO: 52002 - DNA, 342 bp, Homo sapiens; identical to SEQ ID NO: 19662
  misc_feature 1..342: note = chr7:37488578-37488920
  misc_feature 1..342: note = hyper
  source 1..342: mol_type = genomic DNA

SEQ ID NO: 52003 - DNA, 27 bp, Homo sapiens
  misc_feature 1..27: note = chr7:37488992-37489019
  misc_feature 1..27: note = hyper
  source 1..27: mol_type = genomic DNA
tgtttgttttgacgctgtgcctctacc

SEQ ID NO: 52004 - DNA, 133 bp, Homo sapiens; identical to SEQ ID NO: 19664
  misc_feature 1..133: note = chr7:37955745-37955878
  misc_feature 1..133: note = hyper
  source 1..133: mol_type = genomic DNA

SEQ ID NO: 52005 - DNA, 55 bp, Homo sapiens
  misc_feature 1..55: note = chr7:37955979-37956034
  misc_feature 1..55: note = hyper
  source 1..55: mol_type = genomic DNA
cgttctcctgcgtgctgtggtgcaggtggttgggcatccgcgtgatgttccaggg

SEQ ID NO: 52006 - DNA, 11 bp, Homo sapiens
  misc_feature 1..11: note = chr7:37956260-37956271
  misc_feature 1..11: note = hyper
  source 1..11: mol_type = genomic DNA
cccccaaactc

SEQ ID NO: 52007 - DNA, 129 bp, Homo sapiens
  misc_feature 1..129: note = chr7:37956439-37956568
  misc_feature 1..129: note = hyper
  source 1..129: mol_type = genomic DNA
cctatttatcccgacacctcccctgacgtgggctcggaacgctcccttggcagctgcagccgcggcgcgggctccccctcggccgccccacccccaggcccgtcggtgcagaagcggtgacatcacccc

SEQ ID NO: 52008 - DNA, 66 bp, Homo sapiens
  misc_feature 1..66: note = chr7:37960235-37960301
  misc_feature 1..66: note = hyper
  source 1..66: mol_type = genomic DNA
gtgagcagtgaaaaccgaagcggcagaaggcagtggcagcaggcagtggcagcaggcagtggccca

SEQ ID NO: 52009 - DNA, 202 bp, Homo sapiens
  misc_feature 1..202: note = chr7:37960335-37960537
  misc_feature 1..202: note = hyper
  source 1..202: mol_type = genomic DNA
ttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgac

SEQ ID NO: 52010 - DNA, 396 bp, Homo sapiens; identical to SEQ ID NO: 9019
  misc_feature 1..396: note = chr7:37960562-37960958
  misc_feature 1..396: note = hyper
  source 1..396: mol_type = genomic DNA

SEQ ID NO: 52011 - DNA, 51 bp, Homo sapiens
  misc_feature 1..51: note = chr7:38670306-38670357
  misc_feature 1..51: note = hyper
  source 1..51: mol_type = genomic DNA
agcactgtgtgatcacgatcctaccctattggtcctgggagatttttggtg

SEQ ID NO: 52012 - DNA, 149 bp, Homo sapiens
  misc_feature 1..149: note = chr7:38671015-38671164
  misc_feature 1..149: note = hyper
  source 1..149: mol_type = genomic DNA
gcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcggga

SEQ ID NO: 52013 - DNA, 748 bp, Homo sapiens; identical to SEQ ID NO: 31245
  misc_feature 1..748: note = chr7:39453541-39454289
  misc_feature 1..748: note = hyper
  source 1..748: mol_type = genomic DNA

SEQ ID NO: 52014 - DNA, 38 bp, Homo sapiens; identical to SEQ ID NO: 31246
  misc_feature 1..38: note = chr7:39873278-39873316
  misc_feature 1..38: note = hyper
  source 1..38: mol_type = genomic DNA

SEQ ID NO: 52015 - DNA, 19 bp, Homo sapiens
  misc_feature 1..19: note = chr7:42267628-42267647
  misc_feature 1..19: note = hyper
  source 1..19: mol_type = genomic DNA
ttcaccacttttgcccgcg

SEQ ID NO: 52016 - DNA, 35 bp, Homo sapiens; identical to SEQ ID NO: 19671
  misc_feature 1..35: note = chr7:42267677-42267712
  misc_feature 1..35: note = hyper
  source 1..35: mol_type = genomic DNA

SEQ ID NO: 52017 - DNA, 89 bp, Homo sapiens; identical to SEQ ID NO: 31248
  misc_feature 1..89: note = chr7:42275797-42275886
  misc_feature 1..89: note = hyper
  source 1..89: mol_type = genomic DNA

SEQ ID NO: 52018 - DNA, 250 bp, Homo sapiens
  misc_feature 1..250: note = chr7:42276096-42276346
  misc_feature 1..250: note = hyper
  source 1..250: mol_type = genomic DNA
cgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtcc

SEQ ID NO: 52019 - DNA, 261 bp, Homo sapiens; identical to SEQ ID NO: 19674
  misc_feature 1..261: note = chr7:42276634-42276895
  misc_feature 1..261: note = hyper
  source 1..261: mol_type = genomic DNA

SEQ ID NO: 52020 - DNA, 141 bp, Homo sapiens; identical to SEQ ID NO: 31250
  misc_feature 1..141: note = chr7:42277420-42277561
  misc_feature 1..141: note = hyper
  source 1..141: mol_type = genomic DNA

SEQ ID NO: 52021 - DNA, 200 bp, Homo sapiens; identical to SEQ ID NO: 31251
  misc_feature 1..200: note = chr7:42277621-42277821
  misc_feature 1..200: note = hyper
  source 1..200: mol_type = genomic DNA

SEQ ID NO: 52022 - DNA, 20 bp, Homo sapiens
  misc_feature 1..20: note = chr7:42533061-42533081
  misc_feature 1..20: note = hyper
  source 1..20: mol_type = genomic DNA
ggaaagggaggaggccggga

SEQ ID NO: 52023 - DNA, 30 bp, Homo sapiens; identical to SEQ ID NO: 31253
  misc_feature 1..30: note = chr7:42927875-42927905
  misc_feature 1..30: note = hyper
  source 1..30: mol_type = genomic DNA

SEQ ID NO: 52024 - DNA, 30 bp, Homo sapiens; identical to SEQ ID NO: 31254
  misc_feature 1..30: note = chr7:42928140-42928170
  misc_feature 1..30: note = hyper
  source 1..30: mol_type = genomic DNA

SEQ ID NO: 52025 - DNA, 139 bp, Homo sapiens
  misc_feature 1..139: note = chr7:43151970-43152109
  misc_feature 1..139: note = hyper
  source 1..139: mol_type = genomic DNA
cacacacaaaagggccgaggagccagggttggtgttggatatgcccagtacgcgtgctgggtgttggaaggatggggccggcggtaacaagaatcgatatatatttaccgcgggggcgggggtgggggtgcgcggaggc

SEQ ID NO: 52026 - DNA, 215 bp, Homo sapiens; identical to SEQ ID NO: 19677
  misc_feature 1..215: note = chr7:43152700-43152915
  misc_feature 1..215: note = hyper
  source 1..215: mol_type = genomic DNA

SEQ ID NO: 52027 - DNA, 307 bp, Homo sapiens
  misc_feature 1..307: note = chr7:43153237-43153544
  misc_feature 1..307: note = hyper
  source 1..307: mol_type = genomic DNA
agacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctgg

SEQ ID NO: 52028 - DNA, 27 bp, Homo sapiens
  misc_feature 1..27: note = chr7:44143915-44143942
  misc_feature 1..27: note = hyper
  source 1..27: mol_type = genomic DNA
aagccccggcgcccccgccccgggccc

SEQ ID NO: 52029 - DNA, 405 bp, Homo sapiens; identical to SEQ ID NO: 31259
  misc_feature 1..405: note = chr7:44144029-44144434
  misc_feature 1..405: note = hyper
  source 1..405: mol_type = genomic DNA

SEQ ID NO: 52030 - DNA, 33 bp, Homo sapiens; identical to SEQ ID NO: 31260
  misc_feature 1..33: note = chr7:44349574-44349607
  misc_feature 1..33: note = hyper
  source 1..33: mol_type = genomic DNA

SEQ ID NO: 52031 - DNA, 44 bp, Homo sapiens; identical to SEQ ID NO: 31261
  misc_feature 1..44: note = chr7:44349655-44349699
  misc_feature 1..44: note = hyper
  source 1..44: mol_type = genomic DNA

SEQ ID NO: 52032 - DNA, 194 bp, Homo sapiens; identical to SEQ ID NO: 31262
  misc_feature 1..194: note = chr7:44364485-44364679
  misc_feature 1..194: note = hyper
  source 1..194: mol_type = genomic DNA

SEQ ID NO: 52033 - DNA, 140 bp, Homo sapiens
  misc_feature 1..140: note = chr7:44364698-44364838
  misc_feature 1..140: note = hyper
  source 1..140: mol_type = genomic DNA
cgcgagcccggagccccggcccggcagccgcgctgggcagagctgggcagggccgcgcgcgctgaggtcaggcagccaggcccggggccgggggctcgcgggtcggggccgcgcggggccgtgcgcttgggcccggagcc

SEQ ID NO: 52034 - DNA, 179 bp, Homo sapiens; identical to SEQ ID NO: 19681
  misc_feature 1..179: note = chr7:44364903-44365082
  misc_feature 1..179: note = hyper
  source 1..179: mol_type = genomic DNA

SEQ ID NO: 52035 - DNA, 119 bp, Homo sapiens; identical to SEQ ID NO: 31264
  misc_feature 1..119: note = chr7:44365117-44365236
  misc_feature 1..119: note = hyper
  source 1..119: mol_type = genomic DNA

SEQ ID NO: 52036 - DNA, 30 bp, Homo sapiens; identical to SEQ ID NO: 31265
  misc_feature 1..30: note = chr7:44924253-44924283
  misc_feature 1..30: note = hyper
  source 1..30: mol_type = genomic DNA

SEQ ID NO: 52037 - DNA, 292 bp, Homo sapiens; identical to SEQ ID NO: 31266
  misc_feature 1..292: note = chr7:45128841-45129133
  misc_feature 1..292: note = hyper
  source 1..292: mol_type = genomic DNA

SEQ ID NO: 52038 - DNA, 51 bp, Homo sapiens; identical to SEQ ID NO: 31267
  misc_feature 1..51: note = chr7:45197382-45197433
  misc_feature 1..51: note = hyper
  source 1..51: mol_type = genomic DNA

SEQ ID NO: 52039 - DNA, 298 bp, Homo sapiens
  misc_feature 1..298: note = chr7:45613487-45613785
  misc_feature 1..298: note = hyper
  source 1..298: mol_type = genomic DNA
tgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaagga

SEQ ID NO: 52040 - DNA, 443 bp, Homo sapiens; identical to SEQ ID NO: 19684
  misc_feature 1..443: note = chr7:45613898-45614341
  misc_feature 1..443: note = hyper
  source 1..443: mol_type = genomic DNA

SEQ ID NO: 52041 - DNA, 263 bp, Homo sapiens; identical to SEQ ID NO: 19685
  misc_feature 1..263: note = chr7:45614474-45614737
  misc_feature 1..263: note = hyper
  source 1..263: mol_type = genomic DNA

SEQ ID NO: 52042 - DNA, 87 bp, Homo sapiens; identical to SEQ ID NO: 9039
  misc_feature 1..87: note = chr7:45928490-45928577
  misc_feature 1..87: note = hyper
  source 1..87: mol_type = genomic DNA

SEQ ID NO: 52043 - DNA, 51 bp, Homo sapiens; identical to SEQ ID NO: 31271
  misc_feature 1..51: note = chr7:45959968-45960019
  misc_feature 1..51: note = hyper
  source 1..51: mol_type = genomic DNA

SEQ ID NO: 52044 - DNA, 267 bp, Homo sapiens; identical to SEQ ID NO: 31272
  misc_feature 1..267: note = chr7:45960227-45960494
  misc_feature 1..267: note = hyper
  source 1..267: mol_type = genomic DNA

SEQ ID NO: 52045 - DNA, 322 bp, Homo sapiens; identical to SEQ ID NO: 19687
  misc_feature 1..322: note = chr7:45960794-45961116
  misc_feature 1..322: note = hyper
  source 1..322: mol_type = genomic DNA

SEQ ID NO: 52046 - DNA, 77 bp, Homo sapiens
  misc_feature 1..77: note = chr7:45961756-45961833
  misc_feature 1..77: note = hyper
  source 1..77: mol_type = genomic DNA
gtcattttttgaaggcgacttcgtattactgtattctcgatgcgttgggattctagcttatctctgcaatctaaaca

SEQ ID NO: 52047 - DNA, 69 bp, Homo sapiens; identical to SEQ ID NO: 19689
  misc_feature 1..69: note = chr7:45961888-45961957
  misc_feature 1..69: note = hyper
  source 1..69: mol_type = genomic DNA

SEQ ID NO: 52048 - DNA, 962 bp, Homo sapiens; identical to SEQ ID NO: 31276
  misc_feature 1..962: note = chr7:48074917-48075879
  misc_feature 1..962: note = hyper
  source 1..962: mol_type = genomic DNA

SEQ ID NO: 52049 - DNA, 129 bp, Homo sapiens
  misc_feature 1..129: note = chr7:49812691-49812820
  misc_feature 1..129: note = hyper
  source 1..129: mol_type = genomic DNA
agaggaagatgggagcggggagagattggcagagattcagaaagttcgcgcttgagatttttacgtttcttactcgtaaacgtctatttctctgggtttctgaatgcaaagacgagaaagtctcaacag

SEQ ID NO: 52050 - DNA, 99 bp, Homo sapiens
  misc_feature 1..99: note = chr7:49813994-49814093
  misc_feature 1..99: note = hyper
  source 1..99: mol_type = genomic DNA
agagaggctggattgccggtgtcctgcggcgtctcgggctctcccagcccctttgggcggcagaaactttggaatccagaaaggctggccgggatccag

SEQ ID NO: 52051 - DNA, 410 bp, Homo sapiens
  misc_feature 1..410: note = chr7:49814121-49814531
  misc_feature 1..410: note = hyper
  source 1..410: mol_type = genomic DNA
cgccctggggccccagcctcccgcactgcacaccttggtgctgcccgggcgcttctgctccgcagccaggacactacaagactgagcgctgcggccggcgacctggctcccaaggctcggaggggcgggccggcagaggagctgaagccccgggaatccccgacccggccctctggcaaggggccgagggcatcctttcatgcagcggggcttagagagcggggagggggcgtctgctcccgagacgggagtcttttaagaagttgttagaaatgaatcgtggagtcctaggagaagctttgtttaacctccccgcattttcccagcacaaccccctaaagcaaatgaggaagagtttccctcttatcttcctgtacattcgtccgtctctaactccactgctgaattct

SEQ ID NO: 52052 - DNA, 42 bp, Homo sapiens
  misc_feature 1..42: note = chr7:50343221-50343263
  misc_feature 1..42: note = hyper
  source 1..42: mol_type = genomic DNA
ctcgcatcctggggccggagcctgaacccgggagccaagggg

SEQ ID NO: 52053 - DNA, 89 bp, Homo sapiens; identical to SEQ ID NO: 19693
  misc_feature 1..89: note = chr7:50343401-50343490
  misc_feature 1..89: note = hyper
  source 1..89: mol_type = genomic DNA

SEQ ID NO: 52054 - DNA, 232 bp, Homo sapiens; identical to SEQ ID NO: 19694
  misc_feature 1..232: note = chr7:50343994-50344226
  misc_feature 1..232: note = hyper
  source 1..232: mol_type = genomic DNA

SEQ ID NO: 52055 - DNA, 247 bp, Homo sapiens; identical to SEQ ID NO: 19695
  misc_feature 1..247: note = chr7:50344491-50344738
  misc_feature 1..247: note = hyper
  source 1..247: mol_type = genomic DNA

SEQ ID NO: 52056 - DNA, 40 bp, Homo sapiens; identical to SEQ ID NO: 31286
  misc_feature 1..40: note = chr7:51383352-51383392
  misc_feature 1..40: note = hyper
  source 1..40: mol_type = genomic DNA

SEQ ID NO: 52057 - DNA, 46 bp, Homo sapiens; identical to SEQ ID NO: 31287
  misc_feature 1..46: note = chr7:51384251-51384297
  misc_feature 1..46: note = hyper
  source 1..46: mol_type = genomic DNA

SEQ ID NO: 52058 - DNA, 66 bp, Homo sapiens
  misc_feature 1..66: note = chr7:54609786-54609852
  misc_feature 1..66: note = hyper
  source 1..66: mol_type = genomic DNA
tgtcctcctcggcaccgagcgatctgatccgccgagccagaaagacacccgatgggggagagaagc

SEQ ID NO: 52059 - DNA, 55 bp, Homo sapiens
  misc_feature 1..55: note = chr7:54612363-54612418
  misc_feature 1..55: note = hyper
  source 1..55: mol_type = genomic DNA
tgtggagatgtcctgcgccttccagagcggctccgcctcggtgtatctggagatc

SEQ ID NO: 52060 - DNA, 67 bp, Homo sapiens
  misc_feature 1..67: note = chr7:54612730-54612797
  misc_feature 1..67: note = hyper
  source 1..67: mol_type = genomic DNA
gttctggtacttaggcagatgcccgccttgcccctaccacgctgccacatcccgggacatccgggag

SEQ ID NO: 52061 - DNA, 99 bp, Homo sapiens; identical to SEQ ID NO: 31292
  misc_feature 1..99: note = chr7:54614009-54614108
  misc_feature 1..99: note = hyper
  source 1..99: mol_type = genomic DNA

SEQ ID NO: 52062 - DNA, 50 bp, Homo sapiens; identical to SEQ ID NO: 31293
  misc_feature 1..50: note = chr7:54614391-54614441
  misc_feature 1..50: note = hyper
  source 1..50: mol_type = genomic DNA

SEQ ID NO: 52063 - DNA, 30 bp, Homo sapiens; identical to SEQ ID NO: 31294
  misc_feature 1..30: note = chr7:54614739-54614769
  misc_feature 1..30: note = hyper
  source 1..30: mol_type = genomic DNA

SEQ ID NO: 52064 - DNA, 510 bp, Homo sapiens; identical to SEQ ID NO: 31295
  misc_feature 1..510: note = chr7:54732044-54732554
  misc_feature 1..510: note = hyper
  source 1..510: mol_type = genomic DNA

SEQ ID NO: 52065 - DNA, 65 bp, Homo sapiens; identical to SEQ ID NO: 31296
  misc_feature 1..65: note = chr7:55086624-55086689
  misc_feature 1..65: note = hyper
  source 1..65: mol_type = genomic DNA

SEQ ID NO: 52066 - DNA, 270 bp, Homo sapiens
  misc_feature 1..270: note = chr7:55087533-55087803
  misc_feature 1..270: note = hyper
  source 1..270: mol_type = genomic DNA
tagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcc

SEQ ID NO: 52067 - DNA, 290 bp, Homo sapiens; identical to SEQ ID NO: 31298
  misc_feature 1..290: note = chr7:56183846-56184136
  misc_feature 1..290: note = hyper
  source 1..290: mol_type = genomic DNA

SEQ ID NO: 52068 - DNA, 44 bp, Homo sapiens; identical to SEQ ID NO: 31299
  misc_feature 1..44: note = chr7:56355700-56355744
  misc_feature 1..44: note = hyper
  source 1..44: mol_type = genomic DNA

SEQ ID NO: 52069 - DNA, 443 bp, Homo sapiens; identical to SEQ ID NO: 31300
  misc_feature 1..443: note = chr7:63767561-63768004
  misc_feature 1..443: note = hyper
  source 1..443: mol_type = genomic DNA

SEQ ID NO: 52070 - DNA, 83 bp, Homo sapiens
  misc_feature 1..83: note = chr7:64349056-64349139
  misc_feature 1..83: note = hyper
  source 1..83: mol_type = genomic DNA
gtcttcggggtgagaggtccggctcctggaggacagcgggatgggagagtcccgttcacacccagccccgcagagccggatag

SEQ ID NO: 52071 - DNA, 30 bp, Homo sapiens; identical to SEQ ID NO: 31302
  misc_feature 1..30: note = chr7:64350006-64350036
  misc_feature 1..30: note = hyper
  source 1..30: mol_type = genomic DNA

SEQ ID NO: 52072 - DNA, 289 bp, Homo sapiens; identical to SEQ ID NO: 31303
  misc_feature 1..289: note = chr7:64407780-64408069
  misc_feature 1..289: note = hyper
  source 1..289: mol_type = genomic DNA

SEQ ID NO: 52073 - DNA, 333 bp, Homo sapiens
  misc_feature 1..333: note = chr7:64700329-64700662
  misc_feature 1..333: note = hyper
  source 1..333: mol_type = genomic DNA
gctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtc

SEQ ID NO: 52074 - DNA, 86 bp, Homo sapiens
  misc_feature 1..86: note = chr7:64712278-64712364
  misc_feature 1..86: note = hyper
  source 1..86: mol_type = genomic DNA
ttctggctgtcccaccggcgatgctgcgcttccacaccacccggcgcacaggcgttggtagatgtggaaggtaccaagagcggcag

SEQ ID NO: 52075 - DNA, 494 bp, Homo sapiens
  misc_feature 1..494: note = chr7:64712510-64713004
  misc_feature 1..494: note = hyper
  source 1..494: mol_type = genomic DNA
cgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgtcccaccctcttctccccgccgccgcggcaaggccagggcgaaagggacaagtgcgctgctggggtcctctgcgctgtgcgggtccgggactcagggttcccggctgctaacaaggctgcgtagcttccccctcccctcctccttaggtggcaacttgtggacacacccattaagcggtcaggcgtcaggtttcctcccgagaggtgggaggcgccctggccttgattcatcgtgaagctaggcaggagatttcccagccacggagggtggaaagcttgccttgacctcagcaggtcatgtcactccgtgtgcacaaggcc

SEQ ID NO: 52076 - DNA, 299 bp, Homo sapiens; identical to SEQ ID NO: 31306
  misc_feature 1..299: note = chr7:64734473-64734772
  misc_feature 1..299: note = hyper
  source 1..299: mol_type = genomic DNA

SEQ ID NO: 52077 - DNA, 112 bp, Homo sapiens; identical to SEQ ID NO: 19703
  misc_feature 1..112: note = chr7:64974270-64974382
  misc_feature 1..112: note = hyper
  source 1..112: mol_type = genomic DNA

SEQ ID NO: 52078 - DNA, 28 bp, Homo sapiens
  misc_feature 1..28: note = chr7:64974422-64974450
  misc_feature 1..28: note = hyper
  source 1..28: mol_type = genomic DNA
aaagccgcggtggcaaaaatgcgcggcg

SEQ ID NO: 52079 - DNA, 480 bp, Homo sapiens; identical to SEQ ID NO: 3051
  misc_feature 1..480: note = chr7:64974510-64974990
  misc_feature 1..480: note = hyper
  source 1..480: mol_type = genomic DNA

SEQ ID NO: 52080 - DNA, 79 bp, Homo sapiens; identical to SEQ ID NO: 31310
  misc_feature 1..79: note = chr7:65446028-65446107
  misc_feature 1..79: note = hyper
  source 1..79: mol_type = genomic DNA

SEQ ID NO: 52081 - DNA, 65 bp, Homo sapiens
  misc_feature 1..65: note = chr7:65508930-65508995
  misc_feature 1..65: note = hyper
  source 1..65: mol_type = genomic DNA
cacctactttcagggcggacagactcaggcctttacagcctgctaagtcccgggtcggataccag

SEQ ID NO: 52082 - DNA, 144 bp, Homo sapiens; identical to SEQ ID NO: 19708
  misc_feature 1..144: note = chr7:69062375-69062519
  misc_feature 1..144: note = hyper
  source 1..144: mol_type = genomic DNA

SEQ ID NO: 52083 - DNA, 395 bp, Homo sapiens
  misc_feature 1..395: note = chr7:69062635-69063030
  misc_feature 1..395: note = hyper
  source 1..395: mol_type = genomic DNA
tccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcctccggcggcttccacgccctggcgcgccaactctgcccggccgcggccgaccccacgcgggc

SEQ ID NO: 52084 - DNA, 344 bp, Homo sapiens
  misc_feature 1..344: note = chr7:69064246-69064590
  misc_feature 1..344: note = hyper
  source 1..344: mol_type = genomic DNA
ttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgc

SEQ ID NO: 52085 - DNA, 116 bp, Homo sapiens
  misc_feature 1..116: note = chr7:69065045-69065161
  misc_feature 1..116: note = hyper
  source 1..116: mol_type = genomic DNA
gtctgtctgtctgtctgtctgtctgtctaggctgaggtcttattgttggtggggggagctgggggcgcgggcagacaggcagcaggagggagtcgcaaagccgtgcctggtctcgt

SEQ ID NO: 52086 - DNA, 269 bp, Homo sapiens; identical to SEQ ID NO: 31315
  misc_feature 1..269: note = chr7:70596147-70596416
  misc_feature 1..269: note = hyper
  source 1..269: mol_type = genomic DNA

SEQ ID NO: 52087 - DNA, 23 bp, Homo sapiens
  misc_feature 1..23: note = chr7:70596688-70596711
  misc_feature 1..23: note = hyper
  source 1..23: mol_type = genomic DNA
cggggctgtgtggctctcggtgc

SEQ ID NO: 52088 - DNA, 128 bp, Homo sapiens
  misc_feature 1..128: note = chr7:70598387-70598515
  misc_feature 1..128: note = hyper
  source 1..128: mol_type = genomic DNA
gaggaaatagtcttagagcccagcgtttggtggggtaccagtagggaacctgggagattggagggcttggatgtctgcagacaaagtcaaggccccaggtcgcggagctaatgcgcttaggtagtata

SEQ ID NO: 52089 - DNA, 75 bp, Homo sapiens
  misc_feature 1..75: note = chr7:71217033-71217108
  misc_feature 1..75: note = hyper
  source 1..75: mol_type = genomic DNA
atgcagaagataaaacgtttcgcagcaccgggtccaaggaagtgcaatacaacagcaaaatgcaatggccgcagc

SEQ ID NO: 52090 - DNA, 45 bp, Homo sapiens; identical to SEQ ID NO: 19713
  misc_feature 1..45: note = chr7:71800631-71800676
  misc_feature 1..45: note = hyper
  source 1..45: mol_type = genomic DNA

SEQ ID NO: 52091 - DNA, 141 bp, Homo sapiens; identical to SEQ ID NO: 31322
  misc_feature 1..141: note = chr7:71802206-71802347
  misc_feature 1..141: note = hyper
  source 1..141: mol_type = genomic DNA

SEQ ID NO: 52092 - DNA, 130 bp, Homo sapiens
  misc_feature 1..130: note = chr7:71802637-71802767
  misc_feature 1..130: note = hyper
  source 1..130: mol_type = genomic DNA
ccagggggaaggcggggcgccgaagtggaggggccaatggccgaaactgcggggaccagcattccgcgtgaccgcccctggagacgtccagggaggcacggctgccgcagggcatcgcccacccaccagc

SEQ ID NO: 52093 - DNA, 165 bp, Homo sapiens; identical to SEQ ID NO: 31325
  misc_feature 1..165: note = chr7:76145381-76145546
  misc_feature 1..165: note = hyper
  source 1..165: mol_type = genomic DNA

SEQ ID NO: 52094 - DNA, 17 bp, Homo sapiens
  misc_feature 1..17: note = chr7:79081775-79081792
  misc_feature 1..17: note = hyper
  source 1..17: mol_type = genomic DNA
gtcccttcttttcttcg

SEQ ID NO: 52095 - DNA, 71 bp, Homo sapiens
  misc_feature 1..71: note = chr7:79081821-79081892
  misc_feature 1..71: note = hyper
  source 1..71: mol_type = genomic DNA
cagctggggacccaggcgcccccagcccagccccagaaacgctggacgcagttctccgctcaccccaccac

SEQ ID NO: 52096 - DNA, 361 bp, Homo sapiens
  misc_feature 1..361: note = chr7:79082218-79082579
  misc_feature 1..361: note = hyper
  source 1..361: mol_type = genomic DNA
ccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccaggtaggggaactgtccattctcggcgccccccttcagttcaaagcccagctggccctccgggttcctgccaat

SEQ ID NO: 52097 - DNA, 202 bp, Homo sapiens; identical to SEQ ID NO: 19717
  misc_feature 1..202: note = chr7:79083190-79083392
  misc_feature 1..202: note = hyper
  source 1..202: mol_type = genomic DNA

SEQ ID NO: 52098 - DNA, 53 bp, Homo sapiens; identical to SEQ ID NO: 31329
  misc_feature 1..53: note = chr7:79764160-79764213
  misc_feature 1..53: note = hyper
  source 1..53: mol_type = genomic DNA

SEQ ID NO: 52099 - DNA, 220 bp, Homo sapiens; identical to SEQ ID NO: 31330
  misc_feature 1..220: note = chr7:79764492-79764712
  misc_feature 1..220: note = hyper
  source 1..220: mol_type = genomic DNA

SEQ ID NO: 52100 - DNA, 61 bp, Homo sapiens; identical to SEQ ID NO: 31331
  misc_feature 1..61: note = chr7:79765016-79765077
  misc_feature 1..61: note = hyper
  source 1..61: mol_type = genomic DNA

SEQ ID NO: 52101 - DNA, 344 bp, Homo sapiens
  misc_feature 1..344: note = chr7:82072006-82072350
  misc_feature 1..344: note = hyper
  source 1..344: mol_type = genomic DNA
ttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaa

SEQ ID NO: 52102 - DNA, 59 bp, Homo sapiens
  misc_feature 1..59: note = chr7:82072503-82072562
  misc_feature 1..59: note = hyper
  source 1..59: mol_type = genomic DNA
tccagcggcgagcggcgcgcaccgcctgcccggcgtctccgcatccgagcctggctccc

SEQ ID NO: 52103 - DNA, 53 bp, Homo sapiens; identical to SEQ ID NO: 31333
  misc_feature 1..53: note = chr7:82072646-82072699
  misc_feature 1..53: note = hyper
  source 1..53: mol_type = genomic DNA

SEQ ID NO: 52104 - DNA, 59 bp, Homo sapiens; identical to SEQ ID NO: 31334
  misc_feature 1..59: note = chr7:82791978-82792037
  misc_feature 1..59: note = hyper
  source 1..59: mol_type = genomic DNA

SEQ ID NO: 52105 - DNA, 34 bp, Homo sapiens; identical to SEQ ID NO: 31335
  misc_feature 1..34: note = chr7:83277925-83277959
  misc_feature 1..34: note = hyper
  source 1..34: mol_type = genomic DNA

SEQ ID NO: 52106 - DNA, 45 bp, Homo sapiens; identical to SEQ ID NO: 9081
  misc_feature 1..45: note = chr7:83278225-83278270
  misc_feature 1..45: note = hyper
  source 1..45: mol_type = genomic DNA

SEQ ID NO: 52107 - DNA, 71 bp, Homo sapiens; identical to SEQ ID NO: 31337
  misc_feature 1..71: note = chr7:83824239-83824310
  misc_feature 1..71: note = hyper
  source 1..71: mol_type = genomic DNA

SEQ ID NO: 52108 - DNA, 59 bp, Homo sapiens; identical to SEQ ID NO: 31338
  misc_feature 1..59: note = chr7:84814638-84814697
  misc_feature 1..59: note = hyper
  source 1..59: mol_type = genomic DNA

SEQ ID NO: 52109 - DNA, 35 bp, Homo sapiens; identical to SEQ ID NO: 31339
  misc_feature 1..35: note = chr7:84815396-84815431
  misc_feature 1..35: note = hyper
  source 1..35: mol_type = genomic DNA

SEQ ID NO: 52110 - DNA, 127 bp, Homo sapiens; identical to SEQ ID NO: 31341
  misc_feature 1..127: note = chr7:84816225-84816352
  misc_feature 1..127: note = hyper
  source 1..127: mol_type = genomic DNA

SEQ ID NO: 52111 - DNA, 177 bp, Homo sapiens; identical to SEQ ID NO: 19722
  misc_feature 1..177: note = chr7:86273541-86273718
  misc_feature 1..177: note = hyper
  source 1..177: mol_type = genomic DNA

SEQ ID NO: 52112 - DNA, 13 bp, Homo sapiens
  misc_feature 1..13: note = chr7:86273719-86273732
  misc_feature 1..13: note = hyper
  source 1..13: mol_type = genomic DNA
gcttcagcctggt

SEQ ID NO: 52113 - DNA, 47 bp, Homo sapiens; identical to SEQ ID NO: 31344
  misc_feature 1..47: note = chr7:86274070-86274117
  misc_feature 1..47: note = hyper
  source 1..47: mol_type = genomic DNA

SEQ ID NO: 52114 - DNA, 39 bp, Homo sapiens; identical to SEQ ID NO: 31346
  misc_feature 1..39: note = chr7:86688488-86688527
  misc_feature 1..39: note = hyper
  source 1..39: mol_type = genomic DNA

SEQ ID NO: 52115-52116 - skipped (2 entries)

SEQ ID NO: 52117 - DNA, 90 bp, Homo sapiens; identical to SEQ ID NO: 19725
  misc_feature 1..90: note = chr7:87230433-87230523
  misc_feature 1..90: note = hyper
  source 1..90: mol_type = genomic DNA

SEQ ID NO: 52118 - DNA, 100 bp, Homo sapiens
  misc_feature 1..100: note = chr7:87256912-87257012
  misc_feature 1..100: note = hyper
  source 1..100: mol_type = genomic DNA
ctcctgcaggtaaaacggtgggtagtgagaagctctaggaagggggcgcttccgaacacgcgcgtcgaggagggcgttccaggactctgagggagcagcc

SEQ ID NO: 52119 - DNA, 413 bp, Homo sapiens; identical to SEQ ID NO: 31352
  misc_feature 1..413: note = chr7:87257327-87257740
  misc_feature 1..413: note = hyper
  source 1..413: mol_type = genomic DNA

SEQ ID NO: 52120 - DNA, 115 bp, Homo sapiens; identical to SEQ ID NO: 31353
  misc_feature 1..115: note = chr7:87258283-87258398
  misc_feature 1..115: note = hyper
  source 1..115: mol_type = genomic DNA

SEQ ID NO: 52121 - DNA, 64 bp, Homo sapiens; identical to SEQ ID NO: 31354
  misc_feature 1..64: note = chr7:87936120-87936184
  misc_feature 1..64: note = hyper
  source 1..64: mol_type = genomic DNA

SEQ ID NO: 52122 - DNA, 50 bp, Homo sapiens; identical to SEQ ID NO: 31355
  misc_feature 1..50: note = chr7:88387737-88387787
  misc_feature 1..50: note = hyper
  source 1..50: mol_type = genomic DNA

SEQ ID NO: 52123 - DNA, 30 bp, Homo sapiens; identical to SEQ ID NO: 31357
  misc_feature 1..30: note = chr7:88388282-88388312
  misc_feature 1..30: note = hyper
  source 1..30: mol_type = genomic DNA

SEQ ID NO: 52124 - DNA, 219 bp, Homo sapiens; identical to SEQ ID NO: 19729
  misc_feature 1..219: note = chr7:88388660-88388879
  misc_feature 1..219: note = hyper
  source 1..219: mol_type = genomic DNA

SEQ ID NO: 52125 - DNA, 223 bp, Homo sapiens
  misc_feature 1..223: note = chr7:89748340-89748563
  misc_feature 1..223: note = hyper
  source 1..223: mol_type = genomic DNA
gcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgg

SEQ ID NO: 52126 - DNA, 20 bp, Homo sapiens
  misc_feature 1..20: note = chr7:89841213-89841233
  misc_feature 1..20: note = hyper
  source 1..20: mol_type = genomic DNA
cgccgcggcagccaccctgc

SEQ ID NO: 52127 - skipped

SEQ ID NO: 52128 - DNA, 99 bp, Homo sapiens
  misc_feature 1..99: note = chr7:90226464-90226563
  misc_feature 1..99: note = hyper
  source 1..99: mol_type = genomic DNA
tggtattgtttaacgtatccaacctaaagggaagtgggacagttaccttgggacctattgttcggtacttcgggtcctggaaagcgagatttgggtgtt

SEQ ID NO: 52129 - DNA, 74 bp, Homo sapiens
  misc_feature 1..74: note = chr7:90894938-90895012
  misc_feature 1..74: note = hyper
  source 1..74: mol_type = genomic DNA
cagcaaccctcagcacggcggcggagggcaccgtggcggcttcccggggggcgccggcgcgtcggagcgaggca

SEQ ID NO: 52130 - DNA, 17 bp, Homo sapiens
  misc_feature 1..17: note = chr7:90895097-90895114
  misc_feature 1..17: note = hyper
  source 1..17: mol_type = genomic DNA
gccgaccaaggtgtatg

SEQ ID NO: 52131 - DNA, 43 bp, Homo sapiens; identical to SEQ ID NO: 31369
  misc_feature 1..43: note = chr7:91510048-91510091
  misc_feature 1..43: note = hyper
  source 1..43: mol_type = genomic DNA

SEQ ID NO: 52132 - DNA, 329 bp, Homo sapiens; identical to SEQ ID NO: 9101
  misc_feature 1..329: note = chr7:91808202-91808531
  misc_feature 1..329: note = hyper
  source 1..329: mol_type = genomic DNA

SEQ ID NO: 52133 - DNA, 81 bp, Homo sapiens
  misc_feature 1..81: note = chr7:92466400-92466481
  misc_feature 1..81: note = hyper
  source 1..81: mol_type = genomic DNA
cagggtcgcccagagttggggttttgacagggtgaagcggggggcatcctcactgtgtgacgtggacggatgggaaaaaca

SEQ ID NO: 52134 - DNA, 19 bp, Homo sapiens
  misc_feature 1..19: note = chr7:93203756-93203775
  misc_feature 1..19: note = hyper
  source 1..19: mol_type = genomic DNA
aacccgggaaggtccgcca

SEQ ID NO: 52135 - DNA, 34 bp, Homo sapiens; identical to SEQ ID NO: 19734
  misc_feature 1..34: note = chr7:93204298-93204332
  misc_feature 1..34: note = hyper
  source 1..34: mol_type = genomic DNA

SEQ ID NO: 52136 - DNA, 107 bp, Homo sapiens
  misc_feature 1..107: note = chr7:93204492-93204599
  misc_feature 1..107: note = hyper
  source 1..107: mol_type = genomic DNA
ttccacaagaaccttatcccagagacattgtgaccctggcttcttcagccgccactccggggacagcactagggagcctgtggagggagggtcggtagtgggctagg

SEQ ID NO: 52137 - DNA, 30 bp, Homo sapiens; identical to SEQ ID NO: 31374
  misc_feature 1..30: note = chr7:93205084-93205114
  misc_feature 1..30: note = hyper
  source 1..30: mol_type = genomic DNA

SEQ ID NO: 52138 - DNA, 147 bp, Homo sapiens
  misc_feature 1..147: note = chr7:93519204-93519351
  misc_feature 1..147: note = hyper
  source 1..147: mol_type = genomic DNA
atctttccctgagtccgcacaggcactgaattatgatcaatgtcagttgggagacaggaaatgtgttagtggttgtaaatttgtgattacttttaagaaactgaaaaccatgaggtttgcttaacacttgagaaaacccaggctaaa

SEQ ID NO: 52139 - DNA, 322 bp, Homo sapiens
  misc_feature 1..322: note = chr7:93520137-93520459
  misc_feature 1..322: note = hyper
  source 1..322: mol_type = genomic DNA
ggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaa

SEQ ID NO: 52140 - DNA, 270 bp, Homo sapiens
  misc_feature 1..270: note = chr7:93551053-93551323
  misc_feature 1..270: note = hyper
  source 1..270: mol_type = genomic DNA
cagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggc

SEQ ID NO: 52141 - DNA, 105 bp, Homo sapiens
  misc_feature 1..105: note = chr7:93551425-93551530
  misc_feature 1..105: note = hyper
  source 1..105: mol_type = genomic DNA
cccgagcccggttctggggcgaaaatgcctgcccttcacatcgaagatttgccagagaaggaaaaactgaaaatggaagttgagcagcttcgcaaagaagtgaag

SEQ ID NO: 52142 - DNA, 30 bp, Homo sapiens; identical to SEQ ID NO: 31379
  misc_feature 1..30: note = chr7:94024050-94024080
  misc_feature 1..30: note = hyper
  source 1..30: mol_type = genomic DNA

SEQ ID NO: 52143 - DNA, 223 bp, Homo sapiens; identical to SEQ ID NO: 19737
  misc_feature 1..223: note = chr7:94284873-94285096
  misc_feature 1..223: note = hyper
  source 1..223: mol_type = genomic DNA

SEQ ID NO: 52144 - DNA, 153 bp, Homo sapiens; identical to SEQ ID NO: 31381
  misc_feature 1..153: note = chr7:94536847-94537000
  misc_feature 1..153: note = hyper
  source 1..153: mol_type = genomic DNA

SEQ ID NO: 52145 - DNA, 131 bp, Homo sapiens; identical to SEQ ID NO: 31382
  misc_feature 1..131: note = chr7:95225822-95225953
  misc_feature 1..131: note = hyper
  source 1..131: mol_type = genomic DNA

SEQ ID NO: 52146 - DNA, 30 bp, Homo sapiens; identical to SEQ ID NO: 31383
  misc_feature 1..30: note = chr7:95226177-95226207
  misc_feature 1..30: note = hyper
  source 1..30: mol_type = genomic DNA

SEQ ID NO: 52147 - DNA, 30 bp, Homo sapiens; identical to SEQ ID NO: 31384
  misc_feature 1..30: note = chr7:95402081-95402111
  misc_feature 1..30: note = hyper
  source 1..30: mol_type = genomic DNA

SEQ ID NO: 52148 - DNA, 49 bp, Homo sapiens; identical to SEQ ID NO: 31385
  misc_feature 1..49: note = chr7:95402319-95402368
  misc_feature 1..49: note = hyper
  source 1..49: mol_type = genomic DNA

SEQ ID NO: 52149 - DNA, 88 bp, Homo sapiens
  misc_feature 1..88: note = chr7:96621811-96621899
  misc_feature 1..88: note = hyper
  source 1..88: mol_type = genomic DNA
gaggcttcgaatataaccttgcctatttctcgcctactgagatttctttccagaaaaggacattctcctgctccgaggagatggatcc

SEQ ID NO: 52150 - DNA, 53 bp, Homo sapiens
  misc_feature 1..53: note = chr7:96625720-96625773
  misc_feature 1..53: note = hyper
  source 1..53: mol_type = genomic DNA
cttgtcaagtatggttttaattaaacatcttccggcctcgaaagattacatgt

SEQ ID NO: 52151 - DNA, 24 bp, Homo sapiens
  misc_feature 1..24: note = chr7:96625974-96625998
  misc_feature 1..24: note = hyper
  source 1..24: mol_type = genomic DNA
gagcctgacaggtcccgggtccca

SEQ ID NO: 52152 - DNA, 161 bp, Homo sapiens
  misc_feature 1..161: note = chr7:96626051-96626212
  misc_feature 1..161: note = hyper
  source 1..161: mol_type = genomic DNA
taagtaactcaaacccgacccggcaagcgtggcccaagctgcttttgcagttggggacaattgagcggacacacaagttaatcccgcactgatttgtttcggatccatctgcaggacgcctgatgcctcccccttggctgctgcagcggacacctgcctcc

SEQ ID NO: 52153 - DNA, 118 bp, Homo sapiens; identical to SEQ ID NO: 9114
  misc_feature 1..118: note = chr7:96627308-96627426
  misc_feature 1..118: note = hyper
  source 1..118: mol_type = genomic DNA

SEQ ID NO: 52154 - DNA, 267 bp, Homo sapiens; identical to SEQ ID NO: 31391
  misc_feature 1..267: note = chr7:96633233-96633500
  misc_feature 1..267: note = hyper
  source 1..267: mol_type = genomic DNA

SEQ ID NO: 52155 - DNA, 50 bp, Homo sapiens; identical to SEQ ID NO: 31392
  misc_feature 1..50: note = chr7:96634276-96634326
  misc_feature 1..50: note = hyper
  source 1..50: mol_type = genomic DNA

SEQ ID NO: 52156 - DNA, 141 bp, Homo sapiens
  misc_feature 1..141: note = chr7:96635204-96635345
  misc_feature 1..141: note = hyper
  source 1..141: mol_type = genomic DNA
ctgcagaggggagagcggcgcgagccaagtgggggagggtggaggaaacccgggagaaggctttctccagcccccaaagtttttgatgatgaccatgactacgatggctgacggcttggaaggccaggactcgtccaaatc

SEQ ID NO: 52157 - DNA, 104 bp, Homo sapiens; identical to SEQ ID NO: 9117
  misc_feature 1..104: note = chr7:96635486-96635590
  misc_feature 1..104: note = hyper
  source 1..104: mol_type = genomic DNA

SEQ ID NO: 52158 - DNA, 114 bp, Homo sapiens; identical to SEQ ID NO: 19744
  misc_feature 1..114: note = chr7:96635619-96635733
  misc_feature 1..114: note = hyper
  source 1..114: mol_type = genomic DNA

SEQ ID NO: 52159 - DNA, 162 bp, Homo sapiens
  misc_feature 1..162: note = chr7:96636645-96636807
  misc_feature 1..162: note = hyper
  source 1..162: mol_type = genomic DNA
cgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggacc

SEQ ID NO: 52160 - DNA, 82 bp, Homo sapiens; identical to SEQ ID NO: 31398
  misc_feature 1..82: note = chr7:96642045-96642127
  misc_feature 1..82: note = hyper
  source 1..82: mol_type = genomic DNA

SEQ ID NO: 52161 - DNA, 809 bp, Homo sapiens; identical to SEQ ID NO: 31399
  misc_feature 1..809: note = chr7:96645617-96646426
  misc_feature 1..809: note = hyper
  source 1..809: mol_type = genomic DNA

SEQ ID NO: 52162 - DNA, 10 bp, Homo sapiens
  misc_feature 1..10: note = chr7:96646652-96646662
  misc_feature 1..10: note = hyper
  source 1..10: mol_type = genomic DNA
gcacccacag

SEQ ID NO: 52163 - DNA, 206 bp, Homo sapiens
  misc_feature 1..206: note = chr7:96647131-96647337
  misc_feature 1..206: note = hyper
  source 1..206: mol_type = genomic DNA
ggagaggaagagaaggtggaagggagggcaagggagagaaacatcacatagatatttttagactttgctgaagatctgttatttttacatccttgggctcgggacggcagggagttaaattcccctgagagaatccccatggggccagggaaagcccgctgcagactggtttaccagaatatttttgtccacggctcccagaccaa

SEQ ID NO: 52164 - DNA, 49 bp, Homo sapiens
  misc_feature 1..49: note = chr7:96647760-96647809
  misc_feature 1..49: note = hyper
  source 1..49: mol_type = genomic DNA
ggtgtgcagtgggtgcgccctcacccccaaccttcccaaacacgcaccc

SEQ ID NO: 52165 - DNA, 13 bp, Homo sapiens
  misc_feature 1..13: note = chr7:96648219-96648232
  misc_feature 1..13: note = hyper
  source 1..13: mol_type = genomic DNA
gagccaggctgcg

SEQ ID NO: 52166 - DNA, 16 bp, Homo sapiens
  misc_feature 1..16: note = chr7:96650421-96650437
  misc_feature 1..16: note = hyper
  source 1..16: mol_type = genomic DNA
tcgcccgcgccttccc

SEQ ID NO: 52167 - DNA, 124 bp, Homo sapiens
  misc_feature 1..124: note = chr7:96651151-96651275
  misc_feature 1..124: note = hyper
  source 1..124: mol_type = genomic DNA
ttgttaagaaaaccagatagctgctctgggctgcctaggccgccctagaaataaccctccgcttgctttcaacccgcgaaattggccccacagctccggaggcccgctacggggtgggggcggg

SEQ ID NO: 52168 - DNA, 118 bp, Homo sapiens; identical to SEQ ID NO: 31404
  misc_feature 1..118: note = chr7:96651845-96651963
  misc_feature 1..118: note = hyper
  source 1..118: mol_type = genomic DNA

SEQ ID NO: 52169 - DNA, 127 bp, Homo sapiens
  misc_feature 1..127: note = chr7:96652017-96652144
  misc_feature 1..127: note = hyper
  source 1..127: mol_type = genomic DNA
cgtttccgcccctccccaggcttcaagaacaccagcccctccccaggcttcaaggaggtggccctgggccgtgaccctacttctgtcggcgtctgttcgggcgcccgcagaagccagactcttgggc

SEQ ID NO: 52170 - DNA, 55 bp, Homo sapiens
  misc_feature 1..55: note = chr7:96653452-96653507
  misc_feature 1..55: note = hyper
  source 1..55: mol_type = genomic DNA
cctactcccttctgccgcgtgcgcccccactgccgtgaaccgctgtgacccccaa

SEQ ID NO: 52171 - DNA, 60 bp, Homo sapiens
  misc_feature 1..60: note = chr7:96653993-96654053
  misc_feature 1..60: note = hyper
  source 1..60: mol_type = genomic DNA
ttggctgtggggctgctctggtctaagcagacatggctgtgggagcgagggaggaggagg

SEQ ID NO: 52172 - DNA, 83 bp, Homo sapiens; identical to SEQ ID NO: 31408
  misc_feature 1..83: note = chr7:96656775-96656858
  misc_feature 1..83: note = hyper
  source 1..83: mol_type = genomic DNA

SEQ ID NO: 52173 - DNA, 93 bp, Homo sapiens
  misc_feature 1..93: note = chr7:97361005-97361098
  misc_feature 1..93: note = hyper
  source 1..93: mol_type = genomic DNA
tgcaacttatcctgacgtctcgagggacggaaaagttaccgaagtccaaggaatgagtcactttgctcaaatttgatgagtaatatcaggtgt

SEQ ID NO: 52174 - DNA, 105 bp, Homo sapiens
  misc_feature 1..105: note = chr7:97362187-97362292
  misc_feature 1..105: note = hyper
  source 1..105: mol_type = genomic DNA
aggggcactatttcccgggttccccacgggattttgtgcccacgattcaagtttcttcccgagggctgcaccgtccggcccaggaactccctgcagtagggatgc

SEQ ID NO: 52175 - DNA, 98 bp, Homo sapiens; identical to SEQ ID NO: 19752
  misc_feature 1..98: note = chr7:97362607-97362705
  misc_feature 1..98: note = hyper
  source 1..98: mol_type = genomic DNA

SEQ ID NO: 52176 - DNA, 586 bp, Homo sapiens; identical to SEQ ID NO: 31412
  misc_feature 1..586: note = chr7:97362706-97363292
  misc_feature 1..586: note = hyper
  source 1..586: mol_type = genomic DNA

SEQ ID NO: 52177 - DNA, 75 bp, Homo sapiens; identical to SEQ ID NO: 31413
  misc_feature 1..75: note = chr7:97680670-97680745
  misc_feature 1..75: note = hyper
  source 1..75: mol_type = genomic DNA

SEQ ID NO: 52178 - DNA, 29 bp, Homo sapiens
  misc_feature 1..29: note = chr7:98245856-98245885
  misc_feature 1..29: note = hyper
  source 1..29: mol_type = genomic DNA
cgtgactttgtccctaactccgggtgtcc

SEQ ID NO: 52179 - DNA, 258 bp, Homo sapiens; identical to SEQ ID NO: 19755
  misc_feature 1..258: note = chr7:98246868-98247126
  misc_feature 1..258: note = hyper
  source 1..258: mol_type = genomic DNA

SEQ ID NO: 52180 - DNA, 192 bp, Homo sapiens
  misc_feature 1..192: note = chr7:98247656-98247848
  misc_feature 1..192: note = hyper
  source 1..192: mol_type = genomic DNA
tctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggg

SEQ ID NO: 52181 - DNA, 199 bp, Homo sapiens; identical to SEQ ID NO: 31417
  misc_feature 1..199: note = chr7:99149223-99149422
  misc_feature 1..199: note = hyper
  source 1..199: mol_type = genomic DNA

SEQ ID NO: 52182 - DNA, 15 bp, Homo sapiens
  misc_feature 1..15: note = chr7:99155799-99155814
  misc_feature 1..15: note = hyper
  source 1..15: mol_type = genomic DNA
aggccccgcaatcct

SEQ ID NO: 52183 - DNA, 195 bp, Homo sapiens; identical to SEQ ID NO: 9139
  misc_feature 1..195: note = chr7:99155931-99156126
  misc_feature 1..195: note = hyper
  source 1..195: mol_type = genomic DNA

SEQ ID NO: 52184 - DNA, 82 bp, Homo sapiens; identical to SEQ ID NO: 31420
  misc_feature 1..82: note = chr7:99156127-99156209
  misc_feature 1..82: note = hyper
  source 1..82: mol_type = genomic DNA

SEQ ID NO: 52185 - DNA, 128 bp, Homo sapiens; identical to SEQ ID NO: 31421
  misc_feature 1..128: note = chr7:99156472-99156600
  misc_feature 1..128: note = hyper
  source 1..128: mol_type = genomic DNA

SEQ ID NO: 52186 - DNA, 100 bp, Homo sapiens; identical to SEQ ID NO: 9141
  misc_feature 1..100: note = chr7:99156815-99156915
  misc_feature 1..100: note = hyper
  source 1..100: mol_type = genomic DNA

SEQ ID NO: 52187 - DNA, 48 bp, Homo sapiens; identical to SEQ ID NO: 19761
  misc_feature 1..48: note = chr7:99177694-99177742
  misc_feature 1..48: note = hyper
  source 1..48: mol_type = genomic DNA

SEQ ID NO: 52188 - DNA, 413 bp, Homo sapiens
  misc_feature 1..413: note = chr7:99177870-99178283
  misc_feature 1..413: note = hyper
  source 1..413: mol_type = genomic DNA
ctccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatc

SEQ ID NO: 52189 - DNA, 15 bp, Homo sapiens
  misc_feature 1..15: note = chr7:99595179-99595194
  misc_feature 1..15: note = hyper
  source 1..15: mol_type = genomic DNA
ctcccttttgactca

SEQ ID NO: 52190 - DNA, 30 bp, Homo sapiens; identical to SEQ ID NO: 31425
  misc_feature 1..30: note = chr7:99595608-99595638
  misc_feature 1..30: note = hyper
  source 1..30: mol_type = genomic DNA

SEQ ID NO: 52191 - DNA, 54 bp, Homo sapiens; identical to SEQ ID NO: 31426
  misc_feature 1..54: note = chr7:100091127-100091181
  misc_feature 1..54: note = hyper
  source 1..54: mol_type = genomic DNA

SEQ ID NO: 52192 - DNA, 236 bp, Homo sapiens; identical to SEQ ID NO: 31427
  misc_feature 1..236: note = chr7:100167379-100167615
  misc_feature 1..236: note = hyper
  source 1..236: mol_type = genomic DNA

SEQ ID NO: 52193 - DNA, 113 bp, Homo sapiens; identical to SEQ ID NO: 31428
  misc_feature 1..113: note = chr7:100167860-100167973
  misc_feature 1..113: note = hyper
  source 1..113: mol_type = genomic DNA

SEQ ID NO: 52194 - DNA, 39 bp, Homo sapiens; identical to SEQ ID NO: 31429
  misc_feature 1..39: note = chr7:100254093-100254132
  misc_feature 1..39: note = hyper
  source 1..39: mol_type = genomic DNA

SEQ ID NO: 52195 - DNA, 39 bp, Homo sapiens
  misc_feature 1..39: note = chr7:100318466-100318505
  misc_feature 1..39: note = hyper
  source 1..39: mol_type = genomic DNA
cgcgccccctggacagccgccctctcctccaggcccgtg

SEQ ID NO: 52196 - DNA, 160 bp, Homo sapiens
  misc_feature 1..160: note = chr7:100318575-100318735
  misc_feature 1..160: note = hyper
  source 1..160: mol_type = genomic DNA
cgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggac

SEQ ID NO: 52197 - DNA, 30 bp, Homo sapiens; identical to SEQ ID NO: 31431
  misc_feature 1..30: note = chr7:100770176-100770206
  misc_feature 1..30: note = hyper
  source 1..30: mol_type = genomic DNA

SEQ ID NO: 52198 - DNA, 169 bp, Homo sapiens; identical to SEQ ID NO: 31432
  misc_feature 1..169: note = chr7:100807589-100807758
  misc_feature 1..169: note = hyper
  source 1..169: mol_type = genomic DNA

SEQ ID NO: 52199 - DNA, 77 bp, Homo sapiens
  misc_feature 1..77: note = chr7:100808389-100808466
  misc_feature 1..77: note = hyper
  source 1..77: mol_type = genomic DNA
ccatctcactgccatcgcccacgtactaagcagcagcaatatgggggaaaaaaaaatctctgctccctccccgtagg

SEQ ID NO: 52200 - DNA, 73 bp, Homo sapiens
  misc_feature 1..73: note = chr7:100809363-100809436
  misc_feature 1..73: note = hyper
  source 1..73: mol_type = genomic DNA
ccgggttccccaccccgagaccacgcgcccaaggacggcgtgaacctgagtgcagagggacagatctgcacgc

SEQ ID NO: 52201 - DNA, 18 bp, Homo sapiens
  misc_feature 1..18: note = chr7:100809521-100809539
  misc_feature 1..18: note = hyper
  source 1..18: mol_type = genomic DNA
catcgggaagggtccgag

SEQ ID NO: 52202 - DNA, 30 bp, Homo sapiens; identical to SEQ ID NO: 31435
  misc_feature 1..30: note = chr7:100817707-100817737
  misc_feature 1..30: note = hyper
  source 1..30: mol_type = genomic DNA

SEQ ID NO: 52203 - DNA, 30 bp, Homo sapiens; identical to SEQ ID NO: 31436
  misc_feature 1..30: note = chr7:100822573-100822603
  misc_feature 1..30: note = hyper
  source 1..30: mol_type = genomic DNA

SEQ ID NO: 52204 - DNA, 259 bp, Homo sapiens; identical to SEQ ID NO: 31437
  misc_feature 1..259: note = chr7:100823092-100823351
  misc_feature 1..259: note = hyper
  source 1..259: mol_type = genomic DNA

SEQ ID NO: 52205 - DNA, 56 bp, Homo sapiens; identical to SEQ ID NO: 19768
  misc_feature 1..56: note = chr7:100823380-100823436
  misc_feature 1..56: note = hyper
  source 1..56: mol_type = genomic DNA

SEQ ID NO: 52206 - DNA, 203 bp, Homo sapiens
  misc_feature 1..203: note = chr7:100823497-100823700
  misc_feature 1..203: note = hyper
  source 1..203: mol_type = genomic DNA
tcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgc

SEQ ID NO: 52207 - DNA, 30 bp, Homo sapiens; identical to SEQ ID NO: 9151
  misc_feature 1..30: note = chr7:100845392-100845422
  misc_feature 1..30: note = hyper
  source 1..30: mol_type = genomic DNA

SEQ ID NO: 52208 - DNA, 210 bp, Homo sapiens; identical to SEQ ID NO: 31440
  misc_feature 1..210: note = chr7:100943301-100943511
  misc_feature 1..210: note = hyper
  source 1..210: mol_type = genomic DNA

SEQ ID NO: 52209 - DNA, 30 bp, Homo sapiens; identical to SEQ ID NO: 31441
  misc_feature 1..30: note = chr7:100946628-100946658
  misc_feature 1..30: note = hyper
  source 1..30: mol_type = genomic DNA

SEQ ID NO: 52210 - DNA, 30 bp, Homo sapiens; identical to SEQ ID NO: 31442
  misc_feature 1..30: note = chr7:100951829-100951859
  misc_feature 1..30: note = hyper
  source 1..30: mol_type = genomic DNA

SEQ ID NO: 52211 - DNA, 434 bp, Homo sapiens; identical to SEQ ID NO: 31443
  misc_feature 1..434: note = chr7:101006050-101006484
  misc_feature 1..434: note = hyper
  source 1..434: mol_type = genomic DNA

SEQ ID NO: 52212 - DNA, 34 bp, Homo sapiens; identical to SEQ ID NO: 19773
  misc_feature 1..34: note = chr7:103085842-103085876
  misc_feature 1..34: note = hyper
  source 1..34: mol_type = genomic DNA

SEQ ID NO: 52213 - DNA, 260 bp, Homo sapiens
  misc_feature 1..260: note = chr7:103086474-103086734
  misc_feature 1..260: note = hyper
  source 1..260: mol_type = genomic DNA
gcgggcctcagctcagtcccctcccgagggaccgcgacccccggccccgcggccgcccgcgcgcactcaccagcccgggctgccctgggcggagccgccccgccgcgctccacagccgctgcctcttcgacgcgcgcgctgcctccaggtgcggctctaggaggaggcgccgcgggcagtgccggccgcgccccgcgactcccggtaacccgagcccgccccgccccgctagggccaggccccgccgccaccctccgcgc

SEQ ID NO: 52214 - DNA, 109 bp, Homo sapiens; identical to SEQ ID NO: 9157
  misc_feature 1..109: note = chr7:103630363-103630472
  misc_feature 1..109: note = hyper
  source 1..109: mol_type = genomic DNA

SEQ ID NO: 52215 - DNA, 194 bp, Homo sapiens
  misc_feature 1..194: note = chr7:103630824-103631018
  misc_feature 1..194: note = hyper
  source 1..194: mol_type = genomic DNA
gtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 52216 - DNA, 251 bp, Homo sapiens; identical to SEQ ID NO: 3084
  misc_feature 1..251: note = chr7:103968915-103969166
  misc_feature 1..251: note = hyper
  source 1..251: mol_type = genomic DNA

SEQ ID NO: 52217 - DNA, 50 bp, Homo sapiens; identical to SEQ ID NO: 19777
  misc_feature 1..50: note = chr7:103969167-103969217
  misc_feature 1..50: note = hyper
  source 1..50: mol_type = genomic DNA

SEQ ID NO: 52218 - DNA, 181 bp, Homo sapiens; identical to SEQ ID NO: 19778
  misc_feature 1..181: note = chr7:103969341-103969522
  misc_feature 1..181: note = hyper
  source 1..181: mol_type = genomic DNA

SEQ ID NO: 52219 - DNA, 15 bp, Homo sapiens
  misc_feature 1..15: note = chr7:103969562-103969577
  misc_feature 1..15: note = hyper
  source 1..15: mol_type = genomic DNA
cggcctctccatgat

SEQ ID NO: 52220 - DNA, 115 bp, Homo sapiens; identical to SEQ ID NO: 31452
  misc_feature 1..115: note = chr7:103969892-103970007
  misc_feature 1..115: note = hyper
  source 1..115: mol_type = genomic DNA

SEQ ID NO: 52221 - DNA, 82 bp, Homo sapiens; identical to SEQ ID NO: 31453
  misc_feature 1..82: note = chr7:106684832-106684914
  misc_feature 1..82: note = hyper
  source 1..82: mol_type = genomic DNA

SEQ ID NO: 52222 - DNA, 433 bp, Homo sapiens; identical to SEQ ID NO: 31454
  misc_feature 1..433: note = chr7:106685345-106685778
  misc_feature 1..433: note = hyper
  source 1..433: mol_type = genomic DNA

SEQ ID NO: 52223 - DNA, 512 bp, Homo sapiens
  misc_feature 1..512: note = chr7:107300982-107301494
  misc_feature 1..512: note = hyper
  source 1..512: mol_type = genomic DNA
ccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagc

SEQ ID NO: 52224 - DNA, 141 bp, Homo sapiens; identical to SEQ ID NO: 19781
  misc_feature 1..141: note = chr7:107301640-107301781
  misc_feature 1..141: note = hyper
  source 1..141: mol_type = genomic DNA

SEQ ID NO: 52225 - DNA, 50 bp, Homo sapiens; identical to SEQ ID NO: 31456
  misc_feature 1..50: note = chr7:107642639-107642689
  misc_feature 1..50: note = hyper
  source 1..50: mol_type = genomic DNA

SEQ ID NO: 52226 - DNA, 72 bp, Homo sapiens; identical to SEQ ID NO: 31457
  misc_feature 1..72: note = chr7:107643722-107643794
  misc_feature 1..72: note = hyper
  source 1..72: mol_type = genomic DNA

SEQ ID NO: 52227 - DNA, 216 bp, Homo sapiens
  misc_feature 1..216: note = chr7:108095362-108095578
  misc_feature 1..216: note = hyper
  source 1..216: mol_type = genomic DNA
gctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcag

SEQ ID NO: 52228 - DNA, 833 bp, Homo sapiens
  misc_feature 1..833: note = chr7:108096055-108096888
  misc_feature 1..833: note = hyper
  source 1..833: mol_type = genomic DNA
ccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgc

SEQ ID NO: 52229 - DNA, 33 bp, Homo sapiens
  misc_feature 1..33: note = chr7:108097139-108097172
  misc_feature 1..33: note = hyper
  source 1..33: mol_type = genomic DNA
ccgtcagcctgcgagcgcgtgtggcggcggggg

SEQ ID NO: 52230 - DNA, 17 bp, Homo sapiens
  misc_feature 1..17: note = chr7:108097491-108097508
  misc_feature 1..17: note = hyper
  source 1..17: mol_type = genomic DNA
cgcggtagaaactgggt

SEQ ID NO: 52231 - DNA, 57 bp, Homo sapiens; identical to SEQ ID NO: 9167
  misc_feature 1..57: note = chr7:112726853-112726910
  misc_feature 1..57: note = hyper
  source 1..57: mol_type = genomic DNA

SEQ ID NO: 52232 - DNA, 114 bp, Homo sapiens
  misc_feature 1..114: note = chr7:113722696-113722810
  misc_feature 1..114: note = hyper
  source 1..114: mol_type = genomic DNA
ttctaatttgtcattcgcgtgcgtcgctttccttcatcttggctatacttcctctcatctgcggtgttttatttcgcgcaagatgcgctgacagaggccatttcaaacgaattt

SEQ ID NO: 52233 - DNA, 144 bp, Homo sapiens; identical to SEQ ID NO: 19785
  misc_feature 1..144: note = chr7:113723439-113723583
  misc_feature 1..144: note = hyper
  source 1..144: mol_type = genomic DNA

SEQ ID NO: 52234 - DNA, 201 bp, Homo sapiens; identical to SEQ ID NO: 19786
  misc_feature 1..201: note = chr7:113724755-113724956
  misc_feature 1..201: note = hyper
  source 1..201: mol_type = genomic DNA

SEQ ID NO: 52235 - DNA, 391 bp, Homo sapiens
  misc_feature 1..391: note = chr7:113725081-113725472
  misc_feature 1..391: note = hyper
  source 1..391: mol_type = genomic DNA
gggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgaga

SEQ ID NO: 52236 - DNA, 30 bp, Homo sapiens; identical to SEQ ID NO: 31465
  misc_feature 1..30: note = chr7:113725787-113725817
  misc_feature 1..30: note = hyper
  source 1..30: mol_type = genomic DNA

SEQ ID NO: 52237 - DNA, 422 bp, Homo sapiens
  misc_feature 1..422: note = chr7:113726087-113726509
  misc_feature 1..422: note = hyper
  source 1..422: mol_type = genomic DNA
tatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgc

SEQ ID NO: 52238 - DNA, 47 bp, Homo sapiens; identical to SEQ ID NO: 9171
  misc_feature 1..47: note = chr7:113726751-113726798
  misc_feature 1..47: note = hyper
  source 1..47: mol_type = genomic DNA

SEQ ID NO: 52239 - DNA, 140 bp, Homo sapiens
  misc_feature 1..140: note = chr7:113727486-113727626
  misc_feature 1..140: note = hyper
  source 1..140: mol_type = genomic DNA
gggtgggtttggggtgaaatcgcacctcgcggcacttggtgaggggacgtgggaggagcgcagacacctttcggtgatagggagggcttctcacttggctgttacctggaagtccacagtggccccggcgggcaggcggg

SEQ ID NO: 52240 - DNA, 27 bp, Homo sapiens
  misc_feature 1..27: note = chr7:113727781-113727808
  misc_feature 1..27: note = hyper
  source 1..27: mol_type = genomic DNA
cgccctgacacccgacctcagtgtgga

SEQ ID NO: 52241 - DNA, 92 bp, Homo sapiens; identical to SEQ ID NO: 31470
  misc_feature 1..92: note = chr7:114562185-114562277
  misc_feature 1..92: note = hyper
  source 1..92: mol_type = genomic DNA

SEQ ID NO: 52242 - DNA, 317 bp, Homo sapiens; identical to SEQ ID NO: 31471
  misc_feature 1..317: note = chr7:114562326-114562643
  misc_feature 1..317: note = hyper
  source 1..317: mol_type = genomic DNA

SEQ ID NO: 52243 - DNA, 440 bp, Homo sapiens; identical to SEQ ID NO: 31472
  misc_feature 1..440: note = chr7:114562960-114563400
  misc_feature 1..440: note = hyper
  source 1..440: mol_type = genomic DNA

SEQ ID NO: 52244 - DNA, 52 bp, Homo sapiens; identical to SEQ ID NO: 19793
  misc_feature 1..52: note = chr7:115117500-115117552
  misc_feature 1..52: note = hyper
  source 1..52: mol_type = genomic DNA

SEQ ID NO: 52245 - DNA, 80 bp, Homo sapiens; identical to SEQ ID NO: 19794
  misc_feature 1..80: note = chr7:115117647-115117727
  misc_feature 1..80: note = hyper
  source 1..80: mol_type = genomic DNA

SEQ ID NO: 52246 - DNA, 30 bp, Homo sapiens; identical to SEQ ID NO: 31474
  misc_feature 1..30: note = chr7:116140161-116140191
  misc_feature 1..30: note = hyper
  source 1..30: mol_type = genomic DNA

SEQ ID NO: 52247 - DNA, 16 bp, Homo sapiens
  misc_feature 1..16: note = chr7:116962550-116962566
  misc_feature 1..16: note = hyper
  source 1..16: mol_type = genomic DNA
ctgggatgggggaggc

SEQ ID NO: 52248 - DNA, 267 bp, Homo sapiens
  misc_feature 1..267: note = chr7:116962626-116962893
  misc_feature 1..267: note = hyper
  source 1..267: mol_type = genomic DNA
gtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaaggg

SEQ ID NO: 52249 - DNA, 125 bp, Homo sapiens
  misc_feature 1..125: note = chr7:116963476-116963601
  misc_feature 1..125: note = hyper
  source 1..125: mol_type = genomic DNA
atcgctgcatggttacgagcacacgcgaatacaggaacctttagggaagctccaggccaaagagcatccgtgggctctcggagcgtgcgttccggattgccgaggccatccgctggcaaacaagt

SEQ ID NO: 52250 - DNA, 337 bp, Homo sapiens; identical to SEQ ID NO: 31478
  misc_feature 1..337: note = chr7:116963872-116964209
  misc_feature 1..337: note = hyper
  source 1..337: mol_type = genomic DNA

SEQ ID NO: 52251 - DNA, 154 bp, Homo sapiens; identical to SEQ ID NO: 31479
  misc_feature 1..154: note = chr7:116964456-116964610
  misc_feature 1..154: note = hyper
  source 1..154: mol_type = genomic DNA

SEQ ID NO: 52252 - DNA, 39 bp, Homo sapiens; identical to SEQ ID NO: 31481
  misc_feature 1..39: note = chr7:117512371-117512410
  misc_feature 1..39: note = hyper
  source 1..39: mol_type = genomic DNA

SEQ ID NO: 52253 - DNA, 46 bp, Homo sapiens; identical to SEQ ID NO: 31482
  misc_feature 1..46: note = chr7:117512808-117512854
  misc_feature 1..46: note = hyper
  source 1..46: mol_type = genomic DNA

SEQ ID NO: 52254 - DNA, 35 bp, Homo sapiens; identical to SEQ ID NO: 31483
  misc_feature 1..35: note = chr7:117513436-117513471
  misc_feature 1..35: note = hyper
  source 1..35: mol_type = genomic DNA

SEQ ID NO: 52255 - DNA, 126 bp, Homo sapiens; identical to SEQ ID NO: 31484
  misc_feature 1..126: note = chr7:119912968-119913094
  misc_feature 1..126: note = hyper
  source 1..126: mol_type = genomic DNA

SEQ ID NO: 52256 - DNA, 41 bp, Homo sapiens; identical to SEQ ID NO: 31485
  misc_feature 1..41: note = chr7:119913455-119913496
  misc_feature 1..41: note = hyper
  source 1..41: mol_type = genomic DNA

SEQ ID NO: 52257 - DNA, 53 bp, Homo sapiens; identical to SEQ ID NO: 31486
  misc_feature 1..53: note = chr7:120969300-120969353
  misc_feature 1..53: note = hyper
  source 1..53: mol_type = genomic DNA

SEQ ID NO: 52258 - DNA, 22 bp, Homo sapiens
  misc_feature 1..22: note = chr7:120969650-120969672
  misc_feature 1..22: note = hyper
  source 1..22: mol_type = genomic DNA
agagaagctgggctgcgccaat

SEQ ID NO: 52259 - DNA, 51 bp, Homo sapiens
  misc_feature 1..51: note = chr7:120969800-120969851
  misc_feature 1..51: note = hyper
  source 1..51: mol_type = genomic DNA
catgatcaccgccgccgccactaccgccccgatgggcgccagccccctctt

SEQ ID NO: 52260 - DNA, 600 bp, Homo sapiens; identical to SEQ ID NO: 31488
  misc_feature 1..600: note = chr7:120970100-120970700
  misc_feature 1..600: note = hyper
  source 1..600: mol_type = genomic DNA

SEQ ID NO: 52261 - DNA, 215 bp, Homo sapiens
  misc_feature 1..215: note = chr7:121513709-121513924
  misc_feature 1..215: note = hyper
  source 1..215: mol_type = genomic DNA
ctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctc

SEQ ID NO: 52262 - DNA, 258 bp, Homo sapiens; identical to SEQ ID NO: 31490
  misc_feature 1..258: note = chr7:121783508-121783766
  misc_feature 1..258: note = hyper
  source 1..258: mol_type = genomic DNA

SEQ ID NO: 52263 - DNA, 67 bp, Homo sapiens; identical to SEQ ID NO: 31491
  misc_feature 1..67: note = chr7:121784215-121784282
  misc_feature 1..67: note = hyper
  source 1..67: mol_type = genomic DNA

SEQ ID NO: 52264 - DNA, 176 bp, Homo sapiens
  misc_feature 1..176: note = chr7:121940448-121940624
  misc_feature 1..176: note = hyper
  source 1..176: mol_type = genomic DNA
gtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatg

SEQ ID NO: 52265 - DNA, 32 bp, Homo sapiens; identical to SEQ ID NO: 19804
  misc_feature 1..32: note = chr7:121940903-121940935
  misc_feature 1..32: note = hyper
  source 1..32: mol_type = genomic DNA

SEQ ID NO: 52266 - DNA, 38 bp, Homo sapiens
  misc_feature 1..38: note = chr7:121941052-121941090
  misc_feature 1..38: note = hyper
  source 1..38: mol_type = genomic DNA
acattgcatacagctactggatacgttgttcccattta

SEQ ID NO: 52267 - DNA, 31 bp, Homo sapiens
  misc_feature 1..31: note = chr7:121942170-121942201
  misc_feature 1..31: note = hyper
  source 1..31: mol_type = genomic DNA
ttcgccagctggcgtgcgggccagccccagg

SEQ ID NO: 52268 - DNA, 15 bp, Homo sapiens
  misc_feature 1..15: note = chr7:121943974-121943989
  misc_feature 1..15: note = hyper
  source 1..15: mol_type = genomic DNA
ccgggtggcatgggc

SEQ ID NO: 52269 - DNA, 123 bp, Homo sapiens; identical to SEQ ID NO: 706
  misc_feature 1..123: note = chr7:121944176-121944299
  misc_feature 1..123: note = hyper
  source 1..123: mol_type = genomic DNA

SEQ ID NO: 52270 - DNA, 30 bp, Homo sapiens; identical to SEQ ID NO: 31498
  misc_feature 1..30: note = chr7:121944621-121944651
  misc_feature 1..30: note = hyper
  source 1..30: mol_type = genomic DNA

SEQ ID NO: 52271 - DNA, 142 bp, Homo sapiens; identical to SEQ ID NO: 31499
  misc_feature 1..142: note = chr7:121945611-121945753
  misc_feature 1..142: note = hyper
  source 1..142: mol_type = genomic DNA

SEQ ID NO: 52272 - DNA, 46 bp, Homo sapiens; identical to SEQ ID NO: 9197
  misc_feature 1..46: note = chr7:121946080-121946126
  misc_feature 1..46: note = hyper
  source 1..46: mol_type = genomic DNA

SEQ ID NO: 52273 - DNA, 35 bp, Homo sapiens
  misc_feature 1..35: note = chr7:121950102-121950137
  misc_feature 1..35: note = hyper
  source 1..35: mol_type = genomic DNA
ccatgaaataaaagtcgataatagaaattaaaaca

SEQ ID NO: 52274 - DNA, 14 bp, Homo sapiens
  misc_feature 1..14: note = chr7:121951863-121951877
  misc_feature 1..14: note = hyper
  source 1..14: mol_type = genomic DNA
ggctcctggaaaca

SEQ ID NO: 52275 - DNA, 40 bp, Homo sapiens; identical to SEQ ID NO: 31507
  misc_feature 1..40: note = chr7:121955281-121955321
  misc_feature 1..40: note = hyper
  source 1..40: mol_type = genomic DNA

SEQ ID NO: 52276 - DNA, 459 bp, Homo sapiens; identical to SEQ ID NO: 31508
  misc_feature 1..459: note = chr7:121955381-121955840
  misc_feature 1..459: note = hyper
  source 1..459: mol_type = genomic DNA

SEQ ID NO: 52277 - DNA, 30 bp, Homo sapiens; identical to SEQ ID NO: 31509
  misc_feature 1..30: note = chr7:121956177-121956207
  misc_feature 1..30: note = hyper
  source 1..30: mol_type = genomic DNA

SEQ ID NO: 52278 - DNA, 28 bp, Homo sapiens
  misc_feature 1..28: note = chr7:121956458-121956486
  misc_feature 1..28: note = hyper
  source 1..28: mol_type = genomic DNA
tccccatcttcaatccgaagctggggta

SEQ ID NO: 52279 - DNA, 15 bp, Homo sapiens
  misc_feature 1..15: note = chr7:121956567-121956582
  misc_feature 1..15: note = hyper
  source 1..15: mol_type = genomic DNA
ctctccgctactgcc

SEQ ID NO: 52280 - DNA, 211 bp, Homo sapiens
  misc_feature 1..211: note = chr7:123172939-123173150
  misc_feature 1..211: note = hyper
  source 1..211: mol_type = genomic DNA
gcttggcgcggaaggcgccgccagtgaccggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaag

SEQ ID NO: 52281 - DNA, 32 bp, Homo sapiens
  misc_feature 1..32: note = chr7:123672016-123672048
  misc_feature 1..32: note = hyper
  source 1..32: mol_type = genomic DNA
gcccataaaattgagcgggtagtgagaatagt

SEQ ID NO: 52282 - DNA, 435 bp, Homo sapiens
  misc_feature 1..435: note = chr7:123672086-123672521
  misc_feature 1..435: note = hyper
  source 1..435: mol_type = genomic DNA
caggacagctcccacacgtagatgaagatcacgtagatgggcacccgcttccaagtgccccaaccgcggctgtagtggaggtggaagtagagcttttccaccacgaaactgcagctgccgtacataaagaaggaccagagcgacgtgtggccgctggttgtcccgtccccctgccccagtacgttgaagaagaaggtgaagaagatctcatccagaaagccgtgcattccgaagaaaagaaagcggggtaggtcgggcagcccctggctgggggctcccccggcgcccctggggccacggggtcgtcgccgccgggctccggccgcagtagggacccgggcgccgggagggacggggagcgcgcccctccgctgctgctgctgctgctgctgctgctgttgctgctgccgccgcctctgtcgcccgtaccgcaag

SEQ ID NO: 52283 - DNA, 56 bp, Homo sapiens; identical to SEQ ID NO: 9209
  misc_feature 1..56: note = chr7:123672928-123672984
  misc_feature 1..56: note = hyper
  source 1..56: mol_type = genomic DNA

SEQ ID NO: 52284 - DNA, 157 bp, Homo sapiens; identical to SEQ ID NO: 31517
  misc_feature 1..157: note = chr7:123673226-123673383
  misc_feature 1..157: note = hyper
  source 1..157: mol_type = genomic DNA

SEQ ID NO: 52285 - DNA, 54 bp, Homo sapiens
  misc_feature 1..54: note = chr7:124404361-124404415
  misc_feature 1..54: note = hyper
  source 1..54: mol_type = genomic DNA
tccattctgggccagcgcccggcccgggagtgcaattgtccacccttcgtgccc

SEQ ID NO: 52286 - DNA, 226 bp, Homo sapiens; identical to SEQ ID NO: 31519
  misc_feature 1..226: note = chr7:124404734-124404960
  misc_feature 1..226: note = hyper
  source 1..226: mol_type = genomic DNA

SEQ ID NO: 52287 - DNA, 30 bp, Homo sapiens; identical to SEQ ID NO: 31520
  misc_feature 1..30: note = chr7:124405187-124405217
  misc_feature 1..30: note = hyper
  source 1..30: mol_type = genomic DNA

SEQ ID NO: 52288 - DNA, 671 bp, Homo sapiens; identical to SEQ ID NO: 31521
  misc_feature 1..671: note = chr7:124405556-124406227
  misc_feature 1..671: note = hyper
  source 1..671: mol_type = genomic DNA

SEQ ID NO: 52289 - DNA, 14 bp, Homo sapiens
  misc_feature 1..14: note = chr7:126891206-126891220
  misc_feature 1..14: note = hyper
  source 1..14: mol_type = genomic DNA
gtctgttttcaccc

SEQ ID NO: 52290 - DNA, 1020 bp, Homo sapiens
  misc_feature 1..1020: note = chr7:126891593-126892613
  misc_feature 1..1020: note = hyper
  source 1..1020: mol_type = genomic DNA
cttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggcc

SEQ ID NO: 52291 - DNA, 212 bp, Homo sapiens; identical to SEQ ID NO: 31524
  misc_feature 1..212: note = chr7:126892895-126893107
  misc_feature 1..212: note = hyper
  source 1..212: mol_type = genomic DNA

SEQ ID NO: 52292 - DNA, 69 bp, Homo sapiens; identical to SEQ ID NO: 31525
  misc_feature 1..69: note = chr7:126987771-126987840
  misc_feature 1..69: note = hyper
  source 1..69: mol_type = genomic DNA

SEQ ID NO: 52293 - DNA, 43 bp, Homo sapiens; identical to SEQ ID NO: 31526
  misc_feature 1..43: note = chr7:126988163-126988206
  misc_feature 1..43: note = hyper
  source 1..43: mol_type = genomic DNA

SEQ ID NO: 52294 - DNA, 47 bp, Homo sapiens; identical to SEQ ID NO: 31527
  misc_feature 1..47: note = chr7:127260538-127260585
  misc_feature 1..47: note = hyper
  source 1..47: mol_type = genomic DNA

SEQ ID NO: 52295 - DNA, 65 bp, Homo sapiens; identical to SEQ ID NO: 19824
  misc_feature 1..65: note = chr7:127744057-127744122
  misc_feature 1..65: note = hyper
  source 1..65: mol_type = genomic DNA

SEQ ID NO: 52296 - DNA, 39 bp, Homo sapiens; identical to SEQ ID NO: 19825
  misc_feature 1..39: note = chr7:127744631-127744670
  misc_feature 1..39: note = hyper
  source 1..39: mol_type = genomic DNA

SEQ ID NO: 52297 - DNA, 46 bp, Homo sapiens; identical to SEQ ID NO: 31530
  misc_feature 1..46: note = chr7:127806561-127806607
  misc_feature 1..46: note = hyper
  source 1..46: mol_type = genomic DNA

SEQ ID NO: 52298 - DNA, 50 bp, Homo sapiens; identical to SEQ ID NO: 31531
  misc_feature 1..50: note = chr7:127807004-127807054
  misc_feature 1..50: note = hyper
  source 1..50: mol_type = genomic DNA

SEQ ID NO: 52299 - DNA, 131 bp, Homo sapiens; identical to SEQ ID NO: 31532
  misc_feature 1..131: note = chr7:127807478-127807609
  misc_feature 1..131: note = hyper
  source 1..131: mol_type = genomic DNA

SEQ ID NO: 52300 - skipped

SEQ ID NO: 52301 - DNA, 201 bp, Homo sapiens; identical to SEQ ID NO: 19827
  misc_feature 1..201: note = chr7:127807846-127808047
  misc_feature 1..201: note = hyper
  source 1..201: mol_type = genomic DNA

SEQ ID NO: 52302 - DNA, 159 bp, Homo sapiens; identical to SEQ ID NO: 3109
  misc_feature 1..159: note = chr7:127841338-127841497
  misc_feature 1..159: note = hyper
  source 1..159: mol_type = genomic DNA

SEQ ID NO: 52303 - DNA, 113 bp, Homo sapiens
  misc_feature 1..113: note = chr7:127841704-127841817
  misc_feature 1..113: note = hyper
  source 1..113: mol_type = genomic DNA
gtcctacactttgagagcagaaaacgaccccgtacgtggtgggtctccgacatctgtttattacgttggaccgcatgctgcatatgatccagccacctcgctctactcctgtg

SEQ ID NO: 52304 - DNA, 34 bp, Homo sapiens; identical to SEQ ID NO: 31536
  misc_feature 1..34: note = chr7:127991709-127991743
  misc_feature 1..34: note = hyper
  source 1..34: mol_type = genomic DNA

SEQ ID NO: 52305 - DNA, 39 bp, Homo sapiens
  misc_feature 1..39: note = chr7:127991787-127991826
  misc_feature 1..39: note = hyper
  source 1..39: mol_type = genomic DNA
cgcccaggcgcaggcctagctggaaggcccaccagggcc

SEQ ID NO: 52306 - DNA, 184 bp, Homo sapiens
  misc_feature 1..184: note = chr7:127992135-127992319
  misc_feature 1..184: note = hyper
  source 1..184: mol_type = genomic DNA
gcagcgggcgatgcgcggcgctcccgagggcggcggcggccgccagccccagccccaggagcagcagcgcagccaggccggtggggcaccgcggcgggcgcggccgggccagcagcaggcaggccagccccaggccggcagccaagcagggcagcggaaggtcctgcagcagcagccaggcgag

SEQ ID NO: 52307 - DNA, 154 bp, Homo sapiens; identical to SEQ ID NO: 31539
  misc_feature 1..154: note = chr7:127992371-127992525
  misc_feature 1..154: note = hyper
  source 1..154: mol_type = genomic DNA

SEQ ID NO: 52308 - DNA, 115 bp, Homo sapiens; identical to SEQ ID NO: 31540
  misc_feature 1..115: note = chr7:128002255-128002370
  misc_feature 1..115: note = hyper
  source 1..115: mol_type = genomic DNA

SEQ ID NO: 52309 - DNA, 62 bp, Homo sapiens
  misc_feature 1..62: note = chr7:128337405-128337467
  misc_feature 1..62: note = hyper
  source 1..62: mol_type = genomic DNA
ctcaatttcttcacccggccatgtaagcagagcggacaactctgagggcgtggctgggcggg

SEQ ID NO: 52310 - DNA, 142 bp, Homo sapiens; identical to SEQ ID NO: 31543
  misc_feature 1..142: note = chr7:128430740-128430882
  misc_feature 1..142: note = hyper
  source 1..142: mol_type = genomic DNA

SEQ ID NO: 52311 - DNA, 19 bp, Homo sapiens
  misc_feature 1..19: note = chr7:128430922-128430941
  misc_feature 1..19: note = hyper
  source 1..19: mol_type = genomic DNA
cgttcgcccatccgggcct

SEQ ID NO: 52312 - DNA, 404 bp, Homo sapiens
  misc_feature 1..404: note = chr7:128470493-128470897
  misc_feature 1..404: note = hyper
  source 1..404: mol_type = genomic DNA
gagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccg

SEQ ID NO: 52313 - DNA, 25 bp, Homo sapiens
  misc_feature 1..25: note = chr7:128471032-128471057
  misc_feature 1..25: note = hyper
  source 1..25: mol_type = genomic DNA
cgtgtccataggtcagtgccggggg

SEQ ID NO: 52314 - DNA, 134 bp, Homo sapiens; identical to SEQ ID NO: 31546
  misc_feature 1..134: note = chr7:128471125-128471259
  misc_feature 1..134: note = hyper
  source 1..134: mol_type = genomic DNA

SEQ ID NO: 52315 - DNA, 101 bp, Homo sapiens; identical to SEQ ID NO: 31547
  misc_feature 1..101: note = chr7:128510097-128510198
  misc_feature 1..101: note = hyper
  source 1..101: mol_type = genomic DNA

SEQ ID NO: 52316 - DNA, 65 bp, Homo sapiens; identical to SEQ ID NO: 19836
  misc_feature 1..65: note = chr7:128828130-128828195
  misc_feature 1..65: note = hyper
  source 1..65: mol_type = genomic DNA

SEQ ID NO: 52317 - DNA, 232 bp, Homo sapiens
  misc_feature 1..232: note = chr7:128828272-128828504
  misc_feature 1..232: note = hyper
  source 1..232: mol_type = genomic DNA
actcatctctttcccccgggcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaaca

SEQ ID NO: 52318 - DNA, 475 bp, Homo sapiens; identical to SEQ ID NO: 31549
  misc_feature 1..475: note = chr7:128828904-128829379
  misc_feature 1..475: note = hyper
  source 1..475: mol_type = genomic DNA

SEQ ID NO: 52319 - DNA, 30 bp, Homo sapiens; identical to SEQ ID NO: 31550
  misc_feature 1..30: note = chr7:129142850-129142880
  misc_feature 1..30: note = hyper
  source 1..30: mol_type = genomic DNA

SEQ ID NO: 52320 - DNA, 143 bp, Homo sapiens
  misc_feature 1..143: note = chr7:129418428-129418571
  misc_feature 1..143: note = hyper
  source 1..143: mol_type = genomic DNA
tcgaggctgagagctgggcttggggcaggttcctttgcgttcgctcaggccacgatgaggccactaggacagatttctccgaaggctcggcctcggatcagagatccgccgactcggtgcccatcggtcgggctcactgggtg

SEQ ID NO: 52321 - DNA, 79 bp, Homo sapiens; identical to SEQ ID NO: 31552
  misc_feature 1..79: note = chr7:129421630-129421709
  misc_feature 1..79: note = hyper
  source 1..79: mol_type = genomic DNA

SEQ ID NO: 52322 - DNA, 45 bp, Homo sapiens; identical to SEQ ID NO: 19840
  misc_feature 1..45: note = chr7:129422115-129422160
  misc_feature 1..45: note = hyper
  source 1..45: mol_type = genomic DNA

SEQ ID NO: 52323 - skipped

SEQ ID NO: 52324 - DNA, 100 bp, Homo sapiens
  misc_feature 1..100: note = chr7:129424555-129424655
  misc_feature 1..100: note = hyper
  source 1..100: mol_type = genomic DNA
taccaggcgacaccccggtcgactttgacccccgagcaggtgaaacataagcgtccaccccagaggggtcccctacccaagtcagaggagaaggtggcct

SEQ ID NO: 52325 - DNA, 59 bp, Homo sapiens; identical to SEQ ID NO: 19843
  misc_feature 1..59: note = chr7:129425887-129425946
  misc_feature 1..59: note = hyper
  source 1..59: mol_type = genomic DNA

SEQ ID NO: 52326 - DNA, 140 bp, Homo sapiens
  misc_feature 1..140: note = chr7:131242824-131242964
  misc_feature 1..140: note = hyper
  source 1..140: mol_type = genomic DNA
ggagtctatctgccagatggggctgggtggaggggttttctccaggatctagccgcgtcccgggcacaggggactccgtgagcccctcaagtcggctgcaagcaggcgatgcctgcagggcactgcgtccctggagccgc

SEQ ID NO: 52327 - DNA, 85 bp, Homo sapiens
  misc_feature 1..85: note = chr7:131514739-131514824
  misc_feature 1..85: note = hyper
  source 1..85: mol_type = genomic DNA
cctgggcttggatcccgctgtgaggccgggggcaggtgatcatggcaggcggtaggactcctctcactctctgccccagaccccg

SEQ ID NO: 52328 - DNA, 80 bp, Homo sapiens
  misc_feature 1..80: note = chr7:131514854-131514934
  misc_feature 1..80: note = hyper
  source 1..80: mol_type = genomic DNA
cagcaggcaaggccaggaagccgggagtgcttgctgtcaatatcacatgtggagctgcttgtggccggccaggactctca

SEQ ID NO: 52329 - DNA, 286 bp, Homo sapiens; identical to SEQ ID NO: 31558
  misc_feature 1..286: note = chr7:132260280-132260566
  misc_feature 1..286: note = hyper
  source 1..286: mol_type = genomic DNA

SEQ ID NO: 52330 - DNA, 89 bp, Homo sapiens; identical to SEQ ID NO: 9241
  misc_feature 1..89: note = chr7:132260852-132260941
  misc_feature 1..89: note = hyper
  source 1..89: mol_type = genomic DNA

SEQ ID NO: 52331 - DNA, 62 bp, Homo sapiens; identical to SEQ ID NO: 31560
  misc_feature 1..62: note = chr7:132261146-132261208
  misc_feature 1..62: note = hyper
  source 1..62: mol_type = genomic DNA

SEQ ID NO: 52332 - DNA, 16 bp, Homo sapiens
  misc_feature 1..16: note = chr7:132261256-132261272
  misc_feature 1..16: note = hyper
  source 1..16: mol_type = genomic DNA
cgccctcctctgaacg

SEQ ID NO: 52333 - DNA, 73 bp, Homo sapiens
  misc_feature 1..73: note = chr7:132261432-132261505
  misc_feature 1..73: note = hyper
  source 1..73: mol_type = genomic DNA
taatgtccaacaaaaaggtcggaaaatggggatcgattccgaacacccctttcctccacccagccccggagcc

SEQ ID NO: 52334 - DNA, 27 bp, Homo sapiens
  misc_feature 1..27: note = chr7:132261534-132261561
  misc_feature 1..27: note = hyper
  source 1..27: mol_type = genomic DNA
cggtggcgacgccgggctgcccccctt

SEQ ID NO: 52335 - DNA, 151 bp, Homo sapiens; identical to SEQ ID NO: 31563
  misc_feature 1..151: note = chr7:132261835-132261986
  misc_feature 1..151: note = hyper
  source 1..151: mol_type = genomic DNA

SEQ ID NO: 52336 - DNA, 168 bp, Homo sapiens; identical to SEQ ID NO: 31564
  misc_feature 1..168: note = chr7:132262214-132262382
  misc_feature 1..168: note = hyper
  source 1..168: mol_type = genomic DNA

SEQ ID NO: 52337 - DNA, 30 bp, Homo sapiens; identical to SEQ ID NO: 31565
  misc_feature 1..30: note = chr7:132299615-132299645
  misc_feature 1..30: note = hyper
  source 1..30: mol_type = genomic DNA

SEQ ID NO: 52338 - DNA, 52 bp, Homo sapiens; identical to SEQ ID NO: 31566
  misc_feature 1..52: note = chr7:133812094-133812146
  misc_feature 1..52: note = hyper
  source 1..52: mol_type = genomic DNA

SEQ ID NO: 52339 - DNA, 178 bp, Homo sapiens
  misc_feature 1..178: note = chr7:134142986-134143164
  misc_feature 1..178: note = hyper
  source 1..178: mol_type = genomic DNA
ggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagct

SEQ ID NO: 52340 - DNA, 112 bp, Homo sapiens; identical to SEQ ID NO: 19848
  misc_feature 1..112: note = chr7:134143475-134143587
  misc_feature 1..112: note = hyper
  source 1..112: mol_type = genomic DNA

SEQ ID NO: 52341 - DNA, 107 bp, Homo sapiens
  misc_feature 1..107: note = chr7:134143700-134143807
  misc_feature 1..107: note = hyper
  source 1..107: mol_type = genomic DNA
cggagagtgtgaggcgagccccgggcccgcgcccccacgagcacctaccttccaggtacccaaccccaggatgggcatcttggcgccgttgttgagcaggagacggc

SEQ ID NO: 52342 - DNA, 48 bp, Homo sapiens
  misc_feature 1..48: note = chr7:136554366-136554414
  misc_feature 1..48: note = hyper
  source 1..48: mol_type = genomic DNA
ggtctgaaaggaaggggcaaacgaggcacagcgcgaggcgaggtaccc

SEQ ID NO: 52343 - DNA, 11 bp, Homo sapiens
  misc_feature 1..11: note = chr7:136554966-136554977
  misc_feature 1..11: note = hyper
  source 1..11: mol_type = genomic DNA
gtcgtagactg

SEQ ID NO: 52344 - DNA, 38 bp, Homo sapiens
  misc_feature 1..38: note = chr7:136555197-136555235
  misc_feature 1..38: note = hyper
  source 1..38: mol_type = genomic DNA
aattattgacacacacggcggcacaccctttgcctccg

SEQ ID NO: 52345 - DNA, 269 bp, Homo sapiens
  misc_feature 1..269: note = chr7:136555412-136555681
  misc_feature 1..269: note = hyper
  source 1..269: mol_type = genomic DNA
ggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttc

SEQ ID NO: 52346 - DNA, 11 bp, Homo sapiens
  misc_feature 1..11: note = chr7:137028524-137028535
  misc_feature 1..11: note = hyper
  source 1..11: mol_type = genomic DNA
ggagggagagc

SEQ ID NO: 52347 - DNA, 68 bp, Homo sapiens; identical to SEQ ID NO: 31579
  misc_feature 1..68: note = chr7:137532373-137532441
  misc_feature 1..68: note = hyper
  source 1..68: mol_type = genomic DNA

SEQ ID NO: 52348 - DNA, 71 bp, Homo sapiens
  misc_feature 1..71: note = chr7:139167546-139167617
  misc_feature 1..71: note = hyper
  source 1..71: mol_type = genomic DNA
cggtccagggctgggcgggtgtgggggtttcggctacgtccacccgacctggcggcgtcggctgccggcgc

SEQ ID NO: 52349 - DNA, 83 bp, Homo sapiens; identical to SEQ ID NO: 19849
  misc_feature 1..83: note = chr7:139167744-139167827
  misc_feature 1..83: note = hyper
  source 1..83: mol_type = genomic DNA

SEQ ID NO: 52350 - DNA, 235 bp, Homo sapiens
  misc_feature 1..235: note = chr7:139168379-139168614
  misc_feature 1..235: note = hyper
  source 1..235: mol_type = genomic DNA
ctcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctgtggctgaggttctgctgccccgacccccttcgggacacagccccggcctccaccaggcactgggagggagctgagaa

SEQ ID NO: 52351 - DNA, 37 bp, Homo sapiens; identical to SEQ ID NO: 31582
  misc_feature 1..37: note = chr7:139168658-139168695
  misc_feature 1..37: note = hyper
  source 1..37: mol_type = genomic DNA

SEQ ID NO: 52352 - DNA, 325 bp, Homo sapiens; identical to SEQ ID NO: 31583
  misc_feature 1..325: note = chr7:139208245-139208570
  misc_feature 1..325: note = hyper
  source 1..325: mol_type = genomic DNA

SEQ ID NO: 52353 - DNA, 158 bp, Homo sapiens
  misc_feature 1..158: note = chr7:139208614-139208772
  misc_feature 1..158: note = hyper
  source 1..158: mol_type = genomic DNA
cgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgccc

SEQ ID NO: 52354 - skipped

SEQ ID NO: 52355 - DNA, 43 bp, Homo sapiens; identical to SEQ ID NO: 31586
  misc_feature 1..43: note = chr7:140339825-140339868
  misc_feature 1..43: note = hyper
  source 1..43: mol_type = genomic DNA

SEQ ID NO: 52356 - DNA, 187 bp, Homo sapiens
  misc_feature 1..187: note = chr7:140339982-140340169
  misc_feature 1..187: note = hyper
  source 1..187: mol_type = genomic DNA
acacacactcacactcgcgccccgagggacccagcacggcgcagggcgggggtctaccggctttctgcaggtccccgaggcgcgagacggcggcgtccgggctcagtcctgggagtcagcccgagcccgggaggaacgcctggatcgcgctctgcacagtcccgggaccaggcgggaactcagactc

SEQ ID NO: 52357 - DNA, 38 bp, Homo sapiens; identical to SEQ ID NO: 31588
  misc_feature 1..38: note = chr7:140340747-140340785
  misc_feature 1..38: note = hyper
  source 1..38: mol_type = genomic DNA

SEQ ID NO: 52358 - DNA, 203 bp, Homo sapiens; identical to SEQ ID NO: 31589
  misc_feature 1..203: note = chr7:140771347-140771550
  misc_feature 1..203: note = hyper
  source 1..203: mol_type = genomic DNA

SEQ ID NO: 52359 - DNA, 72 bp, Homo sapiens; identical to SEQ ID NO: 31590
  misc_feature 1..72: note = chr7:140771769-140771841
  misc_feature 1..72: note = hyper
  source 1..72: mol_type = genomic DNA

SEQ ID NO: 52360 - DNA, 308 bp, Homo sapiens; identical to SEQ ID NO: 31591
  misc_feature 1..308: note = chr7:140772281-140772589
  misc_feature 1..308: note = hyper
  source 1..308: mol_type = genomic DNA

SEQ ID NO: 52361 - DNA, 335 bp, Homo sapiens; identical to SEQ ID NO: 19856
  misc_feature 1..335: note = chr7:140773228-140773563
  misc_feature 1..335: note = hyper
  source 1..335: mol_type = genomic DNA

SEQ ID NO: 52362 - DNA, 659 bp, Homo sapiens
  misc_feature 1..659: note = chr7:140773750-140774409
  misc_feature 1..659: note = hyper
  source 1..659: mol_type = genomic DNA
ggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggca

SEQ ID NO: 52363 - DNA, 60 bp, Homo sapiens; identical to SEQ ID NO: 31593
  misc_feature 1..60: note = chr7:141211539-141211599
  misc_feature 1..60: note = hyper
  source 1..60: mol_type = genomic DNA

SEQ ID NO: 52364 - DNA, 15 bp, Homo sapiens
  misc_feature 1..15: note = chr7:143042619-143042634
  misc_feature 1..15: note = hyper
  source 1..15: mol_type = genomic DNA
tgatcctgctgggct

SEQ ID NO: 52365 - DNA, 16 bp, Homo sapiens
  misc_feature 1..16: note = chr7:143579649-143579665
  misc_feature 1..16: note = hyper
  source 1..16: mol_type = genomic DNA
gggattctctgtcccc

SEQ ID NO: 52366 - DNA, 73 bp, Homo sapiens
  misc_feature 1..73: note = chr7:143579666-143579739
  misc_feature 1..73: note = hyper
  source 1..73: mol_type = genomic DNA
atgatttctgatttcggcacacccagacccacggcgcacccatcgcgccccgcacccccgccccggcctcccg

SEQ ID NO: 52367 - DNA, 26 bp, Homo sapiens
  misc_feature 1..26: note = chr7:143580069-143580095
  misc_feature 1..26: note = hyper
  source 1..26: mol_type = genomic DNA
ctttgtgtcgccggccctggtggctt

SEQ ID NO: 52368 - DNA, 274 bp, Homo sapiens
  misc_feature 1..274: note = chr7:145812718-145812992
  misc_feature 1..274: note = hyper
  source 1..274: mol_type = genomic DNA
gaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcag

SEQ ID NO: 52369 - DNA, 309 bp, Homo sapiens
  misc_feature 1..309: note = chr7:145813082-145813391
  misc_feature 1..309: note = hyper
  source 1..309: mol_type = genomic DNA
cccccgccccagctgatggaccccggccggtcggctcagtctcccttttgctttcaaacgaggccagggcagggcagaagggttttgacagccagaggggtacggtaaggaggaggaagaggaggaggaggcggaggaggaggaggagccgaggagggaaccgagaagggaagagaagggagggcttccctccgcctcgctcgccgcccgggctcacaggagctggcggcggcggcggcggcggcggcgtctcctgctctccgcggctgttgctgctgctcgcgctccgccgcccgggagatgcttcct

SEQ ID NO: 52370 - skipped

SEQ ID NO: 52371 - DNA, 186 bp, Homo sapiens
  misc_feature 1..186: note = chr7:145813494-145813680
  misc_feature 1..186: note = hyper
  source 1..186: mol_type = genomic DNA
gagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctct

SEQ ID NO: 52372 - DNA, 46 bp, Homo sapiens
  misc_feature 1..46: note = chr7:149112012-149112058
  misc_feature 1..46: note = hyper
  source 1..46: mol_type = genomic DNA
gtgtgaaggtaaagacggtcctatatttcagttccagtggggctgc

SEQ ID NO: 52373 - DNA, 32 bp, Homo sapiens
  misc_feature 1..32: note = chr7:149119916-149119948
  misc_feature 1..32: note = hyper
  source 1..32: mol_type = genomic DNA
gccccatcccacaggcgccaaatggagggcgc

SEQ ID NO: 52374 - DNA, 180 bp, Homo sapiens
  misc_feature 1..180: note = chr7:149411361-149411541
  misc_feature 1..180: note = hyper
  source 1..180: mol_type = genomic DNA
ccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccac

SEQ ID NO: 52375 - DNA, 105 bp, Homo sapiens
  misc_feature 1..105: note = chr7:149412304-149412409
  misc_feature 1..105: note = hyper
  source 1..105: mol_type = genomic DNA
aggtcctcggacaacctctctccagctctccgccgccggtacccacggcccagtctccacctggggaaacccccttggcgtggcttgtttcgttacaagttatcc

SEQ ID NO: 52376 - DNA, 44 bp, Homo sapiens
  misc_feature 1..44: note = chr7:149744461-149744505
  misc_feature 1..44: note = hyper
  source 1..44: mol_type = genomic DNA
cgctctctccagccaccaactcccggccgccgcggctgcagaca

SEQ ID NO: 52377 - DNA, 239 bp, Homo sapiens
  misc_feature 1..239: note = chr7:149744560-149744799
  misc_feature 1..239: note = hyper
  source 1..239: mol_type = genomic DNA
ctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctg

SEQ ID NO: 52378 - DNA, 137 bp, Homo sapiens; identical to SEQ ID NO: 31607
  misc_feature 1..137: note = chr7:149744950-149745087
  misc_feature 1..137: note = hyper
  source 1..137: mol_type = genomic DNA

SEQ ID NO: 52379 - DNA, 15 bp, Homo sapiens
  misc_feature 1..15: note = chr7:149745575-149745590
  misc_feature 1..15: note = hyper
  source 1..15: mol_type = genomic DNA
gcggtgggggagtcc

SEQ ID NO: 52380 - DNA, 35 bp, Homo sapiens; identical to SEQ ID NO: 31609
  misc_feature 1..35: note = chr7:149917112-149917147
  misc_feature 1..35: note = hyper
  source 1..35: mol_type = genomic DNA

SEQ ID NO: 52381 - DNA, 59 bp, Homo sapiens
  misc_feature 1..59: note = chr7:149917336-149917395
  misc_feature 1..59: note = hyper
  source 1..59: mol_type = genomic DNA
gtggcctttccccgggggatacctgacgctattggagactcctgcggtttgattcatgt

SEQ ID NO: 52382 - DNA, 42 bp, Homo sapiens
  misc_feature 1..42: note = chr7:149918149-149918191
  misc_feature 1..42: note = hyper
  source 1..42: mol_type = genomic DNA
gacggcacccgggctcgttagcccaggctgcacgagctacag

SEQ ID NO: 52383 - DNA, 30 bp, Homo sapiens; identical to SEQ ID NO: 31612
  misc_feature 1..30: note = chr7:150715080-150715110
  misc_feature 1..30: note = hyper
  source 1..30: mol_type = genomic DNA

SEQ ID NO: 52384 - DNA, 252 bp, Homo sapiens
  misc_feature 1..252: note = chr7:150715917-150716169
  misc_feature 1..252: note = hyper
  source 1..252: mol_type = genomic DNA
ggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcg

SEQ ID NO: 52385 - DNA, 55 bp, Homo sapiens
  misc_feature 1..55: note = chr7:150716305-150716360
  misc_feature 1..55: note = hyper
  source 1..55: mol_type = genomic DNA
gttggccagcgccacctggtagttggtgtagcgcaggatgcggtggtggatgtcc

SEQ ID NO: 52386 - DNA, 94 bp, Homo sapiens
  misc_feature 1..94: note = chr7:150748098-150748192
  misc_feature 1..94: note = hyper
  source 1..94: mol_type = genomic DNA
ctaaagccatctccccggtacccgcaggcgacgtgccagtgtgcagcccccagcagtacaagaactgtgcccacccggccataggtaagggcga

SEQ ID NO: 52387 - DNA, 151 bp, Homo sapiens
  misc_feature 1..151: note = chr7:150748406-150748557
  misc_feature 1..151: note = hyper
  source 1..151: mol_type = genomic DNA
gtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgctta

SEQ ID NO: 52388 - DNA, 165 bp, Homo sapiens; identical to SEQ ID NO: 9276
  misc_feature 1..165: note = chr7:150864232-150864397
  misc_feature 1..165: note = hyper
  source 1..165: mol_type = genomic DNA

SEQ ID NO: 52389 - DNA, 68 bp, Homo sapiens; identical to SEQ ID NO: 31616
  misc_feature 1..68: note = chr7:150864610-150864678
  misc_feature 1..68: note = hyper
  source 1..68: mol_type = genomic DNA

SEQ ID NO: 52390 - DNA, 33 bp, Homo sapiens; identical to SEQ ID NO: 19871
  misc_feature 1..33: note = chr7:151106418-151106451
  misc_feature 1..33: note = hyper
  source 1..33: mol_type = genomic DNA

SEQ ID NO: 52391 - DNA, 91 bp, Homo sapiens; identical to SEQ ID NO: 19872
  misc_feature 1..91: note = chr7:151107395-151107486
  misc_feature 1..91: note = hyper
  source 1..91: mol_type = genomic DNA

SEQ ID NO: 52392 - DNA, 192 bp, Homo sapiens
  misc_feature 1..192: note = chr7:151107651-151107843
  misc_feature 1..192: note = hyper
  source 1..192: mol_type = genomic DNA
tcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtc

SEQ ID NO: 52393 - DNA, 348 bp, Homo sapiens; identical to SEQ ID NO: 31621
  misc_feature 1..348: note = chr7:151145538-151145886
  misc_feature 1..348: note = hyper
  source 1..348: mol_type = genomic DNA

SEQ ID NO: 52394 - DNA, 61 bp, Homo sapiens; identical to SEQ ID NO: 31622
  misc_feature 1..61: note = chr7:151574953-151575014
  misc_feature 1..61: note = hyper
  source 1..61: mol_type = genomic DNA

SEQ ID NO: 52395 - DNA, 18 bp, Homo sapiens
  misc_feature 1..18: note = chr7:152622496-152622514
  misc_feature 1..18: note = hyper
  source 1..18: mol_type = genomic DNA
gggaacggtggaggccgc

SEQ ID NO: 52396 - DNA, 76 bp, Homo sapiens
  misc_feature 1..76: note = chr7:152622545-152622621
  misc_feature 1..76: note = hyper
  source 1..76: mol_type = genomic DNA
cggcggggatcgcagggccgaggggccgggcgcgcgcgggggagggacccaggccaggggccgctcgcctcggggc

SEQ ID NO: 52397 - DNA, 64 bp, Homo sapiens
  misc_feature 1..64: note = chr7:152622697-152622761
  misc_feature 1..64: note = hyper
  source 1..64: mol_type = genomic DNA
ccttcgccaaggccgggccaggcgagtaggggcgcggcctgagcccctgcggtgattccccagg

SEQ ID NO: 52398 - DNA, 30 bp, Homo sapiens; identical to SEQ ID NO: 31625
  misc_feature 1..30: note = chr7:153445126-153445156
  misc_feature 1..30: note = hyper
  source 1..30: mol_type = genomic DNA

SEQ ID NO: 52399 - DNA, 117 bp, Homo sapiens; identical to SEQ ID NO: 9283
  misc_feature 1..117: note = chr7:153446175-153446292
  misc_feature 1..117: note = hyper
  source 1..117: mol_type = genomic DNA

SEQ ID NO: 52400 - DNA, 181 bp, Homo sapiens; identical to SEQ ID NO: 31627
  misc_feature 1..181: note = chr7:153583349-153583530
  misc_feature 1..181: note = hyper
  source 1..181: mol_type = genomic DNA

SEQ ID NO: 52401 - DNA, 88 bp, Homo sapiens
  misc_feature 1..88: note = chr7:153584301-153584389
  misc_feature 1..88: note = hyper
  source 1..88: mol_type = genomic DNA
tgctggaggagcccccggagccggggccgagccgccggcgtccccgagtgcgccccctgtgcgtgccgccgcgctgttgctcgcagtg

SEQ ID NO: 52402 - DNA, 51 bp, Homo sapiens
  misc_feature 1..51: note = chr7:153584797-153584848
  misc_feature 1..51: note = hyper
  source 1..51: mol_type = genomic DNA
taagatgcaggggaacgtgatggtgagtgccacggacagggcgcgcgctgg

SEQ ID NO: 52403 - DNA, 17 bp, Homo sapiens
  misc_feature 1..17: note = chr7:153749703-153749720
  misc_feature 1..17: note = hyper
  source 1..17: mol_type = genomic DNA
aggcagagtcgccagcg

SEQ ID NO: 52404 - DNA, 76 bp, Homo sapiens; identical to SEQ ID NO: 31632
  misc_feature 1..76: note = chr7:153750249-153750325
  misc_feature 1..76: note = hyper
  source 1..76: mol_type = genomic DNA

SEQ ID NO: 52405 - DNA, 10 bp, Homo sapiens
  misc_feature 1..10: note = chr7:154002083-154002093
  misc_feature 1..10: note = hyper
  source 1..10: mol_type = genomic DNA
cgctgcctcc

SEQ ID NO: 52406 - DNA, 318 bp, Homo sapiens; identical to SEQ ID NO: 31634
  misc_feature 1..318: note = chr7:154861712-154862030
  misc_feature 1..318: note = hyper
  source 1..318: mol_type = genomic DNA

SEQ ID NO: 52407 - DNA, 15 bp, Homo sapiens
  misc_feature 1..15: note = chr7:154862031-154862046
  misc_feature 1..15: note = hyper
  source 1..15: mol_type = genomic DNA
ccagcattcgctctc

SEQ ID NO: 52408 - DNA, 124 bp, Homo sapiens
  misc_feature 1..124: note = chr7:154862266-154862390
  misc_feature 1..124: note = hyper
  source 1..124: mol_type = genomic DNA
cgatctgggagatgctcggctctgggcggccaaacagcctttccaccaaggcgaggagccctgggctcctgacagcttaggcgggccctggctgcgacacgcagcccctcgcctctgcttcctt

SEQ ID NO: 52409 - skipped

SEQ ID NO: 52410 - DNA, 313 bp, Homo sapiens; identical to SEQ ID NO: 19883
  misc_feature 1..313: note = chr7:155165562-155165875
  misc_feature 1..313: note = hyper
  source 1..313: mol_type = genomic DNA

SEQ ID NO: 52411 - DNA, 250 bp, Homo sapiens; identical to SEQ ID NO: 19884
  misc_feature 1..250: note = chr7:155166784-155167034
  misc_feature 1..250: note = hyper
  source 1..250: mol_type = genomic DNA

SEQ ID NO: 52412 - DNA, 85 bp, Homo sapiens; identical to SEQ ID NO: 31641
  misc_feature 1..85: note = chr7:155168529-155168614
  misc_feature 1..85: note = hyper
  source 1..85: mol_type = genomic DNA

SEQ ID NO: 52413 - DNA, 743 bp, Homo sapiens; identical to SEQ ID NO: 31642
  misc_feature 1..743: note = chr7:155170182-155170925
  misc_feature 1..743: note = hyper
  source 1..743: mol_type = genomic DNA

SEQ ID NO: 52414 - DNA, 98 bp, Homo sapiens; identical to SEQ ID NO: 31643
  misc_feature 1..98: note = chr7:155173869-155173967
  misc_feature 1..98: note = hyper
  source 1..98: mol_type = genomic DNA

SEQ ID NO: 52415 - DNA, 432 bp, Homo sapiens; identical to SEQ ID NO: 19889
  misc_feature 1..432: note = chr7:155174224-155174656
  misc_feature 1..432: note = hyper
  source 1..432: mol_type = genomic DNA

SEQ ID NO: 52416 - DNA, 192 bp, Homo sapiens
  misc_feature 1..192: note = chr7:155174788-155174980
  misc_feature 1..192: note = hyper
  source 1..192: mol_type = genomic DNA
acatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatg

SEQ ID NO: 52417 - DNA, 260 bp, Homo sapiens
  misc_feature 1..260: note = chr7:155242049-155242309
  misc_feature 1..260: note = hyper
  source 1..260: mol_type = genomic DNA
ggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcccgggaggcggtggagacccacgcccggaagtaaccggattaggtctcagaatgtgatcgccccccgggtcccgggggaga

SEQ ID NO: 52418 - DNA, 140 bp, Homo sapiens; identical to SEQ ID NO: 31647
  misc_feature 1..140: note = chr7:155242379-155242519
  misc_feature 1..140: note = hyper
  source 1..140: mol_type = genomic DNA

SEQ ID NO: 52419 - DNA, 30 bp, Homo sapiens; identical to SEQ ID NO: 19892
  misc_feature 1..30: note = chr7:155242699-155242729
  misc_feature 1..30: note = hyper
  source 1..30: mol_type = genomic DNA

SEQ ID NO: 52420 - DNA, 244 bp, Homo sapiens; identical to SEQ ID NO: 19893
  misc_feature 1..244: note = chr7:155243102-155243346
  misc_feature 1..244: note = hyper
  source 1..244: mol_type = genomic DNA

SEQ ID NO: 52421 - DNA, 70 bp, Homo sapiens
  misc_feature 1..70: note = chr7:155243755-155243825
  misc_feature 1..70: note = hyper
  source 1..70: mol_type = genomic DNA
cggttttgttttccaggggtagtttctgcagaaaggagattctcctccgggccgaagggctaccagcctg

SEQ ID NO: 52422 - DNA, 285 bp, Homo sapiens
  misc_feature 1..285: note = chr7:155243895-155244180
  misc_feature 1..285: note = hyper
  source 1..285: mol_type = genomic DNA
ccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatct

SEQ ID NO: 52423 - DNA, 119 bp, Homo sapiens; identical to SEQ ID NO: 31650
  misc_feature 1..119: note = chr7:155246406-155246525
  misc_feature 1..119: note = hyper
  source 1..119: mol_type = genomic DNA

SEQ ID NO: 52424 - DNA, 372 bp, Homo sapiens; identical to SEQ ID NO: 31652
  misc_feature 1..372: note = chr7:155247839-155248211
  misc_feature 1..372: note = hyper
  source 1..372: mol_type = genomic DNA

SEQ ID NO: 52425 - DNA, 121 bp, Homo sapiens
  misc_feature 1..121: note = chr7:155248792-155248913
  misc_feature 1..121: note = hyper
  source 1..121: mol_type = genomic DNA
ctggggaaggagcttcgcaaggccagggtgcaaccttcaggccccaggtggcctggcaggccacgctgcctcggagatgcttgccagactccccaagttcactcagggcctggcagcaacc

SEQ ID NO: 52426 - DNA, 569 bp, Homo sapiens
  misc_feature 1..569: note = chr7:155248943-155249512
  misc_feature 1..569: note = hyper
  source 1..569: mol_type = genomic DNA
ctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaagga

SEQ ID NO: 52427 - DNA, 62 bp, Homo sapiens
  misc_feature 1..62: note = chr7:155249863-155249925
  misc_feature 1..62: note = hyper
  source 1..62: mol_type = genomic DNA
ggaattgtgggatttcgccccacggtaaacaatatggaaatcttaaaaatagcgatcttcct

SEQ ID NO: 52428 - DNA, 42 bp, Homo sapiens
  misc_feature 1..42: note = chr7:155250011-155250053
  misc_feature 1..42: note = hyper
  source 1..42: mol_type = genomic DNA
agcgcgggcgagcgcaggagacgcggtcgggggtctctccgg

SEQ ID NO: 52429 - DNA, 432 bp, Homo sapiens
  misc_feature 1..432: note = chr7:155250355-155250787
  misc_feature 1..432: note = hyper
  source 1..432: mol_type = genomic DNA
gcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccg

SEQ ID NO: 52430 - DNA, 89 bp, Homo sapiens; identical to SEQ ID NO: 31657
  misc_feature 1..89: note = chr7:155251170-155251259
  misc_feature 1..89: note = hyper
  source 1..89: mol_type = genomic DNA

SEQ ID NO: 52431 - DNA, 204 bp, Homo sapiens; identical to SEQ ID NO: 31658
  misc_feature 1..204: note = chr7:155251346-155251550
  misc_feature 1..204: note = hyper
  source 1..204: mol_type = genomic DNA

SEQ ID NO: 52432 - DNA, 40 bp, Homo sapiens
  misc_feature 1..40: note = chr7:155251661-155251701
  misc_feature 1..40: note = hyper
  source 1..40: mol_type = genomic DNA
cggacagctcgcaagccggcgccaacctgggcgcgcagcc

SEQ ID NO: 52433 - DNA, 85 bp, Homo sapiens; identical to SEQ ID NO: 19901
  misc_feature 1..85: note = chr7:155252162-155252247
  misc_feature 1..85: note = hyper
  source 1..85: mol_type = genomic DNA

SEQ ID NO: 52434 - DNA, 372 bp, Homo sapiens
  misc_feature 1..372: note = chr7:155252490-155252862
  misc_feature 1..372: note = hyper
  source 1..372: mol_type = genomic DNA
ccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaat

SEQ ID NO: 52435 - DNA, 87 bp, Homo sapiens
  misc_feature 1..87: note = chr7:155253041-155253128
  misc_feature 1..87: note = hyper
  source 1..87: mol_type = genomic DNA
cagcccaagtcgcctatcttcatgggctttaaaatatccctgcaagataatgtttctgttctttggtttctccgaaagaaaggggag

SEQ ID NO: 52436 - DNA, 75 bp, Homo sapiens
  misc_feature 1..75: note = chr7:155255324-155255399
  misc_feature 1..75: note = hyper
  source 1..75: mol_type = genomic DNA
acagggcttgtacaaccactccaccacagccaaggagggcaagtcggacagcgagtagggcggggggcatggagg

SEQ ID NO: 52437 - DNA, 15 bp, Homo sapiens
  misc_feature 1..15: note = chr7:155256218-155256233
  misc_feature 1..15: note = hyper
  source 1..15: mol_type = genomic DNA
caccaagggcccaac

SEQ ID NO: 52438 - DNA, 107 bp, Homo sapiens
  misc_feature 1..107: note = chr7:155256312-155256419
  misc_feature 1..107: note = hyper
  source 1..107: mol_type = genomic DNA
cctgccctgggcactgcctccatgcagaagcgcttcgaggttctggggctaaaggcctggggtgtgtggcctaaagcccaagagcggtggggcgaccctccttttgg

SEQ ID NO: 52439 - DNA, 337 bp, Homo sapiens
  misc_feature 1..337: note = chr7:155257856-155258193
  misc_feature 1..337: note = hyper
  source 1..337: mol_type = genomic DNA
ccacccgtgctggaccgaggcgctttcccctggggacaggaactttttactccactgagacaaagagactctccttttcaaagtgtcatttttgtttaccttttgttgtttcccccccaaaacaaaagactttgtacaacttcctaagcaggattgggggagggatcagcttcgcctgtgctgaccgcgcctctggattccgctcatcaggaagtgtttggggtctttgagcgagtgatctacgcgttgaattgctgtttttccaaactttcatggcttaaaaattttttttcttctccctgtaaaagaaactcagagactggtgatctgttaccga

SEQ ID NO: 52440 - DNA, 377 bp, Homo sapiens; identical to SEQ ID NO: 19905
  misc_feature 1..377: note = chr7:155258487-155258864
  misc_feature 1..377: note = hyper
  source 1..377: mol_type = genomic DNA

SEQ ID NO: 52441 - DNA, 35 bp, Homo sapiens; identical to SEQ ID NO: 19906
  misc_feature 1..35: note = chr7:155258914-155258949
  misc_feature 1..35: note = hyper
  source 1..35: mol_type = genomic DNA

SEQ ID NO: 52442 - DNA, 116 bp, Homo sapiens; identical to SEQ ID NO: 31671
  misc_feature 1..116: note = chr7:155260458-155260574
  misc_feature 1..116: note = hyper
  source 1..116: mol_type = genomic DNA

SEQ ID NO: 52443 - DNA, 95 bp, Homo sapiens; identical to SEQ ID NO: 19907
  misc_feature 1..95: note = chr7:155260785-155260880
  misc_feature 1..95: note = hyper
  source 1..95: mol_type = genomic DNA

SEQ ID NO: 52444 - DNA, 167 bp, Homo sapiens
  misc_feature 1..167: note = chr7:155261210-155261377
  misc_feature 1..167: note = hyper
  source 1..167: mol_type = genomic DNA
tttccccagcctctaccccctccaactaactttcctttcttcccttctcttttcttccctctctggatgggtaatcacaggctccgctgccaagcgcgctgcgaggagccgctgcccgttcccgtcggtgcccctccccgcggcagcctggccgagtccgcccagcc

SEQ ID NO: 52445 - DNA, 125 bp, Homo sapiens; identical to SEQ ID NO: 31674
  misc_feature 1..125: note = chr7:155262418-155262543
  misc_feature 1..125: note = hyper
  source 1..125: mol_type = genomic DNA

SEQ ID NO: 52446 - DNA, 215 bp, Homo sapiens; identical to SEQ ID NO: 9326
  misc_feature 1..215: note = chr7:155264127-155264342
  misc_feature 1..215: note = hyper
  source 1..215: mol_type = genomic DNA

SEQ ID NO: 52447 - DNA, 85 bp, Homo sapiens; identical to SEQ ID NO: 19909
  misc_feature 1..85: note = chr7:155301753-155301838
  misc_feature 1..85: note = hyper
  source 1..85: mol_type = genomic DNA

SEQ ID NO: 52448 - DNA, 74 bp, Homo sapiens
  misc_feature 1..74: note = chr7:155301931-155302005
  misc_feature 1..74: note = hyper
  source 1..74: mol_type = genomic DNA
gtaccgcagattgttattacaatgtaacaacgacctgctttacatcattacggggctagcgtaaattccagttt

SEQ ID NO: 52449 - skipped

SEQ ID NO: 52450 - DNA, 28 bp, Homo sapiens
  misc_feature 1..28: note = chr7:155303335-155303363
  misc_feature 1..28: note = hyper
  source 1..28: mol_type = genomic DNA
tgaatgttttaatcgctaaaaatgtcta

SEQ ID NO: 52451 - DNA, 297 bp, Homo sapiens
  misc_feature 1..297: note = chr7:155325872-155326169
  misc_feature 1..297: note = hyper
  source 1..297: mol_type = genomic DNA
tcccaaacggcgcggcctcgctcaccctcaaaacccactccgcgcccgacgggaacggctggagggaggaaagagccaggcacctctcgttcggggtctgacattgtcacctggcagataagtgagtctgctcggatgtgccggctcggaacatgcccgttcgtcaaagagggaggggaaacaaaacgagcttgtgcctcattcccggtggctctccacgcaaagttaacgtttgtttactctaagcatatgcccaggtgaggcctgcacagccacctcgccgcgggtgcagggcgc

SEQ ID NO: 52452 - DNA, 14 bp, Homo sapiens
  misc_feature 1..14: note = chr7:155326527-155326541
  misc_feature 1..14: note = hyper
  source 1..14: mol_type = genomic DNA
ggcattgtttcagc

SEQ ID NO: 52453 - DNA, 25 bp, Homo sapiens
  misc_feature 1..25: note = chr7:155579904-155579929
  misc_feature 1..25: note = hyper
  source 1..25: mol_type = genomic DNA
ccccaaggtaagccccgaggcgtcc

SEQ ID NO: 52454 - DNA, 63 bp, Homo sapiens
  misc_feature 1..63: note = chr7:155580211-155580274
  misc_feature 1..63: note = hyper
  source 1..63: mol_type = genomic DNA
cgcccgcccgctgcaggccaggactgcgctctgtctgcccacggcccccgcctggcacacacg

SEQ ID NO: 52455 - DNA, 62 bp, Homo sapiens
  misc_feature 1..62: note = chr7:155600567-155600629
  misc_feature 1..62: note = hyper
  source 1..62: mol_type = genomic DNA
ttggagtctggttgtcgccatggagggacagcttctatccagggccctaactgtagcgtggg

SEQ ID NO: 52456 - DNA, 257 bp, Homo sapiens; identical to SEQ ID NO: 31683
  misc_feature 1..257: note = chr7:155601133-155601390
  misc_feature 1..257: note = hyper
  source 1..257: mol_type = genomic DNA

SEQ ID NO: 52457 - DNA, 30 bp, Homo sapiens; identical to SEQ ID NO: 31684
  misc_feature 1..30: note = chr7:155601921-155601951
  misc_feature 1..30: note = hyper
  source 1..30: mol_type = genomic DNA

SEQ ID NO: 52458 - DNA, 322 bp, Homo sapiens
  misc_feature 1..322: note = chr7:155602805-155603127
  misc_feature 1..322: note = hyper
  source 1..322: mol_type = genomic DNA
gccgcgggggatcgataacccgggagtaagtggggctgcaggcgtctgcctcgctgcgcggctctgtgcgcttgcagctttgcagcagggctgcaaggcccaagccctgggaaggtgtgcgagcccaggaccccttctgcggtattggcctcccgcagagcagggcagaagctgacccactctggctctgggacctcgggtatccacgcccccgccgctctctccgcagtgcctccctcctctcgggttccgagggaccctggcaaggcccctcctccgcggggagtgagggtgacgagaggatgggcgcctcgggctagcc

SEQ ID NO: 52459 - DNA, 41 bp, Homo sapiens; identical to SEQ ID NO: 31686
  misc_feature 1..41: note = chr7:155604978-155605019
  misc_feature 1..41: note = hyper
  source 1..41: mol_type = genomic DNA

SEQ ID NO: 52460 - DNA, 166 bp, Homo sapiens
  misc_feature 1..166: note = chr7:156409347-156409513
  misc_feature 1..166: note = hyper
  source 1..166: mol_type = genomic DNA
tcccctttccccgctggaaccactttctccaaggagctccgccccgcgctctccccgaccccgtgcgcccccagacctcgcgtcccccgcgctctcccccgccgcgccctcctgccccgcgcccctcctcgccccgaccccgcgcccctgcgcccgggctccagcc

SEQ ID NO: 52461 - DNA, 33 bp, Homo sapiens
  misc_feature 1..33: note = chr7:156409802-156409835
  misc_feature 1..33: note = hyper
  source 1..33: mol_type = genomic DNA
tagttcaaggaataaacacggatccccactggc

SEQ ID NO: 52462 - DNA, 237 bp, Homo sapiens; identical to SEQ ID NO: 31689
  misc_feature 1..237: note = chr7:156432918-156433155
  misc_feature 1..237: note = hyper
  source 1..237: mol_type = genomic DNA

SEQ ID NO: 52463 - DNA, 81 bp, Homo sapiens
  misc_feature 1..81: note = chr7:156794072-156794153
  misc_feature 1..81: note = hyper
  source 1..81: mol_type = genomic DNA
gtgctgcaatgaactcgggtgtgcaaatgtctctttgagatctttttgttttttccaattcttttggatatatacccagaa

SEQ ID NO: 52464 - DNA, 190 bp, Homo sapiens
  misc_feature 1..190: note = chr7:156795914-156796104
  misc_feature 1..190: note = hyper
  source 1..190: mol_type = genomic DNA
gcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactctt

SEQ ID NO: 52465 - DNA, 40 bp, Homo sapiens; identical to SEQ ID NO: 19915
  misc_feature 1..40: note = chr7:156796494-156796534
  misc_feature 1..40: note = hyper
  source 1..40: mol_type = genomic DNA

SEQ ID NO: 52466 - DNA, 43 bp, Homo sapiens
  misc_feature 1..43: note = chr7:156799467-156799510
  misc_feature 1..43: note = hyper
  source 1..43: mol_type = genomic DNA
actatcagtgcccactccccaaggaatgcggactcaggaccac

SEQ ID NO: 52467 - DNA, 66 bp, Homo sapiens; identical to SEQ ID NO: 19916
  misc_feature 1..66: note = chr7:156800933-156800999
  misc_feature 1..66: note = hyper
  source 1..66: mol_type = genomic DNA

SEQ ID NO: 52468 - DNA, 49 bp, Homo sapiens
  misc_feature 1..49: note = chr7:156801029-156801078
  misc_feature 1..49: note = hyper
  source 1..49: mol_type = genomic DNA
aagcccaggctggcaggggattcgcagacgcagacgtgtctgaggtgag

SEQ ID NO: 52469 - DNA, 271 bp, Homo sapiens; identical to SEQ ID NO: 19918
  misc_feature 1..271: note = chr7:156801601-156801872
  misc_feature 1..271: note = hyper
  source 1..271: mol_type = genomic DNA

SEQ ID NO: 52470 - DNA, 24 bp, Homo sapiens
  misc_feature 1..24: note = chr7:156809199-156809223
  misc_feature 1..24: note = hyper
  source 1..24: mol_type = genomic DNA
gtccatgttcgataatggcaggaa

SEQ ID NO: 52471 - DNA, 281 bp, Homo sapiens
  misc_feature 1..281: note = chr7:156811436-156811717
  misc_feature 1..281: note = hyper
  source 1..281: mol_type = genomic DNA
ctgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgag

SEQ ID NO: 52472 - DNA, 105 bp, Homo sapiens; identical to SEQ ID NO: 31705
  misc_feature 1..105: note = chr7:156811921-156812026
  misc_feature 1..105: note = hyper
  source 1..105: mol_type = genomic DNA

SEQ ID NO: 52473 - DNA, 37 bp, Homo sapiens; identical to SEQ ID NO: 31706
  misc_feature 1..37: note = chr7:156812242-156812279
  misc_feature 1..37: note = hyper
  source 1..37: mol_type = genomic DNA

SEQ ID NO: 52474 - DNA, 64 bp, Homo sapiens
  misc_feature 1..64: note = chr7:156812788-156812852
  misc_feature 1..64: note = hyper
  source 1..64: mol_type = genomic DNA
taaggatattgtatacgcggggggtatgctttattgacaatttcattttccaattagtaatttt

SEQ ID NO: 52475 - DNA, 114 bp, Homo sapiens; identical to SEQ ID NO: 31709
  misc_feature 1..114: note = chr7:156871039-156871153
  misc_feature 1..114: note = hyper
  source 1..114: mol_type = genomic DNA

SEQ ID NO: 52476 - DNA, 13 bp, Homo sapiens
  misc_feature 1..13: note = chr7:156871297-156871310
  misc_feature 1..13: note = hyper
  source 1..13: mol_type = genomic DNA
ggggatctgaaca

SEQ ID NO: 52477 - DNA, 138 bp, Homo sapiens; identical to SEQ ID NO: 31711
  misc_feature 1..138: note = chr7:157129147-157129285
  misc_feature 1..138: note = hyper
  source 1..138: mol_type = genomic DNA

SEQ ID NO: 52478 - DNA, 49 bp, Homo sapiens; identical to SEQ ID NO: 31712
  misc_feature 1..49: note = chr7:157130967-157131016
  misc_feature 1..49: note = hyper
  source 1..49: mol_type = genomic DNA

SEQ ID NO: 52479 - DNA, 34 bp, Homo sapiens; identical to SEQ ID NO: 31713
  misc_feature 1..34: note = chr7:157476555-157476589
  misc_feature 1..34: note = hyper
  source 1..34: mol_type = genomic DNA

SEQ ID NO: 52480 - DNA, 201 bp, Homo sapiens
  misc_feature 1..201: note = chr7:157477272-157477473
  misc_feature 1..201: note = hyper
  source 1..201: mol_type = genomic DNA
ctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctccccc

SEQ ID NO: 52481 - DNA, 210 bp, Homo sapiens
  misc_feature 1..210: note = chr7:157481759-157481969
  misc_feature 1..210: note = hyper
  source 1..210: mol_type = genomic DNA
ggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggt

SEQ ID NO: 52482 - DNA, 131 bp, Homo sapiens; identical to SEQ ID NO: 31719
  misc_feature 1..131: note = chr7:157482200-157482331
  misc_feature 1..131: note = hyper
  source 1..131: mol_type = genomic DNA

SEQ ID NO: 52483 - DNA, 134 bp, Homo sapiens
  misc_feature 1..134: note = chr7:157482667-157482801
  misc_feature 1..134: note = hyper
  source 1..134: mol_type = genomic DNA
gctgctcgccccttccctcctcctttcccacacgcctcccatctccgtgcctgcacccccccacccccagcaccctgcaatggtcggaactgcagggagtggggagcaacgcgaaaggccgagagaagagcgct

SEQ ID NO: 52484 - DNA, 265 bp, Homo sapiens
  misc_feature 1..265: note = chr7:157483055-157483320
  misc_feature 1..265: note = hyper
  source 1..265: mol_type = genomic DNA
gttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgca

SEQ ID NO: 52485 - DNA, 705 bp, Homo sapiens
  misc_feature 1..705: note = chr7:157483538-157484243
  misc_feature 1..705: note = hyper
  source 1..705: mol_type = genomic DNA
cgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtctt

SEQ ID NO: 52486 - DNA, 25 bp, Homo sapiens
  misc_feature 1..25: note = chr7:157484461-157484486
  misc_feature 1..25: note = hyper
  source 1..25: mol_type = genomic DNA
tgcccacataacccccggcccctgg

SEQ ID NO: 52487 - DNA, 370 bp, Homo sapiens
  misc_feature 1..370: note = chr7:157484507-157484877
  misc_feature 1..370: note = hyper
  source 1..370: mol_type = genomic DNA
cgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgg

SEQ ID NO: 52488 - DNA, 24 bp, Homo sapiens
  misc_feature 1..24: note = chr7:157485503-157485527
  misc_feature 1..24: note = hyper
  source 1..24: mol_type = genomic DNA
gcccagggcaaggcccgcaaaaac

SEQ ID NO: 52489 - DNA, 271 bp, Homo sapiens
  misc_feature 1..271: note = chr7:157485705-157485976
  misc_feature 1..271: note = hyper
  source 1..271: mol_type = genomic DNA
tccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggt

SEQ ID NO: 52490 - DNA, 100 bp, Homo sapiens
  misc_feature 1..100: note = chr7:157486503-157486603
  misc_feature 1..100: note = hyper
  source 1..100: mol_type = genomic DNA
gctggggtctccagcaggcggccgggagctctccgaggtggccaggagtggccggtagccgtctccctcggccaggccgtgtccagcccctcagtctcca

SEQ ID NO: 52491 - DNA, 144 bp, Homo sapiens; identical to SEQ ID NO: 31728
  misc_feature 1..144: note = chr7:158379278-158379422
  misc_feature 1..144: note = hyper
  source 1..144: mol_type = genomic DNA

SEQ ID NO: 52492 - DNA, 36 bp, Homo sapiens; identical to SEQ ID NO: 31729
  misc_feature 1..36: note = chr7:158380360-158380396
  misc_feature 1..36: note = hyper
  source 1..36: mol_type = genomic DNA

SEQ ID NO: 52493 - DNA, 236 bp, Homo sapiens; identical to SEQ ID NO: 31730
  misc_feature 1..236: note = chr7:158380974-158381210
  misc_feature 1..236: note = hyper
  source 1..236: mol_type = genomic DNA

SEQ ID NO: 52494 - DNA, 336 bp, Homo sapiens; identical to SEQ ID NO: 31731
  misc_feature 1..336: note = chr7:158823329-158823665
  misc_feature 1..336: note = hyper
  source 1..336: mol_type = genomic DNA

SEQ ID NO: 52495 - DNA, 40 bp, Homo sapiens; identical to SEQ ID NO: 31734
  misc_feature 1..40: note = chr7:158937902-158937942
  misc_feature 1..40: note = hyper
  source 1..40: mol_type = genomic DNA

SEQ ID NO: 52496 - DNA, 19 bp, Homo sapiens
  misc_feature 1..19: note = chr7:158938399-158938418
  misc_feature 1..19: note = hyper
  source 1..19: mol_type = genomic DNA
cacgcggtgccactggggc

SEQ ID NO: 52497 - DNA, 143 bp, Homo sapiens; identical to SEQ ID NO: 31736
  misc_feature 1..143: note = chr8:495720-495863
  misc_feature 1..143: note = hyper
  source 1..143: mol_type = genomic DNA

SEQ ID NO: 52498 - DNA, 156 bp, Homo sapiens
  misc_feature 1..156: note = chr8:686714-686870
  misc_feature 1..156: note = hyper
  source 1..156: mol_type = genomic DNA
tatgcggtttgttttcgcatcttttacctcatttaaatgccgtagccatgcaggtggaaagcagaaatccatttctgcgtttatgttaaactggggctgagagacttgcccagggtcggtgaccgcccagggatccccataccagcgcgtctagct

SEQ ID NO: 52499 - DNA, 129 bp, Homo sapiens; identical to SEQ ID NO: 3193
  misc_feature 1..129: note = chr8:687513-687642
  misc_feature 1..129: note = hyper
  source 1..129: mol_type = genomic DNA

SEQ ID NO: 52500 - DNA, 43 bp, Homo sapiens; identical to SEQ ID NO: 31741
  misc_feature 1..43: note = chr8:688697-688740
  misc_feature 1..43: note = hyper
  source 1..43: mol_type = genomic DNA

SEQ ID NO: 52501 - DNA, 35 bp, Homo sapiens; identical to SEQ ID NO: 31742
  misc_feature 1..35: note = chr8:1772635-1772670
  misc_feature 1..35: note = hyper
  source 1..35: mol_type = genomic DNA

SEQ ID NO: 52502 - DNA, 86 bp, Homo sapiens
  misc_feature 1..86: note = chr8:4849177-4849263
  misc_feature 1..86: note = hyper
  source 1..86: mol_type = genomic DNA
cgcgctgccgagccccggggcccagcgccgacgcccccggggggaggcccgaccttggtcacccgggctttgctaggcaaggggaa

SEQ ID NO: 52503 - DNA, 170 bp, Homo sapiens
  misc_feature 1..170: note = chr8:4849296-4849466
  misc_feature 1..170: note = hyper
  source 1..170: mol_type = genomic DNA
cggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaata

SEQ ID NO: 52504 - DNA, 291 bp, Homo sapiens
  misc_feature 1..291: note = chr8:4849500-4849791
  misc_feature 1..291: note = hyper
  source 1..291: mol_type = genomic DNA
ccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccaccc

SEQ ID NO: 52505 - DNA, 15 bp, Homo sapiens
  misc_feature 1..15: note = chr8:4850232-4850247
  misc_feature 1..15: note = hyper
  source 1..15: mol_type = genomic DNA
gccctgctcagcagg

SEQ ID NO: 52506 - DNA, 183 bp, Homo sapiens
  misc_feature 1..183: note = chr8:4850516-4850699
  misc_feature 1..183: note = hyper
  source 1..183: mol_type = genomic DNA
agggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatg

SEQ ID NO: 52507 - DNA, 33 bp, Homo sapiens; identical to SEQ ID NO: 31747
  misc_feature 1..33: note = chr8:4851342-4851375
  misc_feature 1..33: note = hyper
  source 1..33: mol_type = genomic DNA

SEQ ID NO: 52508 - DNA, 30 bp, Homo sapiens; identical to SEQ ID NO: 31748
  misc_feature 1..30: note = chr8:4851581-4851611
  misc_feature 1..30: note = hyper
  source 1..30: mol_type = genomic DNA

SEQ ID NO: 52509 - DNA, 159 bp, Homo sapiens
  misc_feature 1..159: note = chr8:4851862-4852021
  misc_feature 1..159: note = hyper
  source 1..159: mol_type = genomic DNA
cagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccg

SEQ ID NO: 52510 - DNA, 80 bp, Homo sapiens
  misc_feature 1..80: note = chr8:4852118-4852198
  misc_feature 1..80: note = hyper
  source 1..80: mol_type = genomic DNA
gcatcgggtcccgagccactgcagggctgagctgctccgagcgcggagacccgggctggcggggccggggccggggacga

SEQ ID NO: 52511 - DNA, 77 bp, Homo sapiens; identical to SEQ ID NO: 31750
  misc_feature 1..77: note = chr8:4852501-4852578
  misc_feature 1..77: note = hyper
  source 1..77: mol_type = genomic DNA

SEQ ID NO: 52512 - DNA, 182 bp, Homo sapiens; identical to SEQ ID NO: 31751
  misc_feature 1..182: note = chr8:6692272-6692454
  misc_feature 1..182: note = hyper
  source 1..182: mol_type = genomic DNA

SEQ ID NO: 52513 - DNA, 468 bp, Homo sapiens; identical to SEQ ID NO: 31752
  misc_feature 1..468: note = chr8:6692702-6693170
  misc_feature 1..468: note = hyper
  source 1..468: mol_type = genomic DNA

SEQ ID NO: 52514 - DNA, 29 bp, Homo sapiens
  misc_feature 1..29: note = chr8:9756486-9756515
  misc_feature 1..29: note = hyper
  source 1..29: mol_type = genomic DNA
cgctagagtgaaatcgatgtgcatggaaa

SEQ ID NO: 52515 - DNA, 272 bp, Homo sapiens; identical to SEQ ID NO: 31756
  misc_feature 1..272: note = chr8:9761450-9761722
  misc_feature 1..272: note = hyper
  source 1..272: mol_type = genomic DNA

SEQ ID NO: 52516 - DNA, 42 bp, Homo sapiens; identical to SEQ ID NO: 31757
  misc_feature 1..42: note = chr8:9761782-9761824
  misc_feature 1..42: note = hyper
  source 1..42: mol_type = genomic DNA

SEQ ID NO: 52517 - DNA, 253 bp, Homo sapiens; identical to SEQ ID NO: 31758
  misc_feature 1..253: note = chr8:9762041-9762294
  misc_feature 1..253: note = hyper
  source 1..253: mol_type = genomic DNA

SEQ ID NO: 52518 - DNA, 279 bp, Homo sapiens; identical to SEQ ID NO: 19935
  misc_feature 1..279: note = chr8:9762864-9763143
  misc_feature 1..279: note = hyper
  source 1..279: mol_type = genomic DNA

SEQ ID NO: 52519 - DNA, 42 bp, Homo sapiens
  misc_feature 1..42: note = chr8:9763275-9763317
  misc_feature 1..42: note = hyper
  source 1..42: mol_type = genomic DNA
gcggagccgcctggaaatccagcccttcgcgtgaactcgcgt

SEQ ID NO: 52520 - DNA, 226 bp, Homo sapiens; identical to SEQ ID NO: 31761
  misc_feature 1..226: note = chr8:9763536-9763762
  misc_feature 1..226: note = hyper
  source 1..226: mol_type = genomic DNA

SEQ ID NO: 52521 - DNA, 108 bp, Homo sapiens; identical to SEQ ID NO: 19938
  misc_feature 1..108: note = chr8:9763787-9763895
  misc_feature 1..108: note = hyper
  source 1..108: mol_type = genomic DNA

SEQ ID NO: 52522 - DNA, 220 bp, Homo sapiens; identical to SEQ ID NO: 19939
  misc_feature 1..220: note = chr8:9764214-9764434
  misc_feature 1..220: note = hyper
  source 1..220: mol_type = genomic DNA

SEQ ID NO: 52523 - DNA, 401 bp, Homo sapiens
  misc_feature 1..401: note = chr8:9764551-9764952
  misc_feature 1..401: note = hyper
  source 1..401: mol_type = genomic DNA
tccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcag

SEQ ID NO: 52524 - DNA, 167 bp, Homo sapiens
  misc_feature 1..167: note = chr8:10587422-10587589
  misc_feature 1..167: note = hyper
  source 1..167: mol_type = genomic DNA
ccccgccccctggggcgccgatctccgctcctgtcccagcagaggagcctccctgcccgccgcgcggtttcactttggaccgcgccaagtgcccccgctctgaatcctgggcaccgcgagcacccacgctcgcgcagatggccagccacgcgggcacgaagagggcc

SEQ ID NO: 52525 - DNA, 115 bp, Homo sapiens; identical to SEQ ID NO: 31765
  misc_feature 1..115: note = chr8:10587893-10588008
  misc_feature 1..115: note = hyper
  source 1..115: mol_type = genomic DNA

SEQ ID NO: 52526 - DNA, 109 bp, Homo sapiens; identical to SEQ ID NO: 31766
  misc_feature 1..109: note = chr8:10588184-10588293
  misc_feature 1..109: note = hyper
  source 1..109: mol_type = genomic DNA

SEQ ID NO: 52527 - DNA, 30 bp, Homo sapiens; identical to SEQ ID NO: 31767
  misc_feature 1..30: note = chr8:10590903-10590933
  misc_feature 1..30: note = hyper
  source 1..30: mol_type = genomic DNA

SEQ ID NO: 52528 - DNA, 39 bp, Homo sapiens; identical to SEQ ID NO: 31768
  misc_feature 1..39: note = chr8:10916999-10917038
  misc_feature 1..39: note = hyper
  source 1..39: mol_type = genomic DNA

SEQ ID NO: 52529 - DNA, 283 bp, Homo sapiens; identical to SEQ ID NO: 31769
  misc_feature 1..283: note = chr8:11058266-11058549
  misc_feature 1..283: note = hyper
  source 1..283: mol_type = genomic DNA

SEQ ID NO: 52530 - DNA, 35 bp, Homo sapiens; identical to SEQ ID NO: 31770
  misc_feature 1..35: note = chr8:11058764-11058799
  misc_feature 1..35: note = hyper
  source 1..35: mol_type = genomic DNA

SEQ ID NO: 52531 - DNA, 17 bp, Homo sapiens
  misc_feature 1..17: note = chr8:11204509-11204526
  misc_feature 1..17: note = hyper
  source 1..17: mol_type = genomic DNA
agcgccttggacccagc

SEQ ID NO: 52532 - DNA, 27 bp, Homo sapiens
  misc_feature 1..27: note = chr8:11204783-11204810
  misc_feature 1..27: note = hyper
  source 1..27: mol_type = genomic DNA
ctgggccagctacaccgcaaacctttc

SEQ ID NO: 52533 - DNA, 261 bp, Homo sapiens
  misc_feature 1..261: note = chr8:11204905-11205166
  misc_feature 1..261: note = hyper
  source 1..261: mol_type = genomic DNA
gatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgc

SEQ ID NO: 52534 - DNA, 255 bp, Homo sapiens; identical to SEQ ID NO: 31773
  misc_feature 1..255: note = chr8:11205167-11205422
  misc_feature 1..255: note = hyper
  source 1..255: mol_type = genomic DNA

SEQ ID NO: 52535 - DNA, 257 bp, Homo sapiens; identical to SEQ ID NO: 31774
  misc_feature 1..257: note = chr8:11205445-11205702
  misc_feature 1..257: note = hyper
  source 1..257: mol_type = genomic DNA

SEQ ID NO: 52536 - DNA, 61 bp, Homo sapiens; identical to SEQ ID NO: 9392
  misc_feature 1..61: note = chr8:11206007-11206068
  misc_feature 1..61: note = hyper
  source 1..61: mol_type = genomic DNA

SEQ ID NO: 52537 - DNA, 22 bp, Homo sapiens
  misc_feature 1..22: note = chr8:11536805-11536827
  misc_feature 1..22: note = hyper
  source 1..22: mol_type = genomic DNA
gaaggttctcagactcggggat

SEQ ID NO: 52538 - DNA, 69 bp, Homo sapiens
  misc_feature 1..69: note = chr8:11537156-11537225
  misc_feature 1..69: note = hyper
  source 1..69: mol_type = genomic DNA
cgcggccttaaaagtatcccggcgagccctgagtgggccgggtgctgggcgaacagtcctagccctgca

SEQ ID NO: 52539 - DNA, 24 bp, Homo sapiens
  misc_feature 1..24: note = chr8:11537259-11537283
  misc_feature 1..24: note = hyper
  source 1..24: mol_type = genomic DNA
ttacaggggcgaggttgggatcgg

SEQ ID NO: 52540 - DNA, 30 bp, Homo sapiens; identical to SEQ ID NO: 31778
  misc_feature 1..30: note = chr8:11540426-11540456
  misc_feature 1..30: note = hyper
  source 1..30: mol_type = genomic DNA

SEQ ID NO: 52541 - DNA, 46 bp, Homo sapiens; identical to SEQ ID NO: 31779
  misc_feature 1..46: note = chr8:11550050-11550096
  misc_feature 1..46: note = hyper
  source 1..46: mol_type = genomic DNA

SEQ ID NO: 52542 - DNA, 50 bp, Homo sapiens; identical to SEQ ID NO: 9395
  misc_feature 1..50: note = chr8:11550672-11550722
  misc_feature 1..50: note = hyper
  source 1..50: mol_type = genomic DNA

SEQ ID NO: 52543 - DNA, 43 bp, Homo sapiens; identical to SEQ ID NO: 31784
  misc_feature 1..43: note = chr8:11560468-11560511
  misc_feature 1..43: note = hyper
  source 1..43: mol_type = genomic DNA

SEQ ID NO: 52544 - DNA, 102 bp, Homo sapiens
  misc_feature 1..102: note = chr8:11560793-11560895
  misc_feature 1..102: note = hyper
  source 1..102: mol_type = genomic DNA
ctgtgattgctctattaacctttagacctgtctgagggactctccggctcgcagccccgctgcgctggggcctccaggctctgacgccgactcccaactcag

SEQ ID NO: 52545 - DNA, 30 bp, Homo sapiens; identical to SEQ ID NO: 9400
  misc_feature 1..30: note = chr8:11561116-11561146
  misc_feature 1..30: note = hyper
  source 1..30: mol_type = genomic DNA

SEQ ID NO: 52546 - DNA, 51 bp, Homo sapiens
  misc_feature 1..51: note = chr8:11561391-11561442
  misc_feature 1..51: note = hyper
  source 1..51: mol_type = genomic DNA
cacaggaagggggggcggggagggagaaagggaactcattaataaagctga

SEQ ID NO: 52547 - DNA, 27 bp, Homo sapiens
  misc_feature 1..27: note = chr8:11562169-11562196
  misc_feature 1..27: note = hyper
  source 1..27: mol_type = genomic DNA
ggactgacgggcccgggacaggctgca

SEQ ID NO: 52548 - DNA, 187 bp, Homo sapiens
  misc_feature 1..187: note = chr8:11562235-11562422
  misc_feature 1..187: note = hyper
  source 1..187: mol_type = genomic DNA
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctc

SEQ ID NO: 52549 - DNA, 216 bp, Homo sapiens
  misc_feature 1..216: note = chr8:11562485-11562701
  misc_feature 1..216: note = hyper
  source 1..216: mol_type = genomic DNA
gccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggag

SEQ ID NO: 52550 - DNA, 53 bp, Homo sapiens; identical to SEQ ID NO: 31790
  misc_feature 1..53: note = chr8:12808858-12808911
  misc_feature 1..53: note = hyper
  source 1..53: mol_type = genomic DNA

SEQ ID NO: 52551 - DNA, 59 bp, Homo sapiens; identical to SEQ ID NO: 31791
  misc_feature 1..59: note = chr8:12809671-12809730
  misc_feature 1..59: note = hyper
  source 1..59: mol_type = genomic DNA

SEQ ID NO: 52552 - DNA, 267 bp, Homo sapiens; identical to SEQ ID NO: 31792
  misc_feature 1..267: note = chr8:12989381-12989648
  misc_feature 1..267: note = hyper
  source 1..267: mol_type = genomic DNA

SEQ ID NO: 52553 - DNA, 73 bp, Homo sapiens; identical to SEQ ID NO: 31793
  misc_feature 1..73: note = chr8:12990075-12990148
  misc_feature 1..73: note = hyper
  source 1..73: mol_type = genomic DNA

SEQ ID NO: 52554 - skipped

SEQ ID NO: 52555 - DNA, 51 bp, Homo sapiens
  misc_feature 1..51: note = chr8:12990784-12990835
  misc_feature 1..51: note = hyper
  source 1..51: mol_type = genomic DNA
agtcggagcgaactgtctcccgcgcgctccgccagccgggccctcccgctg

SEQ ID NO: 52556 - DNA, 262 bp, Homo sapiens; identical to SEQ ID NO: 31795
  misc_feature 1..262: note = chr8:12991064-12991326
  misc_feature 1..262: note = hyper
  source 1..262: mol_type = genomic DNA

SEQ ID NO: 52557 - DNA, 67 bp, Homo sapiens; identical to SEQ ID NO: 31796
  misc_feature 1..67: note = chr8:13133827-13133894
  misc_feature 1..67: note = hyper
  source 1..67: mol_type = genomic DNA

SEQ ID NO: 52558 - DNA, 42 bp, Homo sapiens; identical to SEQ ID NO: 31797
  misc_feature 1..42: note = chr8:13134283-13134325
  misc_feature 1..42: note = hyper
  source 1..42: mol_type = genomic DNA

SEQ ID NO: 52559 - DNA, 85 bp, Homo sapiens; identical to SEQ ID NO: 31798
  misc_feature 1..85: note = chr8:13424168-13424253
  misc_feature 1..85: note = hyper
  source 1..85: mol_type = genomic DNA

SEQ ID NO: 52560 - skipped

SEQ ID NO: 52561 - DNA, 139 bp, Homo sapiens
  misc_feature 1..139: note = chr8:15094366-15094505
  misc_feature 1..139: note = hyper
  source 1..139: mol_type = genomic DNA
cggccggagcctccgcagatgccgcccctaccagcccggctcccgcctccccgccccctgcccgagtccccggacctgctcccgcgcctggggctagggcaggctagccgtccccggcagcgggggtacctctccagcc

SEQ ID NO: 52562 - DNA, 42 bp, Homo sapiens; identical to SEQ ID NO: 31801
  misc_feature 1..42: note = chr8:15094645-15094687
  misc_feature 1..42: note = hyper
  source 1..42: mol_type = genomic DNA

SEQ ID NO: 52563 - DNA, 51 bp, Homo sapiens; identical to SEQ ID NO: 31802
  misc_feature 1..51: note = chr8:15095356-15095407
  misc_feature 1..51: note = hyper
  source 1..51: mol_type = genomic DNA

SEQ ID NO: 52564 - DNA, 102 bp, Homo sapiens; identical to SEQ ID NO: 31803
  misc_feature 1..102: note = chr8:16859352-16859454
  misc_feature 1..102: note = hyper
  source 1..102: mol_type = genomic DNA

SEQ ID NO: 52565 - DNA, 41 bp, Homo sapiens; identical to SEQ ID NO: 31804
  misc_feature 1..41: note = chr8:16884323-16884364
  misc_feature 1..41: note = hyper
  source 1..41: mol_type = genomic DNA

SEQ ID NO: 52566 - DNA, 322 bp, Homo sapiens; identical to SEQ ID NO: 31805
  misc_feature 1..322: note = chr8:16884365-16884687
  misc_feature 1..322: note = hyper
  source 1..322: mol_type = genomic DNA

SEQ ID NO: 52567 - DNA, 81 bp, Homo sapiens; identical to SEQ ID NO: 31806
  misc_feature 1..81: note = chr8:16884908-16884989
  misc_feature 1..81: note = hyper
  source 1..81: mol_type = genomic DNA

SEQ ID NO: 52568 - DNA, 30 bp, Homo sapiens; identical to SEQ ID NO: 31807
  misc_feature 1..30: note = chr8:16885322-16885352
  misc_feature 1..30: note = hyper
  source 1..30: mol_type = genomic DNA

SEQ ID NO: 52569 - DNA, 450 bp, Homo sapiens; identical to SEQ ID NO: 31808
  misc_feature 1..450: note = chr8:19614007-19614457
  misc_feature 1..450: note = hyper
  source 1..450: mol_type = genomic DNA

SEQ ID NO: 52570 - DNA, 277 bp, Homo sapiens; identical to SEQ ID NO: 31809
  misc_feature 1..277: note = chr8:19614987-19615264
  misc_feature 1..277: note = hyper
  source 1..277: mol_type = genomic DNA

SEQ ID NO: 52571 - DNA, 34 bp, Homo sapiens; identical to SEQ ID NO: 31810
  misc_feature 1..34: note = chr8:19797566-19797600
  misc_feature 1..34: note = hyper
  source 1..34: mol_type = genomic DNA

SEQ ID NO: 52572 - DNA, 133 bp, Homo sapiens
  misc_feature 1..133: note = chr8:19797806-19797939
  misc_feature 1..133: note = hyper
  source 1..133: mol_type = genomic DNA
ctgtggtcgccgactcggggggttgccaggtctgcgtttggccaccctttctgtcctgggggctgaggtcagctccgggcgcccggccccgccgcgcggctgcgagcacgtggggttgacgggcgccgcgtgg

SEQ ID NO: 52573 - DNA, 661 bp, Homo sapiens; identical to SEQ ID NO: 31812
  misc_feature 1..661: note = chr8:20160990-20161651
  misc_feature 1..661: note = hyper
  source 1..661: mol_type = genomic DNA

SEQ ID NO: 52574 - DNA, 32 bp, Homo sapiens; identical to SEQ ID NO: 9415
  misc_feature 1..32: note = chr8:20161666-20161698
  misc_feature 1..32: note = hyper
  source 1..32: mol_type = genomic DNA

SEQ ID NO: 52575 - DNA, 260 bp, Homo sapiens; identical to SEQ ID NO: 31814
  misc_feature 1..260: note = chr8:21881767-21882027
  misc_feature 1..260: note = hyper
  source 1..260: mol_type = genomic DNA

SEQ ID NO: 52576 - DNA, 30 bp, Homo sapiens; identical to SEQ ID NO: 9416
  misc_feature 1..30: note = chr8:22613837-22613867
  misc_feature 1..30: note = hyper
  source 1..30: mol_type = genomic DNA

SEQ ID NO: 52577 - DNA, 208 bp, Homo sapiens; identical to SEQ ID NO: 31816
  misc_feature 1..208: note = chr8:22722223-22722431
  misc_feature 1..208: note = hyper
  source 1..208: mol_type = genomic DNA

SEQ ID NO: 52578 - DNA, 36 bp, Homo sapiens; identical to SEQ ID NO: 31817
  misc_feature 1..36: note = chr8:22723325-22723361
  misc_feature 1..36: note = hyper
  source 1..36: mol_type = genomic DNA

SEQ ID NO: 52579 - DNA, 65 bp, Homo sapiens
  misc_feature 1..65: note = chr8:22960583-22960648
  misc_feature 1..65: note = hyper
  source 1..65: mol_type = genomic DNA
ggccgaggcagggtgcgacccaggacccaggacggcgtcgggaaccataccatggcccggatccc

SEQ ID NO: 52580 - DNA, 123 bp, Homo sapiens
  misc_feature 1..123: note = chr8:22960723-22960846
  misc_feature 1..123: note = hyper
  source 1..123: mol_type = genomic DNA
gaagagcgcacctggcgccgggagggggcagggagacggggacacggcagggatgcctggccctggtcacctgcggccgggcatgtccgggcaggacgaactcgccgtcggagtcaggggaag

SEQ ID NO: 52581 - DNA, 323 bp, Homo sapiens; identical to SEQ ID NO: 31819
  misc_feature 1..323: note = chr8:23021267-23021590
  misc_feature 1..323: note = hyper
  source 1..323: mol_type = genomic DNA

SEQ ID NO: 52582 - DNA, 134 bp, Homo sapiens
  misc_feature 1..134: note = chr8:23260870-23261004
  misc_feature 1..134: note = hyper
  source 1..134: mol_type = genomic DNA
aggactcacggcgctcccgcgctcccaacagcctttcgagcaggctgggggttgaaccgggttcaagcagtggacgctacagctcccgggcgcagcccccggggtccccgcccccactccgtcccagcccagca

SEQ ID NO: 52583 - DNA, 415 bp, Homo sapiens; identical to SEQ ID NO: 31821
  misc_feature 1..415: note = chr8:23261393-23261808
  misc_feature 1..415: note = hyper
  source 1..415: mol_type = genomic DNA

SEQ ID NO: 52584 - DNA, 378 bp, Homo sapiens
  misc_feature 1..378: note = chr8:23560525-23560903
  misc_feature 1..378: note = hyper
  source 1..378: mol_type = genomic DNA
ctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatt

SEQ ID NO: 52585 - DNA, 50 bp, Homo sapiens
  misc_feature 1..50: note = chr8:23565024-23565074
  misc_feature 1..50: note = hyper
  source 1..50: mol_type = genomic DNA
tctcctttatcctccttaaagcggattgcctggagcgtgccagcttgtgt

SEQ ID NO: 52586 - DNA, 91 bp, Homo sapiens
  misc_feature 1..91: note = chr8:23567492-23567583
  misc_feature 1..91: note = hyper
  source 1..91: mol_type = genomic DNA
tccctcctccctcctcctacttcagcgccagaagcattgaaagccgcccgcccgccgagagtggaaccggtacctcgaatctcgctcattc

SEQ ID NO: 52587 - DNA, 58 bp, Homo sapiens; identical to SEQ ID NO: 31830
  misc_feature 1..58: note = chr8:23567657-23567715
  misc_feature 1..58: note = hyper
  source 1..58: mol_type = genomic DNA

SEQ ID NO: 52588 - DNA, 38 bp, Homo sapiens
  misc_feature 1..38: note = chr8:23571643-23571681
  misc_feature 1..38: note = hyper
  source 1..38: mol_type = genomic DNA
attaaggatctgatacgatcttttcctaaattgctatg

SEQ ID NO: 52589 - DNA, 23 bp, Homo sapiens
  misc_feature 1..23: note = chr8:23571973-23571996
  misc_feature 1..23: note = hyper
  source 1..23: mol_type = genomic DNA
cagaccgtcgggggctgactccg

SEQ ID NO: 52590 - DNA, 108 bp, Homo sapiens
  misc_feature 1..108: note = chr8:23572554-23572662
  misc_feature 1..108: note = hyper
  source 1..108: mol_type = genomic DNA
acacacattgctgaccttgagggtcagacagaccctttctcgtctagtttttagcatcagatgtaacctcagcttgggcttctatgatctcatcgatgtccttttgag

SEQ ID NO: 52591 - DNA, 46 bp, Homo sapiens; identical to SEQ ID NO: 3213
  misc_feature 1..46: note = chr8:23583971-23584017
  misc_feature 1..46: note = hyper
  source 1..46: mol_type = genomic DNA

SEQ ID NO: 52592 - DNA, 57 bp, Homo sapiens
  misc_feature 1..57: note = chr8:23584760-23584817
  misc_feature 1..57: note = hyper
  source 1..57: mol_type = genomic DNA
gcccaccctgagcactttacctgcatggtggccaagacccttcgtccggaccctact

SEQ ID NO: 52593 - DNA, 41 bp, Homo sapiens; identical to SEQ ID NO: 31836
  misc_feature 1..41: note = chr8:23585244-23585285
  misc_feature 1..41: note = hyper
  source 1..41: mol_type = genomic DNA

SEQ ID NO: 52594 - DNA, 21 bp, Homo sapiens
  misc_feature 1..21: note = chr8:24770293-24770314
  misc_feature 1..21: note = hyper
  source 1..21: mol_type = genomic DNA
gggtgacaagccccccgggtg

SEQ ID NO: 52595 - DNA, 232 bp, Homo sapiens; identical to SEQ ID NO: 31839
  misc_feature 1..232: note = chr8:24770893-24771125
  misc_feature 1..232: note = hyper
  source 1..232: mol_type = genomic DNA

SEQ ID NO: 52596 - DNA, 82 bp, Homo sapiens; identical to SEQ ID NO: 19977
  misc_feature 1..82: note = chr8:24771349-24771431
  misc_feature 1..82: note = hyper
  source 1..82: mol_type = genomic DNA

SEQ ID NO: 52597 - DNA, 13 bp, Homo sapiens
  misc_feature 1..13: note = chr8:24771562-24771575
  misc_feature 1..13: note = hyper
  source 1..13: mol_type = genomic DNA
gcggctccggacc

SEQ ID NO: 52598 - DNA, 41 bp, Homo sapiens; identical to SEQ ID NO: 31841
  misc_feature 1..41: note = chr8:24799514-24799555
  misc_feature 1..41: note = hyper
  source 1..41: mol_type = genomic DNA

SEQ ID NO: 52599 - DNA, 48 bp, Homo sapiens
  misc_feature 1..48: note = chr8:24813140-24813188
  misc_feature 1..48: note = hyper
  source 1..48: mol_type = genomic DNA
cgtcggtgttcttggcggcgctctcggtcagcacggtgaagcggctct

SEQ ID NO: 52600 - DNA, 177 bp, Homo sapiens; identical to SEQ ID NO: 19978
  misc_feature 1..177: note = chr8:24813287-24813464
  misc_feature 1..177: note = hyper
  source 1..177: mol_type = genomic DNA

SEQ ID NO: 52601 - DNA, 132 bp, Homo sapiens; identical to SEQ ID NO: 19979
  misc_feature 1..132: note = chr8:24813618-24813750
  misc_feature 1..132: note = hyper
  source 1..132: mol_type = genomic DNA

SEQ ID NO: 52602 - DNA, 21 bp, Homo sapiens
  misc_feature 1..21: note = chr8:24814407-24814428
  misc_feature 1..21: note = hyper
  source 1..21: mol_type = genomic DNA
agaccccgtgacacttggatc

SEQ ID NO: 52603 - DNA, 353 bp, Homo sapiens; identical to SEQ ID NO: 31845
  misc_feature 1..353: note = chr8:24815060-24815413
  misc_feature 1..353: note = hyper
  source 1..353: mol_type = genomic DNA

SEQ ID NO: 52604 - DNA, 16 bp, Homo sapiens
  misc_feature 1..16: note = chr8:24816379-24816395
  misc_feature 1..16: note = hyper
  source 1..16: mol_type = genomic DNA
gcggctcctccctgaa

SEQ ID NO: 52605 - DNA, 15 bp, Homo sapiens
  misc_feature 1..15: note = chr8:24816694-24816709
  misc_feature 1..15: note = hyper
  source 1..15: mol_type = genomic DNA
cgaatccagccgggg

SEQ ID NO: 52606 - DNA, 345 bp, Homo sapiens
  misc_feature 1..345: note = chr8:24857431-24857776
  misc_feature 1..345: note = hyper
  source 1..345: mol_type = genomic DNA
cgagaaacagctacacgtctccagggcctttcttctggaaaaacttttctggtcccctcttccctgaactggtgcaggcgtgcaaagaaagctccgtgccacgcccggcagcctccattctttggtagaacgcagcgcagcaatagccgccaagtcccctcctgggtacagtacagctccacagcgcccctgctggtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttaca

SEQ ID NO: 52607 - DNA, 232 bp, Homo sapiens; identical to SEQ ID NO: 19983
  misc_feature 1..232: note = chr8:24857808-24858040
  misc_feature 1..232: note = hyper
  source 1..232: mol_type = genomic DNA

SEQ ID NO: 52608 - DNA, 50 bp, Homo sapiens
  misc_feature 1..50: note = chr8:24858286-24858336
  misc_feature 1..50: note = hyper
  source 1..50: mol_type = genomic DNA
ctgctgagtcactcccgcctgagccacggccgcccccagccagccacgcg

SEQ ID NO: 52609 - DNA, 416 bp, Homo sapiens
  misc_feature 1..416: note = chr8:24858440-24858856
  misc_feature 1..416: note = hyper
  source 1..416: mol_type = genomic DNA
tggtaggaaccccctaaaaatgcgccccacttgtgcattcgtgcatgggcgcattttgggagtaaacaatacataaccttcttcgcattcaaagggtctggactcaaaagagggctcagccttgctcctcgggagcaacccctgttttaaatctgggaaatggtgatgccagtggggaaagggcttctccgggcccggggctcccgagctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcct

SEQ ID NO: 52610 - DNA, 335 bp, Homo sapiens
  misc_feature 1..335: note = chr8:24859161-24859496
  misc_feature 1..335: note = hyper
  source 1..335: mol_type = genomic DNA
gtggagaagccagttcccaagtggctcgtcgcgggtgttagagtccctcgttactaaggacgccgccgcccgcgcgccaggcttggggaccagggtgactctgccctttctgggcggaatacgggtgaaggctgtctttggggatccacaggtgatctgtgccgttctcattgtattctcaactctcatcccttccaggttagcccgatccctttaatgcaaggatcggtgccgggaggaaagagagcgtgggccactctggaacggaggctggtgttttgggggagcggggagagcctgtagcccacacatctccacggctctggcccaatttc

SEQ ID NO: 52611 - DNA, 57 bp, Homo sapiens
  misc_feature 1..57: note = chr8:25041864-25041921
  misc_feature 1..57: note = hyper
  source 1..57: mol_type = genomic DNA
gcccgcatccctcgcccaccggccgcccggcctgggcgtgcccggctcctccagcgc

SEQ ID NO: 52612 - DNA, 43 bp, Homo sapiens; identical to SEQ ID NO: 31851
  misc_feature 1..43: note = chr8:25042737-25042780
  misc_feature 1..43: note = hyper
  source 1..43: mol_type = genomic DNA

SEQ ID NO: 52613 - DNA, 100 bp, Homo sapiens; identical to SEQ ID NO: 31852
  misc_feature 1..100: note = chr8:25899320-25899420
  misc_feature 1..100: note = hyper
  source 1..100: mol_type = genomic DNA

SEQ ID NO: 52614 - DNA, 381 bp, Homo sapiens
  misc_feature 1..381: note = chr8:25901765-25902146
  misc_feature 1..381: note = hyper
  source 1..381: mol_type = genomic DNA
gccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacag

SEQ ID NO: 52615 - skipped

SEQ ID NO: 52616 - DNA, 50 bp, Homo sapiens; identical to SEQ ID NO: 31857
  misc_feature 1..50: note = chr8:25902919-25902969
  misc_feature 1..50: note = hyper
  source 1..50: mol_type = genomic DNA

SEQ ID NO: 52617 - DNA, 31 bp, Homo sapiens
  misc_feature 1..31: note = chr8:25903631-25903662
  misc_feature 1..31: note = hyper
  source 1..31: mol_type = genomic DNA
gccggggagtattcccgcgggtcctccggtt

SEQ ID NO: 52618 - DNA, 12 bp, Homo sapiens
  misc_feature 1..12: note = chr8:25903854-25903866
  misc_feature 1..12: note = hyper
  source 1..12: mol_type = genomic DNA
tgcctattaaac

SEQ ID NO: 52619 - DNA, 176 bp, Homo sapiens
  misc_feature 1..176: note = chr8:25904191-25904367
  misc_feature 1..176: note = hyper
  source 1..176: mol_type = genomic DNA
agagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcgggattgcgactaggaagtgct

SEQ ID NO: 52620 - DNA, 122 bp, Homo sapiens; identical to SEQ ID NO: 31860
  misc_feature 1..122: note = chr8:25904898-25905020
  misc_feature 1..122: note = hyper
  source 1..122: mol_type = genomic DNA

SEQ ID NO: 52621 - DNA, 378 bp, Homo sapiens; identical to SEQ ID NO: 31861
  misc_feature 1..378: note = chr8:25905251-25905629
  misc_feature 1..378: note = hyper
  source 1..378: mol_type = genomic DNA

SEQ ID NO: 52622 - DNA, 67 bp, Homo sapiens; identical to SEQ ID NO: 19989
  misc_feature 1..67: note = chr8:25905695-25905762
  misc_feature 1..67: note = hyper
  source 1..67: mol_type = genomic DNA

SEQ ID NO: 52623 - DNA, 14 bp, Homo sapiens
  misc_feature 1..14: note = chr8:25905811-25905825
  misc_feature 1..14: note = hyper
  source 1..14: mol_type = genomic DNA
ggccaactagctcg

SEQ ID NO: 52624 - DNA, 57 bp, Homo sapiens; identical to SEQ ID NO: 31863
  misc_feature 1..57: note = chr8:25907271-25907328
  misc_feature 1..57: note = hyper
  source 1..57: mol_type = genomic DNA

SEQ ID NO: 52625 - DNA, 10 bp, Homo sapiens
  misc_feature 1..10: note = chr8:25908415-25908425
  misc_feature 1..10: note = hyper
  source 1..10: mol_type = genomic DNA
gcaatcattt

SEQ ID NO: 52626 - skipped

SEQ ID NO: 52627 - DNA, 47 bp, Homo sapiens; identical to SEQ ID NO: 31866
  misc_feature 1..47: note = chr8:25909600-25909647
  misc_feature 1..47: note = hyper
  source 1..47: mol_type = genomic DNA

SEQ ID NO: 52628 - DNA, 36 bp, Homo sapiens; identical to SEQ ID NO: 31867
  misc_feature 1..36: note = chr8:26306055-26306091
  misc_feature 1..36: note = hyper
  source 1..36: mol_type = genomic DNA

SEQ ID NO: 52629 - DNA, 145 bp, Homo sapiens; identical to SEQ ID NO: 31868
  misc_feature 1..145: note = chr8:26370760-26370905
  misc_feature 1..145: note = hyper
  source 1..145: mol_type = genomic DNA

SEQ ID NO: 52630 - DNA, 102 bp, Homo sapiens
  misc_feature 1..102: note = chr8:26372761-26372863
  misc_feature 1..102: note = hyper
  source 1..102: mol_type = genomic DNA
cccttgactcctgctcgcagcgtgagaagagccaggaaggctgtggagtcacccgaggaaaccgagacgctcctaaatagcctatgtggggaacaaagttcc

SEQ ID NO: 52631 - DNA, 27 bp, Homo sapiens
  misc_feature 1..27: note = chr8:26372893-26372920
  misc_feature 1..27: note = hyper
  source 1..27: mol_type = genomic DNA
cgctccccaaaccgctatgtgggaggc

SEQ ID NO: 52632 - DNA, 74 bp, Homo sapiens; identical to SEQ ID NO: 31870
  misc_feature 1..74: note = chr8:26723005-26723079
  misc_feature 1..74: note = hyper
  source 1..74: mol_type = genomic DNA

SEQ ID NO: 52633 - DNA, 264 bp, Homo sapiens; identical to SEQ ID NO: 31871
  misc_feature 1..264: note = chr8:26723320-26723584
  misc_feature 1..264: note = hyper
  source 1..264: mol_type = genomic DNA

SEQ ID NO: 52634 - DNA, 400 bp, Homo sapiens
  misc_feature 1..400: note = chr8:26723585-26723985
  misc_feature 1..400: note = hyper
  source 1..400: mol_type = genomic DNA
ttagaacaggttgcctcgcagtcacctggagggggcggcctgggagagggaacagctgcgacccagggacctcagggccaggaccacgagcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcg

SEQ ID NO: 52635 - DNA, 360 bp, Homo sapiens
  misc_feature 1..360: note = chr8:26724080-26724440
  misc_feature 1..360: note = hyper
  source 1..360: mol_type = genomic DNA
ggacagcgcggcgtgaggaagtgcccaccttgccttctggggttgggccctgaggtgggacctcgggcaaagactcttgttaaaatcgcaagttggagacctcacaggtggtattaaaaacgtgccactgcagaaacccttttcctcctacctcgagggtgataaacacagggttaaaaagacacttgttcagtagaaggcaacttcgcagaagatgtaagggaatcgggggtggggtagaggggccggtataaaacctggtggaaaaagcgggaggcgctgggaaaagtgggggttccgtctcaccagacggcgggggaggtctgccctcacccactcggccctgcgggacgccggccc

SEQ ID NO: 52636 - DNA, 169 bp, Homo sapiens; identical to SEQ ID NO: 31873
  misc_feature 1..169: note = chr8:26724484-26724653
  misc_feature 1..169: note = hyper
  source 1..169: mol_type = genomic DNA

SEQ ID NO: 52637 - DNA, 77 bp, Homo sapiens; identical to SEQ ID NO: 31874
  misc_feature 1..77: note = chr8:29209803-29209880
  misc_feature 1..77: note = hyper
  source 1..77: mol_type = genomic DNA

SEQ ID NO: 52638 - DNA, 33 bp, Homo sapiens; identical to SEQ ID NO: 31875
  misc_feature 1..33: note = chr8:29387334-29387367
  misc_feature 1..33: note = hyper
  source 1..33: mol_type = genomic DNA

SEQ ID NO: 52639 - DNA, 30 bp, Homo sapiens; identical to SEQ ID NO: 31876
  misc_feature 1..30: note = chr8:29387658-29387688
  misc_feature 1..30: note = hyper
  source 1..30: mol_type = genomic DNA

SEQ ID NO: 52640 - DNA, 81 bp, Homo sapiens
  misc_feature 1..81: note = chr8:30769168-30769249
  misc_feature 1..81: note = hyper
  source 1..81: mol_type = genomic DNA
aaacttgaagggaaccgtggtatcttcaaagtctccgagttgccagcgacctcagcctctccactttctcgaacatcatcc

SEQ ID NO: 52641 - DNA, 329 bp, Homo sapiens
  misc_feature 1..329: note = chr8:30769411-30769740
  misc_feature 1..329: note = hyper
  source 1..329: mol_type = genomic DNA
agtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcagggg

SEQ ID NO: 52642 - DNA, 59 bp, Homo sapiens; identical to SEQ ID NO: 31879
  misc_feature 1..59: note = chr8:30769987-30770046
  misc_feature 1..59: note = hyper
  source 1..59: mol_type = genomic DNA

SEQ ID NO: 52643 - DNA, 129 bp, Homo sapiens; identical to SEQ ID NO: 31880
  misc_feature 1..129: note = chr8:30890252-30890381
  misc_feature 1..129: note = hyper
  source 1..129: mol_type = genomic DNA

SEQ ID NO: 52644 - DNA, 48 bp, Homo sapiens
  misc_feature 1..48: note = chr8:31496433-31496481
  misc_feature 1..48: note = hyper
  source 1..48: mol_type = genomic DNA
cagtaaaagaaaaggcgggggtcatgaagaccgaaggatcaaaggagc

SEQ ID NO: 52645 - DNA, 87 bp, Homo sapiens
  misc_feature 1..87: note = chr8:31496757-31496844
  misc_feature 1..87: note = hyper
  source 1..87: mol_type = genomic DNA
cccagtaagcctccgcagcccactcggactgcagcctgtttgccgcccgtcctcccattgcagcactcggggcgacagagagggagg

SEQ ID NO: 52646 - DNA, 51 bp, Homo sapiens
  misc_feature 1..51: note = chr8:31497448-31497499
  misc_feature 1..51: note = hyper
  source 1..51: mol_type = genomic DNA
gagccgggcagagtccgaaccgacagccagaagcccgcacgcacctcgcac

SEQ ID NO: 52647 - DNA, 322 bp, Homo sapiens
  misc_feature 1..322: note = chr8:31497639-31497961
  misc_feature 1..322: note = hyper
  source 1..322: mol_type = genomic DNA
gggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 52648 - DNA, 158 bp, Homo sapiens; identical to SEQ ID NO: 31883
  misc_feature 1..158: note = chr8:32404798-32404956
  misc_feature 1..158: note = hyper
  source 1..158: mol_type = genomic DNA

SEQ ID NO: 52649 - DNA, 60 bp, Homo sapiens; identical to SEQ ID NO: 31884
  misc_feature 1..60: note = chr8:32405453-32405513
  misc_feature 1..60: note = hyper
  source 1..60: mol_type = genomic DNA

SEQ ID NO: 52650 - DNA, 30 bp, Homo sapiens; identical to SEQ ID NO: 31885
  misc_feature 1..30: note = chr8:32405729-32405759
  misc_feature 1..30: note = hyper
  source 1..30: mol_type = genomic DNA

SEQ ID NO: 52651 - DNA, 217 bp, Homo sapiens; identical to SEQ ID NO: 31886
  misc_feature 1..217: note = chr8:32406020-32406237
  misc_feature 1..217: note = hyper
  source 1..217: mol_type = genomic DNA

SEQ ID NO: 52652 - DNA, 89 bp, Homo sapiens
  misc_feature 1..89: note = chr8:32406509-32406598
  misc_feature 1..89: note = hyper
  source 1..89: mol_type = genomic DNA
cgccgctcacctgggcgccgagtcctaccgggcgcctacgcccagagctcagggcaagggacagcagtcccggccgcaccctcccagag

SEQ ID NO: 52653 - DNA, 14 bp, Homo sapiens
  misc_feature 1..14: note = chr8:32406914-32406928
  misc_feature 1..14: note = hyper
  source 1..14: mol_type = genomic DNA
cagtcctgtgctac

SEQ ID NO: 52654 - DNA, 53 bp, Homo sapiens; identical to SEQ ID NO: 9466
  misc_feature 1..53: note = chr8:32406929-32406982
  misc_feature 1..53: note = hyper
  source 1..53: mol_type = genomic DNA

SEQ ID NO: 52655 - DNA, 213 bp, Homo sapiens; identical to SEQ ID NO: 31889
  misc_feature 1..213: note = chr8:33371806-33372019
  misc_feature 1..213: note = hyper
  source 1..213: mol_type = genomic DNA

SEQ ID NO: 52656 - DNA, 35 bp, Homo sapiens
  misc_feature 1..35: note = chr8:33457107-33457142
  misc_feature 1..35: note = hyper
  source 1..35: mol_type = genomic DNA
tcgcccctagctgggcgcctctccccagcgtggag

SEQ ID NO: 52657 - DNA, 30 bp, Homo sapiens; identical to SEQ ID NO: 31891
  misc_feature 1..30: note = chr8:35092643-35092673
  misc_feature 1..30: note = hyper
  source 1..30: mol_type = genomic DNA

SEQ ID NO: 52658 - DNA, 106 bp, Homo sapiens
  misc_feature 1..106: note = chr8:35093054-35093160
  misc_feature 1..106: note = hyper
  source 1..106: mol_type = genomic DNA
actccggcatccgcgctggcggcagcggtcgccgcgccgtgggaagctatggggacgcgccctttctcggggtgcccattcagcggcggctcggagctccctgccc

SEQ ID NO: 52659 - DNA, 79 bp, Homo sapiens; identical to SEQ ID NO: 31893
  misc_feature 1..79: note = chr8:35093225-35093304
  misc_feature 1..79: note = hyper
  source 1..79: mol_type = genomic DNA

SEQ ID NO: 52660 - DNA, 278 bp, Homo sapiens; identical to SEQ ID NO: 31895
  misc_feature 1..278: note = chr8:37552317-37552595
  misc_feature 1..278: note = hyper
  source 1..278: mol_type = genomic DNA

SEQ ID NO: 52661 - DNA, 63 bp, Homo sapiens; identical to SEQ ID NO: 31896
  misc_feature 1..63: note = chr8:37655313-37655376
  misc_feature 1..63: note = hyper
  source 1..63: mol_type = genomic DNA

SEQ ID NO: 52662 - DNA, 293 bp, Homo sapiens
  misc_feature 1..293: note = chr8:37655517-37655810
  misc_feature 1..293: note = hyper
  source 1..293: mol_type = genomic DNA
ggccttgtcccttcaattggggtcatcccatccttgccccctggcctgccagcgccgcttccagccggtctccttagggcaaggggaggctgggctcagaaaagtcggcccttggaataccggcgctcctgggctgcaggagaccctggcgtccccatccctctagaggcccctctcccacggcgccgtttgtgcagtgagctctgtgctgggtcccgcgtccttgcctctcctttgcctctcctggaagtaactcgagctttggctgtttctccattgacttcgcgcaaaga

SEQ ID NO: 52663 - DNA, 133 bp, Homo sapiens
  misc_feature 1..133: note = chr8:37656081-37656214
  misc_feature 1..133: note = hyper
  source 1..133: mol_type = genomic DNA
cgggcccccgcggccgccgcttcctttcctgtcccaaatccagcctaagagccgcttccctttccctgtcctcctgaccccagtggcaaccgtttctccaccgccccttgcccgcagtcggggctggcccagt

SEQ ID NO: 52664 - DNA, 79 bp, Homo sapiens
  misc_feature 1..79: note = chr8:37822717-37822796
  misc_feature 1..79: note = hyper
  source 1..79: mol_type = genomic DNA
gacccacggacacatcgcatgcttcccgaccctgagccgccggtccctctgccccggttacctacccgtcgagccgttg

SEQ ID NO: 52665 - DNA, 52 bp, Homo sapiens
  misc_feature 1..52: note = chr8:37823423-37823475
  misc_feature 1..52: note = hyper
  source 1..52: mol_type = genomic DNA
gcgctgcgcctcggcgtcggcccctacgcgccaccactggctcatgatgggc

SEQ ID NO: 52666 - DNA, 56 bp, Homo sapiens; identical to SEQ ID NO: 31901
  misc_feature 1..56: note = chr8:37823476-37823532
  misc_feature 1..56: note = hyper
  source 1..56: mol_type = genomic DNA

SEQ ID NO: 52667 - DNA, 25 bp, Homo sapiens
  misc_feature 1..25: note = chr8:38008209-38008234
  misc_feature 1..25: note = hyper
  source 1..25: mol_type = genomic DNA
ggcctgagcctcatccgctgagagc

SEQ ID NO: 52668 - DNA, 41 bp, Homo sapiens; identical to SEQ ID NO: 20009
  misc_feature 1..41: note = chr8:38008557-38008598
  misc_feature 1..41: note = hyper
  source 1..41: mol_type = genomic DNA

SEQ ID NO: 52669 - DNA, 328 bp, Homo sapiens; identical to SEQ ID NO: 31903
  misc_feature 1..328: note = chr8:38323407-38323735
  misc_feature 1..328: note = hyper
  source 1..328: mol_type = genomic DNA

SEQ ID NO: 52670 - DNA, 156 bp, Homo sapiens
  misc_feature 1..156: note = chr8:38323755-38323911
  misc_feature 1..156: note = hyper
  source 1..156: mol_type = genomic DNA
cgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaagg

SEQ ID NO: 52671 - DNA, 214 bp, Homo sapiens; identical to SEQ ID NO: 20012
  misc_feature 1..214: note = chr8:38323941-38324155
  misc_feature 1..214: note = hyper
  source 1..214: mol_type = genomic DNA

SEQ ID NO: 52672 - DNA, 61 bp, Homo sapiens; identical to SEQ ID NO: 31905
  misc_feature 1..61: note = chr8:38324661-38324722
  misc_feature 1..61: note = hyper
  source 1..61: mol_type = genomic DNA

SEQ ID NO: 52673 - DNA, 279 bp, Homo sapiens; identical to SEQ ID NO: 31906
  misc_feature 1..279: note = chr8:38325771-38326050
  misc_feature 1..279: note = hyper
  source 1..279: mol_type = genomic DNA

SEQ ID NO: 52674 - DNA, 33 bp, Homo sapiens; identical to SEQ ID NO: 31907
  misc_feature 1..33: note = chr8:38326276-38326309
  misc_feature 1..33: note = hyper
  source 1..33: mol_type = genomic DNA

SEQ ID NO: 52675 - DNA, 45 bp, Homo sapiens; identical to SEQ ID NO: 31908
  misc_feature 1..45: note = chr8:38614816-38614861
  misc_feature 1..45: note = hyper
  source 1..45: mol_type = genomic DNA

SEQ ID NO: 52676 - DNA, 229 bp, Homo sapiens; identical to SEQ ID NO: 20013
  misc_feature 1..229: note = chr8:41166745-41166974
  misc_feature 1..229: note = hyper
  source 1..229: mol_type = genomic DNA

SEQ ID NO: 52677 - DNA, 322 bp, Homo sapiens
  misc_feature 1..322: note = chr8:41167035-41167357
  misc_feature 1..322: note = hyper
  source 1..322: mol_type = genomic DNA
atcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgaga

SEQ ID NO: 52678 - DNA, 91 bp, Homo sapiens
  misc_feature 1..91: note = chr8:41424669-41424760
  misc_feature 1..91: note = hyper
  source 1..91: mol_type = genomic DNA
ctacctctgctgcagcgtacctcttccgcagccctagcggcctccccgaggggcgccgcggcctcggctgtccctcccctgcctggcacga

SEQ ID NO: 52679 - DNA, 24 bp, Homo sapiens
  misc_feature 1..24: note = chr8:41424842-41424866
  misc_feature 1..24: note = hyper
  source 1..24: mol_type = genomic DNA
aagccactgcgggcacagcctgaa

SEQ ID NO: 52680 - DNA, 467 bp, Homo sapiens; identical to SEQ ID NO: 31915
  misc_feature 1..467: note = chr8:41503858-41504325
  misc_feature 1..467: note = hyper
  source 1..467: mol_type = genomic DNA

SEQ ID NO: 52681 - DNA, 55 bp, Homo sapiens; identical to SEQ ID NO: 31916
  misc_feature 1..55: note = chr8:41511052-41511107
  misc_feature 1..55: note = hyper
  source 1..55: mol_type = genomic DNA

SEQ ID NO: 52682 - DNA, 84 bp, Homo sapiens; identical to SEQ ID NO: 31917
  misc_feature 1..84: note = chr8:41511147-41511231
  misc_feature 1..84: note = hyper
  source 1..84: mol_type = genomic DNA

SEQ ID NO: 52683 - DNA, 63 bp, Homo sapiens; identical to SEQ ID NO: 31918
  misc_feature 1..63: note = chr8:41511489-41511552
  misc_feature 1..63: note = hyper
  source 1..63: mol_type = genomic DNA

SEQ ID NO: 52684 - DNA, 15 bp, Homo sapiens
  misc_feature 1..15: note = chr8:41624546-41624561
  misc_feature 1..15: note = hyper
  source 1..15: mol_type = genomic DNA
gcggctccacgctcc

SEQ ID NO: 52685 - DNA, 193 bp, Homo sapiens
  misc_feature 1..193: note = chr8:41624633-41624826
  misc_feature 1..193: note = hyper
  source 1..193: mol_type = genomic DNA
cgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccc

SEQ ID NO: 52686 - DNA, 229 bp, Homo sapiens
  misc_feature 1..229: note = chr8:41624855-41625084
  misc_feature 1..229: note = hyper
  source 1..229: mol_type = genomic DNA
tcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctc

SEQ ID NO: 52687 - DNA, 30 bp, Homo sapiens; identical to SEQ ID NO: 31921
  misc_feature 1..30: note = chr8:41625311-41625341
  misc_feature 1..30: note = hyper
  source 1..30: mol_type = genomic DNA

SEQ ID NO: 52688 - DNA, 30 bp, Homo sapiens; identical to SEQ ID NO: 31922
  misc_feature 1..30: note = chr8:41655464-41655494
  misc_feature 1..30: note = hyper
  source 1..30: mol_type = genomic DNA

SEQ ID NO: 52689 - DNA, 144 bp, Homo sapiens; identical to SEQ ID NO: 9488
  misc_feature 1..144: note = chr8:41686308-41686452
  misc_feature 1..144: note = hyper
  source 1..144: mol_type = genomic DNA

SEQ ID NO: 52690 - DNA, 90 bp, Homo sapiens
  misc_feature 1..90: note = chr8:41733415-41733505
  misc_feature 1..90: note = hyper
  source 1..90: mol_type = genomic DNA
ttgccttcatttctccggctgcatccgaggctccccagaggggccggcgcgcgcccgggcgcacactcgcacacctgcccgcgcgcacac

SEQ ID NO: 52691 - DNA, 14 bp, Homo sapiens
  misc_feature 1..14: note = chr8:41733640-41733654
  misc_feature 1..14: note = hyper
  source 1..14: mol_type = genomic DNA
agagctcggagcgg

SEQ ID NO: 52692 - DNA, 92 bp, Homo sapiens; identical to SEQ ID NO: 9490
  misc_feature 1..92: note = chr8:41733684-41733776
  misc_feature 1..92: note = hyper
  source 1..92: mol_type = genomic DNA

SEQ ID NO: 52693 - DNA, 268 bp, Homo sapiens; identical to SEQ ID NO: 20023
  misc_feature 1..268: note = chr8:41753325-41753593
  misc_feature 1..268: note = hyper
  source 1..268: mol_type = genomic DNA

SEQ ID NO: 52694 - DNA, 382 bp, Homo sapiens; identical to SEQ ID NO: 20024
  misc_feature 1..382: note = chr8:41753770-41754152
  misc_feature 1..382: note = hyper
  source 1..382: mol_type = genomic DNA

SEQ ID NO: 52695 - DNA, 293 bp, Homo sapiens; identical to SEQ ID NO: 20025
  misc_feature 1..293: note = chr8:41754885-41755178
  misc_feature 1..293: note = hyper
  source 1..293: mol_type = genomic DNA

SEQ ID NO: 52696 - DNA, 30 bp, Homo sapiens; identical to SEQ ID NO: 31929
  misc_feature 1..30: note = chr8:41755524-41755554
  misc_feature 1..30: note = hyper
  source 1..30: mol_type = genomic DNA

SEQ ID NO: 52697 - DNA, 129 bp, Homo sapiens; identical to SEQ ID NO: 31930
  misc_feature 1..129: note = chr8:42009878-42010007
  misc_feature 1..129: note = hyper
  source 1..129: mol_type = genomic DNA

SEQ ID NO: 52698 - DNA, 88 bp, Homo sapiens; identical to SEQ ID NO: 31931
  misc_feature 1..88: note = chr8:43102486-43102574
  misc_feature 1..88: note = hyper
  source 1..88: mol_type = genomic DNA

SEQ ID NO: 52699 - DNA, 254 bp, Homo sapiens
  misc_feature 1..254: note = chr8:48100443-48100697
  misc_feature 1..254: note = hyper
  source 1..254: mol_type = genomic DNA
ccagaagcctccatctcccgggagccgccatcgctgggagccgccacctccaggagccgccacggccaccgggagccgtcaccgcagggaacctccatctcctggagccaccaccgctgggagctgccacctcaggagcagcggcagcactgggacccgccgggccccctcgcacccagcggctctgcaggtgccctacacccgggaggggccgagggagcccacgccgccggcgggaccgcagggatttgctg

SEQ ID NO: 52700 - DNA, 498 bp, Homo sapiens
  misc_feature 1..498: note = chr8:49292866-49293364
  misc_feature 1..498: note = hyper
  source 1..498: mol_type = genomic DNA
aaaggttgacaagagcggggctgggctccggcatgggcgcaaaaacaccagtgcggaggagttctcgggaccccccggggctgcggggccttgcggggacagccccaggcccggagctgcagaaacacccagaccccgcgcctcccggaaccacgcgtctctgtgcacagacattcctgggggcaggctcctgtcctttaacacagtctcaaaggagtcttcaaaaacaaaaagtttacaagcactgatagggaaaacagaaggatgataacaccaagagggactttcccgggagaggacggcttccagggactgagaaaggatgggcaagtgggcggggcccggcgccgtgcgggcagggctggcgccgggagtccccagactcccccgcagtgggaagcacctctcccattcacgccgggcaggacacctggccgggcgggggaggcagcgcaagggccggccggggagtacgggactcgagccggggacctgagg

SEQ ID NO: 52701 - skipped

SEQ ID NO: 52702 - DNA, 99 bp, Homo sapiens; identical to SEQ ID NO: 31935
  misc_feature 1..99: note = chr8:49309361-49309460
  misc_feature 1..99: note = hyper
  source 1..99: mol_type = genomic DNA

SEQ ID NO: 52703 - skipped

SEQ ID NO: 52704 - DNA, 64 bp, Homo sapiens; identical to SEQ ID NO: 20030
  misc_feature 1..64: note = chr8:49469127-49469191
  misc_feature 1..64: note = hyper
  source 1..64: mol_type = genomic DNA

SEQ ID NO: 52705 - DNA, 36 bp, Homo sapiens; identical to SEQ ID NO: 31938
  misc_feature 1..36: note = chr8:49647817-49647853
  misc_feature 1..36: note = hyper
  source 1..36: mol_type = genomic DNA

SEQ ID NO: 52706 - DNA, 189 bp, Homo sapiens; identical to SEQ ID NO: 9502
  misc_feature 1..189: note = chr8:49782697-49782886
  misc_feature 1..189: note = hyper
  source 1..189: mol_type = genomic DNA

SEQ ID NO: 52707 - DNA, 119 bp, Homo sapiens
  misc_feature 1..119: note = chr8:49782922-49783041
  misc_feature 1..119: note = hyper
  source 1..119: mol_type = genomic DNA
cgacgggcatcctgccctgcggaacacccacccgagccctgcgcgggaggggcggccgggaggcgcgcgggcatgcggaggggaaacagggctgcagcttcaagcccaggcaggacgcc

SEQ ID NO: 52708 - DNA, 185 bp, Homo sapiens; identical to SEQ ID NO: 31941
  misc_feature 1..185: note = chr8:49833801-49833986
  misc_feature 1..185: note = hyper
  source 1..185: mol_type = genomic DNA

SEQ ID NO: 52709 - DNA, 49 bp, Homo sapiens; identical to SEQ ID NO: 31942
  misc_feature 1..49: note = chr8:49834319-49834368
  misc_feature 1..49: note = hyper
  source 1..49: mol_type = genomic DNA

SEQ ID NO: 52710 - DNA, 88 bp, Homo sapiens; identical to SEQ ID NO: 31943
  misc_feature 1..88: note = chr8:49834627-49834715
  misc_feature 1..88: note = hyper
  source 1..88: mol_type = genomic DNA

SEQ ID NO: 52711 - DNA, 113 bp, Homo sapiens
  misc_feature 1..113: note = chr8:50822066-50822179
  misc_feature 1..113: note = hyper
  source 1..113: mol_type = genomic DNA
cataaccttaagcaacgttttcacatggactgaaaagcaaaagacccccttaaaaattagcctcaagcagcagatactctctttttaggtttgtgtgtctccgtgaggtcaga

SEQ ID NO: 52712 - DNA, 39 bp, Homo sapiens
  misc_feature 1..39: note = chr8:50822308-50822347
  misc_feature 1..39: note = hyper
  source 1..39: mol_type = genomic DNA
acagcgaccgcggcctgcaatgtgcggagcacagcgcgg

SEQ ID NO: 52713 - DNA, 30 bp, Homo sapiens; identical to SEQ ID NO: 9506
  misc_feature 1..30: note = chr8:50822561-50822591
  misc_feature 1..30: note = hyper
  source 1..30: mol_type = genomic DNA

SEQ ID NO: 52714 - DNA, 323 bp, Homo sapiens; identical to SEQ ID NO: 31946
  misc_feature 1..323: note = chr8:50822821-50823144
  misc_feature 1..323: note = hyper
  source 1..323: mol_type = genomic DNA

SEQ ID NO: 52715 - DNA, 91 bp, Homo sapiens
  misc_feature 1..91: note = chr8:50823361-50823452
  misc_feature 1..91: note = hyper
  source 1..91: mol_type = genomic DNA
aaaggcagagattgtcgagccctctgactgtctttgtgccttctttatcccgtcctttgtgaaataagccgttttctgcccccactgcagg

SEQ ID NO: 52716 - DNA, 174 bp, Homo sapiens; identical to SEQ ID NO: 31948
  misc_feature 1..174: note = chr8:50824134-50824308
  misc_feature 1..174: note = hyper
  source 1..174: mol_type = genomic DNA

SEQ ID NO: 52717 - DNA, 20 bp, Homo sapiens
  misc_feature 1..20: note = chr8:50824352-50824372
  misc_feature 1..20: note = hyper
  source 1..20: mol_type = genomic DNA
cgccacgggcagctgggcta

SEQ ID NO: 52718 - DNA, 49 bp, Homo sapiens; identical to SEQ ID NO: 9511
  misc_feature 1..49: note = chr8:53477121-53477170
  misc_feature 1..49: note = hyper
  source 1..49: mol_type = genomic DNA

SEQ ID NO: 52719 - DNA, 64 bp, Homo sapiens
  misc_feature 1..64: note = chr8:53477944-53478008
  misc_feature 1..64: note = hyper
  source 1..64: mol_type = genomic DNA
cgcgcctgcccttgtctacgtcccgggggtcggctggagctgcactgggactcggtcctcagtg

SEQ ID NO: 52720 - skipped

SEQ ID NO: 52721 - DNA, 25 bp, Homo sapiens
  misc_feature 1..25: note = chr8:53478455-53478480
  misc_feature 1..25: note = hyper
  source 1..25: mol_type = genomic DNA
ctctgctgccgagcccctgctcgct

SEQ ID NO: 52722 - DNA, 48 bp, Homo sapiens; identical to SEQ ID NO: 31955
  misc_feature 1..48: note = chr8:53852136-53852184
  misc_feature 1..48: note = hyper
  source 1..48: mol_type = genomic DNA

SEQ ID NO: 52723 - DNA, 67 bp, Homo sapiens
  misc_feature 1..67: note = chr8:53853744-53853811
  misc_feature 1..67: note = hyper
  source 1..67: mol_type = genomic DNA
ggtattgctgggaaccgccccctccctgccctgctccctgctgccccacccgagccctggcagtctg

SEQ ID NO: 52724 - DNA, 30 bp, Homo sapiens; identical to SEQ ID NO: 31960
  misc_feature 1..30: note = chr8:54164557-54164587
  misc_feature 1..30: note = hyper
  source 1..30: mol_type = genomic DNA

SEQ ID NO: 52725 - DNA, 39 bp, Homo sapiens; identical to SEQ ID NO: 31961
  misc_feature 1..39: note = chr8:54570523-54570562
  misc_feature 1..39: note = hyper
  source 1..39: mol_type = genomic DNA

SEQ ID NO: 52726 - DNA, 179 bp, Homo sapiens
  misc_feature 1..179: note = chr8:54789099-54789278
  misc_feature 1..179: note = hyper
  source 1..179: mol_type = genomic DNA
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgg

SEQ ID NO: 52727 - DNA, 66 bp, Homo sapiens
  misc_feature 1..66: note = chr8:54789566-54789632
  misc_feature 1..66: note = hyper
  source 1..66: mol_type = genomic DNA
ggagaaaggaggttacgagttcgcacgttctcacaaaaccatttgaaaacatgagctggagacgcc

SEQ ID NO: 52728 - DNA, 214 bp, Homo sapiens; identical to SEQ ID NO: 20044
  misc_feature 1..214: note = chr8:54790077-54790291
  misc_feature 1..214: note = hyper
  source 1..214: mol_type = genomic DNA

SEQ ID NO: 52729 - DNA, 15 bp, Homo sapiens
  misc_feature 1..15: note = chr8:54791767-54791782
  misc_feature 1..15: note = hyper
  source 1..15: mol_type = genomic DNA
ggacaccacagtaac

SEQ ID NO: 52730 - DNA, 397 bp, Homo sapiens; identical to SEQ ID NO: 20045
  misc_feature 1..397: note = chr8:54792237-54792634
  misc_feature 1..397: note = hyper
  source 1..397: mol_type = genomic DNA

SEQ ID NO: 52731 - DNA, 368 bp, Homo sapiens; identical to SEQ ID NO: 20046
  misc_feature 1..368: note = chr8:54792760-54793128
  misc_feature 1..368: note = hyper
  source 1..368: mol_type = genomic DNA

SEQ ID NO: 52732 - DNA, 868 bp, Homo sapiens
  misc_feature 1..868: note = chr8:54793349-54794217
  misc_feature 1..868: note = hyper
  source 1..868: mol_type = genomic DNA
ggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcg

SEQ ID NO: 52733 - DNA, 386 bp, Homo sapiens
  misc_feature 1..386: note = chr8:54794327-54794713
  misc_feature 1..386: note = hyper
  source 1..386: mol_type = genomic DNA
agttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgtt

SEQ ID NO: 52734 - DNA, 52 bp, Homo sapiens
  misc_feature 1..52: note = chr8:55366136-55366188
  misc_feature 1..52: note = hyper
  source 1..52: mol_type = genomic DNA
ctaagaaacactccacggatgagtttctgaagagggaagtggaccgggaaca

SEQ ID NO: 52735 - DNA, 175 bp, Homo sapiens
  misc_feature 1..175: note = chr8:55370858-55371033
  misc_feature 1..175: note = hyper
  source 1..175: mol_type = genomic DNA
caccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggc

SEQ ID NO: 52736 - skipped

SEQ ID NO: 52737 - DNA, 29 bp, Homo sapiens
  misc_feature 1..29: note = chr8:55379202-55379231
  misc_feature 1..29: note = hyper
  source 1..29: mol_type = genomic DNA
ctcttagcttggtgccggggcccgcccgg

SEQ ID NO: 52738 - DNA, 108 bp, Homo sapiens; identical to SEQ ID NO: 3262
  misc_feature 1..108: note = chr8:55380036-55380144
  misc_feature 1..108: note = hyper
  source 1..108: mol_type = genomic DNA

SEQ ID NO: 52739 - DNA, 24 bp, Homo sapiens
  misc_feature 1..24: note = chr8:55380175-55380199
  misc_feature 1..24: note = hyper
  source 1..24: mol_type = genomic DNA
cgtgtttagcgattctcatattta

SEQ ID NO: 52740 - DNA, 30 bp, Homo sapiens
  misc_feature 1..30: note = chr8:56014127-56014157
  misc_feature 1..30: note = hyper
  source 1..30: mol_type = genomic DNA
gcctccgagcccgggcgcccgagttacacc

SEQ ID NO: 52741 - DNA, 247 bp, Homo sapiens; identical to SEQ ID NO: 20057
  misc_feature 1..247: note = chr8:56014376-56014623
  misc_feature 1..247: note = hyper
  source 1..247: mol_type = genomic DNA

SEQ ID NO: 52742 - skipped

SEQ ID NO: 52743 - DNA, 43 bp, Homo sapiens
  misc_feature 1..43: note = chr8:56015619-56015662
  misc_feature 1..43: note = hyper
  source 1..43: mol_type = genomic DNA
attgcaagacggtggtcggcggtgggtctgcagccggggaagg

SEQ ID NO: 52744 - DNA, 50 bp, Homo sapiens; identical to SEQ ID NO: 31994
  misc_feature 1..50: note = chr8:56015749-56015799
  misc_feature 1..50: note = hyper
  source 1..50: mol_type = genomic DNA

SEQ ID NO: 52745 - DNA, 30 bp, Homo sapiens; identical to SEQ ID NO: 31995
  misc_feature 1..30: note = chr8:56792024-56792054
  misc_feature 1..30: note = hyper
  source 1..30: mol_type = genomic DNA

SEQ ID NO: 52746 - DNA, 22 bp, Homo sapiens
  misc_feature 1..22: note = chr8:57025598-57025620
  misc_feature 1..22: note = hyper
  source 1..22: mol_type = genomic DNA
ccccaaggcgctgcccggggag

SEQ ID NO: 52747 - DNA, 225 bp, Homo sapiens
  misc_feature 1..225: note = chr8:57025943-57026168
  misc_feature 1..225: note = hyper
  source 1..225: mol_type = genomic DNA
agtgcacaatgctttgcgagtggaggaagagcaggccgttcacaacatctagtgagtacttgagacactttcccaaacttaactgtcctccagtgcggcagtgaggctcccctgcgtccccctcagggtggccggcggcgccatagatgacttggtgtaaagtgacgttgccaccgaactccatgatgatggtccctaggctattggaccctgcgggcgtgcgcg

SEQ ID NO: 52748 - DNA, 109 bp, Homo sapiens; identical to SEQ ID NO: 20061
  misc_feature 1..109: note = chr8:57026213-57026322
  misc_feature 1..109: note = hyper
  source 1..109: mol_type = genomic DNA

SEQ ID NO: 52749-52750 - skipped (2 entries)

SEQ ID NO: 52751 - DNA, 275 bp, Homo sapiens; identical to SEQ ID NO: 32002
  misc_feature 1..275: note = chr8:57232591-57232866
  misc_feature 1..275: note = hyper
  source 1..275: mol_type = genomic DNA

SEQ ID NO: 52752 - DNA, 70 bp, Homo sapiens; identical to SEQ ID NO: 32003
  misc_feature 1..70: note = chr8:57358077-57358147
  misc_feature 1..70: note = hyper
  source 1..70: mol_type = genomic DNA

SEQ ID NO: 52753 - DNA, 31 bp, Homo sapiens
  misc_feature 1..31: note = chr8:57359636-57359667
  misc_feature 1..31: note = hyper
  source 1..31: mol_type = genomic DNA
ccccctcgcgggtccccgtgggcaccaagca

SEQ ID NO: 52754 - DNA, 30 bp, Homo sapiens; identical to SEQ ID NO: 20066
  misc_feature 1..30: note = chr8:57360540-57360570
  misc_feature 1..30: note = hyper
  source 1..30: mol_type = genomic DNA

SEQ ID NO: 52755 - DNA, 15 bp, Homo sapiens
  misc_feature 1..15: note = chr8:57360791-57360806
  misc_feature 1..15: note = hyper
  source 1..15: mol_type = genomic DNA
cggggcatcacggta

SEQ ID NO: 52756 - DNA, 270 bp, Homo sapiens; identical to SEQ ID NO: 32009
  misc_feature 1..270: note = chr8:58907149-58907419
  misc_feature 1..270: note = hyper
  source 1..270: mol_type = genomic DNA

SEQ ID NO: 52757 - DNA, 215 bp, Homo sapiens; identical to SEQ ID NO: 20069
  misc_feature 1..215: note = chr8:58907483-58907698
  misc_feature 1..215: note = hyper
  source 1..215: mol_type = genomic DNA

SEQ ID NO: 52758 - DNA, 106 bp, Homo sapiens; identical to SEQ ID NO: 20070
  misc_feature 1..106: note = chr8:58907835-58907941
  misc_feature 1..106: note = hyper
  source 1..106: mol_type = genomic DNA

SEQ ID NO: 52759 - DNA, 561 bp, Homo sapiens; identical to SEQ ID NO: 32012
  misc_feature 1..561: note = chr8:60030202-60030763
  misc_feature 1..561: note = hyper
  source 1..561: mol_type = genomic DNA

SEQ ID NO: 52760 - DNA, 144 bp, Homo sapiens; identical to SEQ ID NO: 32013
  misc_feature 1..144: note = chr8:60030764-60030908
  misc_feature 1..144: note = hyper
  source 1..144: mol_type = genomic DNA

SEQ ID NO: 52761 - DNA, 548 bp, Homo sapiens; identical to SEQ ID NO: 32014
  misc_feature 1..548: note = chr8:60031146-60031694
  misc_feature 1..548: note = hyper
  source 1..548: mol_type = genomic DNA

SEQ ID NO: 52762 - DNA, 125 bp, Homo sapiens; identical to SEQ ID NO: 32015
  misc_feature 1..125: note = chr8:60032140-60032265
  misc_feature 1..125: note = hyper
  source 1..125: mol_type = genomic DNA

SEQ ID NO: 52763 - DNA, 190 bp, Homo sapiens; identical to SEQ ID NO: 20077
  misc_feature 1..190: note = chr8:60032490-60032680
  misc_feature 1..190: note = hyper
  source 1..190: mol_type = genomic DNA

SEQ ID NO: 52764 - DNA, 21 bp, Homo sapiens
  misc_feature 1..21: note = chr8:60032738-60032759
  misc_feature 1..21: note = hyper
  source 1..21: mol_type = genomic DNA
ggtttgcgaaggctgaggctg

SEQ ID NO: 52765 - DNA, 512 bp, Homo sapiens; identical to SEQ ID NO: 32017
  misc_feature 1..512: note = chr8:61193203-61193715
  misc_feature 1..512: note = hyper
  source 1..512: mol_type = genomic DNA

SEQ ID NO: 52766 - DNA, 49 bp, Homo sapiens; identical to SEQ ID NO: 32018
  misc_feature 1..49: note = chr8:61193716-61193765
  misc_feature 1..49: note = hyper
  source 1..49: mol_type = genomic DNA

SEQ ID NO: 52767 - DNA, 44 bp, Homo sapiens; identical to SEQ ID NO: 32019
  misc_feature 1..44: note = chr8:61573279-61573323
  misc_feature 1..44: note = hyper
  source 1..44: mol_type = genomic DNA

SEQ ID NO: 52768 - DNA, 292 bp, Homo sapiens; identical to SEQ ID NO: 32020
  misc_feature 1..292: note = chr8:61822378-61822670
  misc_feature 1..292: note = hyper
  source 1..292: mol_type = genomic DNA

SEQ ID NO: 52769 - DNA, 208 bp, Homo sapiens
  misc_feature 1..208: note = chr8:62200776-62200984
  misc_feature 1..208: note = hyper
  source 1..208: mol_type = genomic DNA
ggcgtttcagcacttcggtatgtggacagctcccatctgcaatccctctgcactccatccctcccgcaccgcaccccgctccccgccgcctccgcggtccatcctcctcccggcgcccgctcagcctgcgcccccttacacatcagcacccccatctccaccatcaccgtcatcatagccaccatcaccagcgcggtaactatagtca

SEQ ID NO: 52770 - DNA, 793 bp, Homo sapiens; identical to SEQ ID NO: 32022
  misc_feature 1..793: note = chr8:63160462-63161255
  misc_feature 1..793: note = hyper
  source 1..793: mol_type = genomic DNA

SEQ ID NO: 52771 - DNA, 27 bp, Homo sapiens
  misc_feature 1..27: note = chr8:63161631-63161658
  misc_feature 1..27: note = hyper
  source 1..27: mol_type = genomic DNA
catgggctgctgcaccggacgctgctc

SEQ ID NO: 52772 - DNA, 89 bp, Homo sapiens
  misc_feature 1..89: note = chr8:63161800-63161889
  misc_feature 1..89: note = hyper
  source 1..89: mol_type = genomic DNA
ctccgcccgcctcccaccctccccaccgcctggctgggctcgcactgctctccagccgcgggcactcgccaggtcgcccctgccctgca

SEQ ID NO: 52773 - DNA, 51 bp, Homo sapiens; identical to SEQ ID NO: 32024
  misc_feature 1..51: note = chr8:63998517-63998568
  misc_feature 1..51: note = hyper
  source 1..51: mol_type = genomic DNA

SEQ ID NO: 52774 - DNA, 287 bp, Homo sapiens
  misc_feature 1..287: note = chr8:65281329-65281616
  misc_feature 1..287: note = hyper
  source 1..287: mol_type = genomic DNA
ggggcctctggtcagcgctgattaataagtgttttttgttgtgaagtgttgaataatagaggatggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttg

SEQ ID NO: 52775 - DNA, 17 bp, Homo sapiens
  misc_feature 1..17: note = chr8:65281760-65281777
  misc_feature 1..17: note = hyper
  source 1..17: mol_type = genomic DNA
aaggagagccccagaga

SEQ ID NO: 52776 - DNA, 147 bp, Homo sapiens
  misc_feature 1..147: note = chr8:65281837-65281984
  misc_feature 1..147: note = hyper
  source 1..147: mol_type = genomic DNA
tttagaggacgggagctgcctctagggagaaaggggaggggggaggggagaagaaaaaggaaagagcgcgtttcctcgccggggttaccggggtggcgcgggcttcgcggccgaggggctgccggcccggcccgcagctcctcgcgg

SEQ ID NO: 52777 - DNA, 312 bp, Homo sapiens
  misc_feature 1..312: note = chr8:65286370-65286682
  misc_feature 1..312: note = hyper
  source 1..312: mol_type = genomic DNA
cgtcgcgagcatgcttgagagccgccggctcagctccgggctgtaaggttggttcctggcaatggatggaaatcaggtcacagagatccctaagcttgccaggctctcagacacgcttgggagacagaatggaattggaaggagggatctgaagaggagggaggggatccgtgttcccccaccccgggcctagaatggagccccggccagccgcgggccgggccccttggttttcaggacttattcttgccggggttggctcgcacgccagcatcgcgccttcggtgcgtcttttatctccatctcaaatat

SEQ ID NO: 52778 - DNA, 210 bp, Homo sapiens
  misc_feature 1..210: note = chr8:65286753-65286963
  misc_feature 1..210: note = hyper
  source 1..210: mol_type = genomic DNA
aattgtggttctgagaaggtattttttggcctcttgaaaatgtgcaagaattccgcgggcccaggctttctttgtgtggcgggcagcgccaagcgctttgtgcttcacaaggagaaaatggcgagtcctattgtgtttaggccattttcttccggtactaggattttcccaagttcgaaatacttcttgagaaagtagccttctcgtgcc

SEQ ID NO: 52779 - DNA, 74 bp, Homo sapiens; identical to SEQ ID NO: 20086
  misc_feature 1..74: note = chr8:65289049-65289123
  misc_feature 1..74: note = hyper
  source 1..74: mol_type = genomic DNA

SEQ ID NO: 52780 - DNA, 112 bp, Homo sapiens; identical to SEQ ID NO: 20087
  misc_feature 1..112: note = chr8:65289241-65289353
  misc_feature 1..112: note = hyper
  source 1..112: mol_type = genomic DNA

SEQ ID NO: 52781 - DNA, 22 bp, Homo sapiens
  misc_feature 1..22: note = chr8:65289592-65289614
  misc_feature 1..22: note = hyper
  source 1..22: mol_type = genomic DNA
gagaggctggaagctcgacgtc

SEQ ID NO: 52782 - DNA, 137 bp, Homo sapiens
  misc_feature 1..137: note = chr8:65290897-65291034
  misc_feature 1..137: note = hyper
  source 1..137: mol_type = genomic DNA
cgctgccctgagcctaatccctcttccgggcccagacccgaggtccgcgctcctgggcagtggggaagctttagtgagcaggcttttctctccgcagcaaacttgtagccagaccagatgggccgcccagctctctc

SEQ ID NO: 52783 - DNA, 33 bp, Homo sapiens; identical to SEQ ID NO: 32034
  misc_feature 1..33: note = chr8:65291410-65291443
  misc_feature 1..33: note = hyper
  source 1..33: mol_type = genomic DNA

SEQ ID NO: 52784 - DNA, 254 bp, Homo sapiens; identical to SEQ ID NO: 32035
  misc_feature 1..254: note = chr8:65291758-65292012
  misc_feature 1..254: note = hyper
  source 1..254: mol_type = genomic DNA

SEQ ID NO: 52785 - DNA, 149 bp, Homo sapiens
  misc_feature 1..149: note = chr8:65292727-65292876
  misc_feature 1..149: note = hyper
  source 1..149: mol_type = genomic DNA
gaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 52786 - DNA, 15 bp, Homo sapiens
  misc_feature 1..15: note = chr8:65293179-65293194
  misc_feature 1..15: note = hyper
  source 1..15: mol_type = genomic DNA
ccaggccttgcagcc

SEQ ID NO: 52787 - DNA, 108 bp, Homo sapiens; identical to SEQ ID NO: 32038
  misc_feature 1..108: note = chr8:65293265-65293373
  misc_feature 1..108: note = hyper
  source 1..108: mol_type = genomic DNA

SEQ ID NO: 52788 - DNA, 54 bp, Homo sapiens
  misc_feature 1..54: note = chr8:65488217-65488271
  misc_feature 1..54: note = hyper
  source 1..54: mol_type = genomic DNA
agtggggaaagaccacgcaggagccaggtgagaccctcgcggtgggctcgggga

SEQ ID NO: 52789 - DNA, 47 bp, Homo sapiens
  misc_feature 1..47: note = chr8:65488322-65488369
  misc_feature 1..47: note = hyper
  source 1..47: mol_type = genomic DNA
gtcttcaaggtctgttcaaatttaggctaactcgtccccaaacagta

SEQ ID NO: 52790 - DNA, 43 bp, Homo sapiens; identical to SEQ ID NO: 32040
  misc_feature 1..43: note = chr8:65488704-65488747
  misc_feature 1..43: note = hyper
  source 1..43: mol_type = genomic DNA

SEQ ID NO: 52791 - DNA, 16 bp, Homo sapiens
  misc_feature 1..16: note = chr8:65489049-65489065
  misc_feature 1..16: note = hyper
  source 1..16: mol_type = genomic DNA
ggttggattcttcctc

SEQ ID NO: 52792 - DNA, 33 bp, Homo sapiens
  misc_feature 1..33: note = chr8:65489066-65489099
  misc_feature 1..33: note = hyper
  source 1..33: mol_type = genomic DNA
gttggggaagcacagctggcggagaattcccac

SEQ ID NO: 52793 - DNA, 30 bp, Homo sapiens; identical to SEQ ID NO: 32043
  misc_feature 1..30: note = chr8:65490463-65490493
  misc_feature 1..30: note = hyper
  source 1..30: mol_type = genomic DNA

SEQ ID NO: 52794 - DNA, 216 bp, Homo sapiens
  misc_feature 1..216: note = chr8:65492979-65493195
  misc_feature 1..216: note = hyper
  source 1..216: mol_type = genomic DNA
ggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaaga

SEQ ID NO: 52795 - DNA, 146 bp, Homo sapiens; identical to SEQ ID NO: 20090
  misc_feature 1..146: note = chr8:65493433-65493579
  misc_feature 1..146: note = hyper
  source 1..146: mol_type = genomic DNA

SEQ ID NO: 52796 - DNA, 149 bp, Homo sapiens; identical to SEQ ID NO: 3283
  misc_feature 1..149: note = chr8:65493806-65493955
  misc_feature 1..149: note = hyper
  source 1..149: mol_type = genomic DNA

SEQ ID NO: 52797 - DNA, 58 bp, Homo sapiens
  misc_feature 1..58: note = chr8:65494193-65494251
  misc_feature 1..58: note = hyper
  source 1..58: mol_type = genomic DNA
atcgccacgctgctgctcgccaagaactacatcctcatgcaggcgcaggccctggagg

SEQ ID NO: 52798 - DNA, 87 bp, Homo sapiens; identical to SEQ ID NO: 32048
  misc_feature 1..87: note = chr8:65498465-65498552
  misc_feature 1..87: note = hyper
  source 1..87: mol_type = genomic DNA

SEQ ID NO: 52799 - DNA, 18 bp, Homo sapiens
  misc_feature 1..18: note = chr8:65499739-65499757
  misc_feature 1..18: note = hyper
  source 1..18: mol_type = genomic DNA
accaaatgacgtccacgc

SEQ ID NO: 52800 - DNA, 129 bp, Homo sapiens
  misc_feature 1..129: note = chr8:67024934-67025063
  misc_feature 1..129: note = hyper
  source 1..129: mol_type = genomic DNA
ctgtctacagaaccccgggcttcagtggcgtcttcctaacccggcttgcctgccgggggcgttccgagaccctcggggccttcccttcaccccgcgggagttggaccggtggcgctggtaaggcctccc

SEQ ID NO: 52801 - DNA, 492 bp, Homo sapiens; identical to SEQ ID NO: 32052
  misc_feature 1..492: note = chr8:67089544-67090036
  misc_feature 1..492: note = hyper
  source 1..492: mol_type = genomic DNA

SEQ ID NO: 52802 - DNA, 29 bp, Homo sapiens
  misc_feature 1..29: note = chr8:67344509-67344538
  misc_feature 1..29: note = hyper
  source 1..29: mol_type = genomic DNA
agcagttaccttctacggcaatttcaagg

SEQ ID NO: 52803 - DNA, 15 bp, Homo sapiens
  misc_feature 1..15: note = chr8:67875682-67875697
  misc_feature 1..15: note = hyper
  source 1..15: mol_type = genomic DNA
ctgtttttgtgtttg

SEQ ID NO: 52804 - DNA, 135 bp, Homo sapiens
  misc_feature 1..135: note = chr8:67940875-67941010
  misc_feature 1..135: note = hyper
  source 1..135: mol_type = genomic DNA
ccccggtgggtccttcccctgtgaggcggcggccgggcgctgatgggcactgacggtggtcactaggccgactccgactagagtcctgttagcttgaagaggccgtgaggcatcggtcaccgcattgttttagtg

SEQ ID NO: 52805 - DNA, 33 bp, Homo sapiens; identical to SEQ ID NO: 20097
  misc_feature 1..33: note = chr8:68864545-68864578
  misc_feature 1..33: note = hyper
  source 1..33: mol_type = genomic DNA

SEQ ID NO: 52806 - DNA, 86 bp, Homo sapiens
  misc_feature 1..86: note = chr8:68864765-68864851
  misc_feature 1..86: note = hyper
  source 1..86: mol_type = genomic DNA
tgtcggtgagtgtccccggcagacgcagggggacgtccgggcggcgcggggcgcgggtcccggagtggctgcgggaaggacgcgcg

SEQ ID NO: 52807 - DNA, 42 bp, Homo sapiens; identical to SEQ ID NO: 32065
  misc_feature 1..42: note = chr8:68865398-68865440
  misc_feature 1..42: note = hyper
  source 1..42: mol_type = genomic DNA

SEQ ID NO: 52808 - DNA, 10 bp, Homo sapiens
  misc_feature 1..10: note = chr8:69244500-69244510
  misc_feature 1..10: note = hyper
  source 1..10: mol_type = genomic DNA
aggcccttgc

SEQ ID NO: 52809 - DNA, 125 bp, Homo sapiens; identical to SEQ ID NO: 9614
  misc_feature 1..125: note = chr8:69244511-69244636
  misc_feature 1..125: note = hyper
  source 1..125: mol_type = genomic DNA

SEQ ID NO: 52810 - DNA, 84 bp, Homo sapiens; identical to SEQ ID NO: 32071
  misc_feature 1..84: note = chr8:70404780-70404864
  misc_feature 1..84: note = hyper
  source 1..84: mol_type = genomic DNA

SEQ ID NO: 52811 - DNA, 49 bp, Homo sapiens; identical to SEQ ID NO: 32072
  misc_feature 1..49: note = chr8:70405100-70405149
  misc_feature 1..49: note = hyper
  source 1..49: mol_type = genomic DNA

SEQ ID NO: 52812 - DNA, 21 bp, Homo sapiens
  misc_feature 1..21: note = chr8:70744839-70744860
  misc_feature 1..21: note = hyper
  source 1..21: mol_type = genomic DNA
agcttctgcagtggccggcgc

SEQ ID NO: 52813 - DNA, 320 bp, Homo sapiens
  misc_feature 1..320: note = chr8:70744925-70745245
  misc_feature 1..320: note = hyper
  source 1..320: mol_type = genomic DNA
tttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttgaggcaggcgcctcgcgcgtcccgggctcatcccctccgccgccgccgccgc

SEQ ID NO: 52814 - DNA, 30 bp, Homo sapiens; identical to SEQ ID NO: 9617
  misc_feature 1..30: note = chr8:70945287-70945317
  misc_feature 1..30: note = hyper
  source 1..30: mol_type = genomic DNA

SEQ ID NO: 52815 - DNA, 74 bp, Homo sapiens
  misc_feature 1..74: note = chr8:70946686-70946760
  misc_feature 1..74: note = hyper
  source 1..74: mol_type = genomic DNA
tgaaaagagaaaacacgtagacataatctggatggcggagactgaagagtgattatctctaggtggctggatgc

SEQ ID NO: 52816 - DNA, 166 bp, Homo sapiens; identical to SEQ ID NO: 32077
  misc_feature 1..166: note = chr8:70981714-70981880
  misc_feature 1..166: note = hyper
  source 1..166: mol_type = genomic DNA

SEQ ID NO: 52817 - DNA, 278 bp, Homo sapiens
  misc_feature 1..278: note = chr8:70983226-70983504
  misc_feature 1..278: note = hyper
  source 1..278: mol_type = genomic DNA
ctcctccgacctcagggatctgcaacttgggattcaaagcccccgagagggcagaacgaccatccaaaacgaactgcgccagcgagtgctgccgccctccccaacggccctggaagaccaccgccccgggccccaggcgcgtcctgtcccgtgcctacctccgacaccacctccaagagcgccaccgcggagcgggcgcctcctggacgctgcggggccactcgggctcggtaggccactcgggctcggtagacttcgggcgggccctgagggctgag

SEQ ID NO: 52818 - DNA, 16 bp, Homo sapiens
  misc_feature 1..16: note = chr8:70984978-70984994
  misc_feature 1..16: note = hyper
  source 1..16: mol_type = genomic DNA
tcgcctcttgtcccaa

SEQ ID NO: 52819 - DNA, 90 bp, Homo sapiens
  misc_feature 1..90: note = chr8:72273908-72273998
  misc_feature 1..90: note = hyper
  source 1..90: mol_type = genomic DNA
tttaatgtgttccttcgaattttctgggttagcaaacctccattcctgacatagttttgctcctggatgggtacgcgcgggggctctcag

SEQ ID NO: 52820 - DNA, 101 bp, Homo sapiens; identical to SEQ ID NO: 20109
  misc_feature 1..101: note = chr8:72274033-72274134
  misc_feature 1..101: note = hyper
  source 1..101: mol_type = genomic DNA

SEQ ID NO: 52821 - DNA, 103 bp, Homo sapiens; identical to SEQ ID NO: 32085
  misc_feature 1..103: note = chr8:72460433-72460536
  misc_feature 1..103: note = hyper
  source 1..103: mol_type = genomic DNA

SEQ ID NO: 52822 - DNA, 192 bp, Homo sapiens; identical to SEQ ID NO: 32088
  misc_feature 1..192: note = chr8:72470594-72470786
  misc_feature 1..192: note = hyper
  source 1..192: mol_type = genomic DNA

SEQ ID NO: 52823 - DNA, 30 bp, Homo sapiens; identical to SEQ ID NO: 32089
  misc_feature 1..30: note = chr8:72471116-72471146
  misc_feature 1..30: note = hyper
  source 1..30: mol_type = genomic DNA

SEQ ID NO: 52824 - DNA, 212 bp, Homo sapiens
  misc_feature 1..212: note = chr8:72754609-72754821
  misc_feature 1..212: note = hyper
  source 1..212: mol_type = genomic DNA
agagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacga

SEQ ID NO: 52825 - DNA, 89 bp, Homo sapiens
  misc_feature 1..89: note = chr8:72755176-72755265
  misc_feature 1..89: note = hyper
  source 1..89: mol_type = genomic DNA
ccgttcacgcttcttcctggactttgcccgcaggataatttggtgaaactcatctgactttgaggttctgtcgtttagttcccttcccc

SEQ ID NO: 52826 - DNA, 341 bp, Homo sapiens
  misc_feature 1..341: note = chr8:72755325-72755666
  misc_feature 1..341: note = hyper
  source 1..341: mol_type = genomic DNA
ctccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaa

SEQ ID NO: 52827 - DNA, 19 bp, Homo sapiens
  misc_feature 1..19: note = chr8:72756896-72756915
  misc_feature 1..19: note = hyper
  source 1..19: mol_type = genomic DNA
ctttcggggagtgaagggg

SEQ ID NO: 52828 - DNA, 164 bp, Homo sapiens; identical to SEQ ID NO: 32097
  misc_feature 1..164: note = chr8:73163497-73163661
  misc_feature 1..164: note = hyper
  source 1..164: mol_type = genomic DNA

SEQ ID NO: 52829 - DNA, 46 bp, Homo sapiens; identical to SEQ ID NO: 9640
  misc_feature 1..46: note = chr8:73448786-73448832
  misc_feature 1..46: note = hyper
  source 1..46: mol_type = genomic DNA

SEQ ID NO: 52830 - DNA, 30 bp, Homo sapiens; identical to SEQ ID NO: 32100
  misc_feature 1..30: note = chr8:73449084-73449114
  misc_feature 1..30: note = hyper
  source 1..30: mol_type = genomic DNA

SEQ ID NO: 52831 - DNA, 38 bp, Homo sapiens; identical to SEQ ID NO: 32101
  misc_feature 1..38: note = chr8:73449394-73449432
  misc_feature 1..38: note = hyper
  source 1..38: mol_type = genomic DNA

SEQ ID NO: 52832 - DNA, 292 bp, Homo sapiens; identical to SEQ ID NO: 32102
  misc_feature 1..292: note = chr8:73449663-73449955
  misc_feature 1..292: note = hyper
  source 1..292: mol_type = genomic DNA

SEQ ID NO: 52833 - DNA, 38 bp, Homo sapiens; identical to SEQ ID NO: 20116
  misc_feature 1..38: note = chr8:73450026-73450064
  misc_feature 1..38: note = hyper
  source 1..38: mol_type = genomic DNA

SEQ ID NO: 52834 - DNA, 62 bp, Homo sapiens
  misc_feature 1..62: note = chr8:73450100-73450162
  misc_feature 1..62: note = hyper
  source 1..62: mol_type = genomic DNA
gcggggtctgtgggagctaggtaagtggcgggggcattgctgctccccgaagggggtcttcc

SEQ ID NO: 52835 - DNA, 12 bp, Homo sapiens
  misc_feature 1..12: note = chr8:73450559-73450571
  misc_feature 1..12: note = hyper
  source 1..12: mol_type = genomic DNA
ttcctgagaggg

SEQ ID NO: 52836 - DNA, 30 bp, Homo sapiens; identical to SEQ ID NO: 32105
  misc_feature 1..30: note = chr8:75232938-75232968
  misc_feature 1..30: note = hyper
  source 1..30: mol_type = genomic DNA

SEQ ID NO: 52837 - DNA, 104 bp, Homo sapiens
  misc_feature 1..104: note = chr8:76316452-76316556
  misc_feature 1..104: note = hyper
  source 1..104: mol_type = genomic DNA
tcgctttgggctgcgccagggagcaaaaaacctctgcttttttgaaagaggccggggcaacaaggtagagagccgcggccagaagcagccccgggccataaacc

SEQ ID NO: 52838 - DNA, 276 bp, Homo sapiens; identical to SEQ ID NO: 32110
  misc_feature 1..276: note = chr8:76316614-76316890
  misc_feature 1..276: note = hyper
  source 1..276: mol_type = genomic DNA

SEQ ID NO: 52839 - DNA, 146 bp, Homo sapiens
  misc_feature 1..146: note = chr8:77585073-77585219
  misc_feature 1..146: note = hyper
  source 1..146: mol_type = genomic DNA
gccactctgctcttccgcccagcccactcctgcctgcagtgttgctgctgtcacgccagccggtgatttgataggcttgtcgggttgccatggtgttgacttcttgcctctgaggagctgcccaatgactggaggtctgggattaa

SEQ ID NO: 52840 - DNA, 142 bp, Homo sapiens
  misc_feature 1..142: note = chr8:77585698-77585840
  misc_feature 1..142: note = hyper
  source 1..142: mol_type = genomic DNA
agaaaatagttgccttggacggaggctggcggggcggggggagcgggggcggggaagtcagagagtgcatgtgcaatgcacaaccccagacggaaattgtaaactaggaaatgaaagggaaagaaaccgcttctgttataaa

SEQ ID NO: 52841 - DNA, 75 bp, Homo sapiens
  misc_feature 1..75: note = chr8:77586100-77586175
  misc_feature 1..75: note = hyper
  source 1..75: mol_type = genomic DNA
aggaaagaaatagtccgcgattcacccaagggactgggagattcagagagattccaggagaaggaaaggaacata

SEQ ID NO: 52842 - DNA, 285 bp, Homo sapiens
  misc_feature 1..285: note = chr8:77586278-77586563
  misc_feature 1..285: note = hyper
  source 1..285: mol_type = genomic DNA
acagtcaattggaaggagcccgagtcagggagcaattgctaggacttcggacagagagggcagaagattgtgtagacaggcggtcaaccagagcagcgcggggcaggacccacgagcgcgaagccaggtgccgcgcggtccgcgccccggctccgggcgacgcagggactttgctggcaatgagaaggctgctcgaccagcctgccggagtcacgattccccgcgagtcccaaacacacgcttcactaactactttacagccacttccattgattttctttaaca

SEQ ID NO: 52843 - DNA, 141 bp, Homo sapiens
  misc_feature 1..141: note = chr8:77590098-77590239
  misc_feature 1..141: note = hyper
  source 1..141: mol_type = genomic DNA
tctagggaaagttctcggagcggcagggaaacctctactcctttcactttgaaataaaaagtggcccaacgttccgtgagggcggcggcgggttcgcgcagagtttagggacagtggaatgggggtggggcagggagtggg

SEQ ID NO: 52844 - DNA, 66 bp, Homo sapiens; identical to SEQ ID NO: 20120
  misc_feature 1..66: note = chr8:77590466-77590532
  misc_feature 1..66: note = hyper
  source 1..66: mol_type = genomic DNA

SEQ ID NO: 52845 - DNA, 359 bp, Homo sapiens
  misc_feature 1..359: note = chr8:77593376-77593735
  misc_feature 1..359: note = hyper
  source 1..359: mol_type = genomic DNA
ggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattatttttt

SEQ ID NO: 52846 - DNA, 471 bp, Homo sapiens
  misc_feature 1..471: note = chr8:77594124-77594595
  misc_feature 1..471: note = hyper
  source 1..471: mol_type = genomic DNA
ggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttc

SEQ ID NO: 52847 - DNA, 52 bp, Homo sapiens
  misc_feature 1..52: note = chr8:77594596-77594648
  misc_feature 1..52: note = hyper
  source 1..52: mol_type = genomic DNA
tgagctctggggaggggattccaagaggctggggtgaacgctggggctgggg

SEQ ID NO: 52848 - DNA, 150 bp, Homo sapiens
  misc_feature 1..150: note = chr8:77595189-77595339
  misc_feature 1..150: note = hyper
  source 1..150: mol_type = genomic DNA
ataaagtttctctgccgatgtccaagttacagaaggttccctattctaatccccttcccctagaagacggtgcactggtttctatttcttttgttacctgtgatccgggcggggggctcctttcggccgctcgggctggggtccggccca

SEQ ID NO: 52849 - skipped

SEQ ID NO: 52850 - DNA, 546 bp, Homo sapiens
  misc_feature 1..546: note = chr8:79428401-79428947
  misc_feature 1..546: note = hyper
  source 1..546: mol_type = genomic DNA
aaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccattt

SEQ ID NO: 52851 - DNA, 94 bp, Homo sapiens
  misc_feature 1..94: note = chr8:80523889-80523983
  misc_feature 1..94: note = hyper
  source 1..94: mol_type = genomic DNA
attgcaaagtcaaagcggtcccatcccgctgtttgaaagatgggtggagacggggggaggggatggagagaactgggcacattttacggtattg

SEQ ID NO: 52852 - DNA, 224 bp, Homo sapiens; identical to SEQ ID NO: 20125
  misc_feature 1..224: note = chr8:80524029-80524253
  misc_feature 1..224: note = hyper
  source 1..224: mol_type = genomic DNA

SEQ ID NO: 52853 - DNA, 149 bp, Homo sapiens
  misc_feature 1..149: note = chr8:80524318-80524467
  misc_feature 1..149: note = hyper
  source 1..149: mol_type = genomic DNA
tgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgacccc

SEQ ID NO: 52854 - DNA, 13 bp, Homo sapiens
  misc_feature 1..13: note = chr8:80524468-80524481
  misc_feature 1..13: note = hyper
  source 1..13: mol_type = genomic DNA
ccctccccacgct

SEQ ID NO: 52855 - DNA, 101 bp, Homo sapiens; identical to SEQ ID NO: 20127
  misc_feature 1..101: note = chr8:80524845-80524946
  misc_feature 1..101: note = hyper
  source 1..101: mol_type = genomic DNA

SEQ ID NO: 52856 - DNA, 584 bp, Homo sapiens
  misc_feature 1..584: note = chr8:80525020-80525604
  misc_feature 1..584: note = hyper
  source 1..584: mol_type = genomic DNA
tccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccccttcccagggattcagggagggctgtctcttctcgcccacccacggtccgcggagctcggggctttttttcccccagcccaagccccccgcccaccctctgttctctatgattttccagaatggagaccccgcgaggggcttctctaagggagaccctcgctcctccagcggggcgcggctcggccccacccctcccagctgaggcccagagccgcctaccgctggccgggtgggggcgcacgtggcgactgggtgtgtggagcgcagccagccctgcagagccccgcgccgcgcc

SEQ ID NO: 52857 - DNA, 40 bp, Homo sapiens
  misc_feature 1..40: note = chr8:80525733-80525773
  misc_feature 1..40: note = hyper
  source 1..40: mol_type = genomic DNA
tgagaatgggtggtgggggcgatctcgcctcgctttctgc

SEQ ID NO: 52858 - DNA, 125 bp, Homo sapiens
  misc_feature 1..125: note = chr8:80803548-80803673
  misc_feature 1..125: note = hyper
  source 1..125: mol_type = genomic DNA
gacagaaaaccgagccctatttgttattagtatttttttttttatactctcaaatgccaccggcacattcttttaaaaaaaaatgaaaggaaagaaagaaagaaaaagaaaataagagaggaaaa

SEQ ID NO: 52859 - DNA, 21 bp, Homo sapiens
  misc_feature 1..21: note = chr8:80803872-80803893
  misc_feature 1..21: note = hyper
  source 1..21: mol_type = genomic DNA
gaaggccgccccccgctccac

SEQ ID NO: 52860 - DNA, 101 bp, Homo sapiens; identical to SEQ ID NO: 32125
  misc_feature 1..101: note = chr8:81400332-81400433
  misc_feature 1..101: note = hyper
  source 1..101: mol_type = genomic DNA

SEQ ID NO: 52861 - DNA, 44 bp, Homo sapiens
  misc_feature 1..44: note = chr8:81478141-81478185
  misc_feature 1..44: note = hyper
  source 1..44: mol_type = genomic DNA
ctgcgtgggtgttctcgtctttcctcctatcgtatgttacggtt

SEQ ID NO: 52862 - DNA, 115 bp, Homo sapiens
  misc_feature 1..115: note = chr8:81478350-81478465
  misc_feature 1..115: note = hyper
  source 1..115: mol_type = genomic DNA
cacaaataccagggcacccatgtttctgccctgggaaactctcacgtcagccggccccccaattctgctaaaggagaaaacaaaatttccctcccatggacgcagctgggcactt

SEQ ID NO: 52863 - DNA, 672 bp, Homo sapiens; identical to SEQ ID NO: 32127
  misc_feature 1..672: note = chr8:82192624-82193296
  misc_feature 1..672: note = hyper
  source 1..672: mol_type = genomic DNA

SEQ ID NO: 52864 - DNA, 165 bp, Homo sapiens; identical to SEQ ID NO: 32128
  misc_feature 1..165: note = chr8:82193521-82193686
  misc_feature 1..165: note = hyper
  source 1..165: mol_type = genomic DNA

SEQ ID NO: 52865 - DNA, 42 bp, Homo sapiens; identical to SEQ ID NO: 32129
  misc_feature 1..42: note = chr8:85094795-85094837
  misc_feature 1..42: note = hyper
  source 1..42: mol_type = genomic DNA

SEQ ID NO: 52866 - DNA, 175 bp, Homo sapiens
  misc_feature 1..175: note = chr8:85095307-85095482
  misc_feature 1..175: note = hyper
  source 1..175: mol_type = genomic DNA
cacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcg

SEQ ID NO: 52867 - DNA, 11 bp, Homo sapiens
  misc_feature 1..11: note = chr8:85095668-85095679
  misc_feature 1..11: note = hyper
  source 1..11: mol_type = genomic DNA
gcctgcaagtc

SEQ ID NO: 52868 - DNA, 117 bp, Homo sapiens; identical to SEQ ID NO: 32132
  misc_feature 1..117: note = chr8:85095999-85096116
  misc_feature 1..117: note = hyper
  source 1..117: mol_type = genomic DNA

SEQ ID NO: 52869 - DNA, 151 bp, Homo sapiens; identical to SEQ ID NO: 32134
  misc_feature 1..151: note = chr8:85096852-85097003
  misc_feature 1..151: note = hyper
  source 1..151: mol_type = genomic DNA

SEQ ID NO: 52870 - DNA, 53 bp, Homo sapiens; identical to SEQ ID NO: 32136
  misc_feature 1..53: note = chr8:87081803-87081856
  misc_feature 1..53: note = hyper
  source 1..53: mol_type = genomic DNA

SEQ ID NO: 52871 - DNA, 347 bp, Homo sapiens
  misc_feature 1..347: note = chr8:89339042-89339389
  misc_feature 1..347: note = hyper
  source 1..347: mol_type = genomic DNA
gtgaaaagcatggaccggctacaattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgat

SEQ ID NO: 52872 - DNA, 238 bp, Homo sapiens
  misc_feature 1..238: note = chr8:89339745-89339983
  misc_feature 1..238: note = hyper
  source 1..238: mol_type = genomic DNA
cgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcg

SEQ ID NO: 52873 - DNA, 10 bp, Homo sapiens
  misc_feature 1..10: note = chr8:89340043-89340053
  misc_feature 1..10: note = hyper
  source 1..10: mol_type = genomic DNA
cacacacgcg

SEQ ID NO: 52874 - DNA, 156 bp, Homo sapiens; identical to SEQ ID NO: 32139
  misc_feature 1..156: note = chr8:89340081-89340237
  misc_feature 1..156: note = hyper
  source 1..156: mol_type = genomic DNA

SEQ ID NO: 52875 - DNA, 639 bp, Homo sapiens
  misc_feature 1..639: note = chr8:89340345-89340984
  misc_feature 1..639: note = hyper
  source 1..639: mol_type = genomic DNA
cctggggagcggcccaaccctggtcctggagagcggtcggcattcctgaggaagcggccctggaagaataggggcgctgggaatcagaggagcgcctggtcactgagcgcccctgggtggctcgggtcggtggccggggctgaccaagtttgggaagactgagatagcaaatcccgaacgtccaaaactttgttggggtcccgagcctgtggcctggtgtcttcctgaatcccctctaccatagctacattccgccttccaggcttgaggagtaggcacagggttttggtggcggactagacaaatacagaagcgggatgaaaacgctcactttccaagtgaacggtggacacacgcgcacagtgggacccgggagagatggtcctgggtgttaacaaaacatccgatgagagggatgggggcgctggaaagaaaccggctgcgggagccaggggaagggttggggaaagaaggagaagaagcagcctgaggaaaggcgagtaaagcagctggcaagggcgggaggaagaggctgctcgcagaccgagcgggggagaggctggcgggagctaggagagctgcaggcaagagggggaggcggctggcaagaagcacgggcgaacgcgggcagggaacttc

SEQ ID NO: 52876 - DNA, 32 bp, Homo sapiens; identical to SEQ ID NO: 9668
  misc_feature 1..32: note = chr8:91094254-91094286
  misc_feature 1..32: note = hyper
  source 1..32: mol_type = genomic DNA

SEQ ID NO: 52877 - DNA, 33 bp, Homo sapiens; identical to SEQ ID NO: 32142
  misc_feature 1..33: note = chr8:91095051-91095084
  misc_feature 1..33: note = hyper
  source 1..33: mol_type = genomic DNA

SEQ ID NO: 52878 - DNA, 15 bp, Homo sapiens
  misc_feature 1..15: note = chr8:91095141-91095156
  misc_feature 1..15: note = hyper
  source 1..15: mol_type = genomic DNA
cggccccaagccggg

SEQ ID NO: 52879 - DNA, 59 bp, Homo sapiens; identical to SEQ ID NO: 20140
  misc_feature 1..59: note = chr8:91997947-91998006
  misc_feature 1..59: note = hyper
  source 1..59: mol_type = genomic DNA

SEQ ID NO: 52880 - DNA, 179 bp, Homo sapiens
  misc_feature 1..179: note = chr8:93114528-93114707
  misc_feature 1..179: note = hyper
  source 1..179: mol_type = genomic DNA
aagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccac

SEQ ID NO: 52881 - DNA, 30 bp, Homo sapiens; identical to SEQ ID NO: 9673
  misc_feature 1..30: note = chr8:93115382-93115412
  misc_feature 1..30: note = hyper
  source 1..30: mol_type = genomic DNA

SEQ ID NO: 52882 - DNA, 167 bp, Homo sapiens; identical to SEQ ID NO: 32149
  misc_feature 1..167: note = chr8:93115692-93115859
  misc_feature 1..167: note = hyper
  source 1..167: mol_type = genomic DNA

SEQ ID NO: 52883 - DNA, 30 bp, Homo sapiens; identical to SEQ ID NO: 32150
  misc_feature 1..30: note = chr8:94712418-94712448
  misc_feature 1..30: note = hyper
  source 1..30: mol_type = genomic DNA

SEQ ID NO: 52884 - DNA, 300 bp, Homo sapiens; identical to SEQ ID NO: 32151
  misc_feature 1..300: note = chr8:94713129-94713429
  misc_feature 1..300: note = hyper
  source 1..300: mol_type = genomic DNA

SEQ ID NO: 52885 - DNA, 30 bp, Homo sapiens; identical to SEQ ID NO: 32152
  misc_feature 1..30: note = chr8:95246973-95247003
  misc_feature 1..30: note = hyper
  source 1..30: mol_type = genomic DNA

SEQ ID NO: 52886 - DNA, 30 bp, Homo sapiens; identical to SEQ ID NO: 32153
  misc_feature 1..30: note = chr8:95651480-95651510
  misc_feature 1..30: note = hyper
  source 1..30: mol_type = genomic DNA

SEQ ID NO: 52887 - DNA, 104 bp, Homo sapiens
  misc_feature 1..104: note = chr8:97156981-97157085
  misc_feature 1..104: note = hyper
  source 1..104: mol_type = genomic DNA
agcgcagcgggaagtcgcatacaccctcgcagtgataggcctcgtactccaggggcgcgataatccagtcgtcccagcccagctccttgaagttcacgtgcagg

SEQ ID NO: 52888 - DNA, 89 bp, Homo sapiens
  misc_feature 1..89: note = chr8:97158066-97158155
  misc_feature 1..89: note = hyper
  source 1..89: mol_type = genomic DNA
gccctttgtggtctcaagcctgggccgcgtttcccctagacctcctctgggctgggctggctcgttctcgttgacgtctcaaatgtcac

SEQ ID NO: 52889 - DNA, 11 bp, Homo sapiens
  misc_feature 1..11: note = chr8:97165633-97165644
  misc_feature 1..11: note = hyper
  source 1..11: mol_type = genomic DNA
ccaaaccgaag

SEQ ID NO: 52890 - DNA, 120 bp, Homo sapiens
  misc_feature 1..120: note = chr8:97165676-97165796
  misc_feature 1..120: note = hyper
  source 1..120: mol_type = genomic DNA
ccccatctcactgaggcgcgcacgcggcctgcccttcccctggggccgggacctggggggttggctaggggcggccttccctgcactgtcgaccggtaagtcacccgggagcccagggga

SEQ ID NO: 52891 - DNA, 130 bp, Homo sapiens
  misc_feature 1..130: note = chr8:97169708-97169838
  misc_feature 1..130: note = hyper
  source 1..130: mol_type = genomic DNA
cgctcctccccttgggggacccccggctccaccgagccaggccagccccactcgacggcgatttaaacatcccttaggcaaggcgccaagttagcgctgctggcccagctctaggcgggccgctgctctt

SEQ ID NO: 52892 - skipped

SEQ ID NO: 52893 - DNA, 490 bp, Homo sapiens
  misc_feature 1..490: note = chr8:97170377-97170867
  misc_feature 1..490: note = hyper
  source 1..490: mol_type = genomic DNA
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagct

SEQ ID NO: 52894 - DNA, 232 bp, Homo sapiens
  misc_feature 1..232: note = chr8:97170897-97171129
  misc_feature 1..232: note = hyper
  source 1..232: mol_type = genomic DNA
gaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgct

SEQ ID NO: 52895 - DNA, 233 bp, Homo sapiens; identical to SEQ ID NO: 20149
  misc_feature 1..233: note = chr8:97172200-97172433
  misc_feature 1..233: note = hyper
  source 1..233: mol_type = genomic DNA

SEQ ID NO: 52896 - DNA, 68 bp, Homo sapiens; identical to SEQ ID NO: 20150
  misc_feature 1..68: note = chr8:97173458-97173526
  misc_feature 1..68: note = hyper
  source 1..68: mol_type = genomic DNA

SEQ ID NO: 52897 - DNA, 32 bp, Homo sapiens; identical to SEQ ID NO: 32168
  misc_feature 1..32: note = chr8:97173527-97173559
  misc_feature 1..32: note = hyper
  source 1..32: mol_type = genomic DNA

SEQ ID NO: 52898 - DNA, 30 bp, Homo sapiens; identical to SEQ ID NO: 9688
  misc_feature 1..30: note = chr8:97505645-97505675
  misc_feature 1..30: note = hyper
  source 1..30: mol_type = genomic DNA

SEQ ID NO: 52899 - DNA, 80 bp, Homo sapiens
  misc_feature 1..80: note = chr8:97506524-97506604
  misc_feature 1..80: note = hyper
  source 1..80: mol_type = genomic DNA
ccttgggcttggtggcctgcgtgtcggcggagtcggtgagtgggccaggcggaggatgcgcgcgccgtttagggtgtttg

SEQ ID NO: 52900 - DNA, 46 bp, Homo sapiens; identical to SEQ ID NO: 32173
  misc_feature 1..46: note = chr8:97506848-97506894
  misc_feature 1..46: note = hyper
  source 1..46: mol_type = genomic DNA

SEQ ID NO: 52901 - DNA, 262 bp, Homo sapiens; identical to SEQ ID NO: 20153
  misc_feature 1..262: note = chr8:97507284-97507546
  misc_feature 1..262: note = hyper
  source 1..262: mol_type = genomic DNA

SEQ ID NO: 52902 - DNA, 15 bp, Homo sapiens
  misc_feature 1..15: note = chr8:97507680-97507695
  misc_feature 1..15: note = hyper
  source 1..15: mol_type = genomic DNA
cgggccaggtggaag

SEQ ID NO: 52903 - DNA, 219 bp, Homo sapiens; identical to SEQ ID NO: 32175
  misc_feature 1..219: note = chr8:97657861-97658080
  misc_feature 1..219: note = hyper
  source 1..219: mol_type = genomic DNA

SEQ ID NO: 52904 - skipped

SEQ ID NO: 52905 - DNA, 117 bp, Homo sapiens
  misc_feature 1..117: note = chr8:98290260-98290377
  misc_feature 1..117: note = hyper
  source 1..117: mol_type = genomic DNA
ccgcgggcgctcccacccccatctcgcgcggactcgctttaggtctcggcgagtttctctgatatgcgctcgcgggggtgctgccatttcatctcttccgcgcgggctcatcgtgct

SEQ ID NO: 52906 - DNA, 129 bp, Homo sapiens; identical to SEQ ID NO: 32178
  misc_feature 1..129: note = chr8:98788308-98788437
  misc_feature 1..129: note = hyper
  source 1..129: mol_type = genomic DNA

SEQ ID NO: 52907 - DNA, 30 bp, Homo sapiens; identical to SEQ ID NO: 32179
  misc_feature 1..30: note = chr8:98788975-98789005
  misc_feature 1..30: note = hyper
  source 1..30: mol_type = genomic DNA

SEQ ID NO: 52908 - DNA, 94 bp, Homo sapiens; identical to SEQ ID NO: 9694
  misc_feature 1..94: note = chr8:99076589-99076683
  misc_feature 1..94: note = hyper
  source 1..94: mol_type = genomic DNA

SEQ ID NO: 52909 - DNA, 253 bp, Homo sapiens; identical to SEQ ID NO: 32181
  misc_feature 1..253: note = chr8:99076759-99077012
  misc_feature 1..253: note = hyper
  source 1..253: mol_type = genomic DNA

SEQ ID NO: 52910 - DNA, 40 bp, Homo sapiens; identical to SEQ ID NO: 32182
  misc_feature 1..40: note = chr8:99077254-99077294
  misc_feature 1..40: note = hyper
  source 1..40: mol_type = genomic DNA

SEQ ID NO: 52911 - DNA, 291 bp, Homo sapiens
  misc_feature 1..291: note = chr8:99438813-99439104
  misc_feature 1..291: note = hyper
  source 1..291: mol_type = genomic DNA
caacaaccccacccccgggcttcgggaaacttttcttcaggtccctaaaaggggacacctggagttcctccggtcccgccctgtccccggacacgcgcaagccgccctttatttcccagcccagctcccgccagacccagcggggaaaggtcaccgtaggcagccccctgcctgcgccctgggggtggtgataataacagctgtcaccgggggatggtcggggggaagggagaggtgtcggccccgcgccgagccgggggcgcaaggtggtcgcggtgacgcgccggggaa

SEQ ID NO: 52912 - DNA, 241 bp, Homo sapiens
  misc_feature 1..241: note = chr8:99439133-99439374
  misc_feature 1..241: note = hyper
  source 1..241: mol_type = genomic DNA
cgccttccgagcccgggcggcggccgaggcacgcggagctgtccgttcagcaccaccgcgccgcgccccgcgcagggcgggcgccccgtcacacccgctctgctcccgccccggctcacggggcgaatgcggcgcgggttcctgcctctctgggtgggtgaggggcgcgcggatccggagagggggctccgggagcggcgggaccacgcagccacctgtgagccttcggcagctgcgggcg

SEQ ID NO: 52913 - DNA, 23 bp, Homo sapiens
  misc_feature 1..23: note = chr8:99440354-99440377
  misc_feature 1..23: note = hyper
  source 1..23: mol_type = genomic DNA
cactcgcgcgaggccattctgga

SEQ ID NO: 52914 - DNA, 29 bp, Homo sapiens
  misc_feature 1..29: note = chr8:99951434-99951463
  misc_feature 1..29: note = hyper
  source 1..29: mol_type = genomic DNA
ggaagaggtagggacggaggaggagagag

SEQ ID NO: 52915 - DNA, 118 bp, Homo sapiens
  misc_feature 1..118: note = chr8:99952815-99952933
  misc_feature 1..118: note = hyper
  source 1..118: mol_type = genomic DNA
gcagacgcgggaaggcccccgcgccatccgtgggagtggggcagcctgtctgcacgcggtcccctgggaaacccctctgcatctcccgcccggacaaggtccccggccttggaatctg

SEQ ID NO: 52916 - DNA, 96 bp, Homo sapiens; identical to SEQ ID NO: 32189
  misc_feature 1..96: note = chr8:99952968-99953064
  misc_feature 1..96: note = hyper
  source 1..96: mol_type = genomic DNA

SEQ ID NO: 52917 - DNA, 262 bp, Homo sapiens
  misc_feature 1..262: note = chr8:99954228-99954490
  misc_feature 1..262: note = hyper
  source 1..262: mol_type = genomic DNA
ccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggcc

SEQ ID NO: 52918 - DNA, 35 bp, Homo sapiens
  misc_feature 1..35: note = chr8:99954727-99954762
  misc_feature 1..35: note = hyper
  source 1..35: mol_type = genomic DNA
tgcggaaagagggagcagctcgtggggttggaaat

SEQ ID NO: 52919 - DNA, 30 bp, Homo sapiens; identical to SEQ ID NO: 32193
  misc_feature 1..30: note = chr8:99955993-99956023
  misc_feature 1..30: note = hyper
  source 1..30: mol_type = genomic DNA

SEQ ID NO: 52920 - DNA, 30 bp, Homo sapiens; identical to SEQ ID NO: 32194
  misc_feature 1..30: note = chr8:99957393-99957423
  misc_feature 1..30: note = hyper
  source 1..30: mol_type = genomic DNA

SEQ ID NO: 52921 - DNA, 30 bp, Homo sapiens; identical to SEQ ID NO: 32195
  misc_feature 1..30: note = chr8:99957679-99957709
  misc_feature 1..30: note = hyper
  source 1..30: mol_type = genomic DNA

SEQ ID NO: 52922 - DNA, 281 bp, Homo sapiens
  misc_feature 1..281: note = chr8:99960048-99960329
  misc_feature 1..281: note = hyper
  source 1..281: mol_type = genomic DNA
tttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggag

SEQ ID NO: 52923 - DNA, 15 bp, Homo sapiens
  misc_feature 1..15: note = chr8:99961568-99961583
  misc_feature 1..15: note = hyper
  source 1..15: mol_type = genomic DNA
cgcctaagatgggag

SEQ ID NO: 52924 - DNA, 35 bp, Homo sapiens
  misc_feature 1..35: note = chr8:99961822-99961857
  misc_feature 1..35: note = hyper
  source 1..35: mol_type = genomic DNA
ctgcgggatcacaggtgaggcgggcaaggaggatg

SEQ ID NO: 52925 - DNA, 21 bp, Homo sapiens
  misc_feature 1..21: note = chr8:99985845-99985866
  misc_feature 1..21: note = hyper
  source 1..21: mol_type = genomic DNA
ggcctaggcctagttcgtgtc

SEQ ID NO: 52926 - DNA, 236 bp, Homo sapiens
  misc_feature 1..236: note = chr8:101118005-101118241
  misc_feature 1..236: note = hyper
  source 1..236: mol_type = genomic DNA
tctcatgtctgggagcggggataccgctaggagggcaggaggtaaagtccagaggctggcgcgtggtgcggccccgacgccgcgggctgatcctctgtccctgtggggccgccacctacccgcggtgagcctcttctcgggcatgccgtccccgctgcccgcgcctggagcccgcgcgggccgtcagggccctagcgcgcgggtccagcgcgggtcagggcctgagcgacgcggcg

SEQ ID NO: 52927 - DNA, 79 bp, Homo sapiens; identical to SEQ ID NO: 32204
  misc_feature 1..79: note = chr8:101661840-101661919
  misc_feature 1..79: note = hyper
  source 1..79: mol_type = genomic DNA

SEQ ID NO: 52928 - DNA, 99 bp, Homo sapiens
  misc_feature 1..99: note = chr8:101822047-101822146
  misc_feature 1..99: note = hyper
  source 1..99: mol_type = genomic DNA
ctacgacagcgaggggcccgggaagcccgcggaaacgcaggaggcggccaggagaggcagcgctacgcacatcccccccaccttcggagccctgtccta

SEQ ID NO: 52929 - DNA, 241 bp, Homo sapiens
  misc_feature 1..241: note = chr8:102505556-102505797
  misc_feature 1..241: note = hyper
  source 1..241: mol_type = genomic DNA
gcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggg

SEQ ID NO: 52930 - DNA, 276 bp, Homo sapiens; identical to SEQ ID NO: 32207
  misc_feature 1..276: note = chr8:104152711-104152987
  misc_feature 1..276: note = hyper
  source 1..276: mol_type = genomic DNA

SEQ ID NO: 52931 - DNA, 182 bp, Homo sapiens; identical to SEQ ID NO: 20167
  misc_feature 1..182: note = chr8:104153267-104153449
  misc_feature 1..182: note = hyper
  source 1..182: mol_type = genomic DNA

SEQ ID NO: 52932 - DNA, 30 bp, Homo sapiens; identical to SEQ ID NO: 32209
  misc_feature 1..30: note = chr8:104310870-104310900
  misc_feature 1..30: note = hyper
  source 1..30: mol_type = genomic DNA

SEQ ID NO: 52933 - DNA, 355 bp, Homo sapiens; identical to SEQ ID NO: 32210
  misc_feature 1..355: note = chr8:104511157-104511512
  misc_feature 1..355: note = hyper
  source 1..355: mol_type = genomic DNA

SEQ ID NO: 52934 - DNA, 140 bp, Homo sapiens
  misc_feature 1..140: note = chr8:104511983-104512123
  misc_feature 1..140: note = hyper
  source 1..140: mol_type = genomic DNA
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggagggg

SEQ ID NO: 52935 - DNA, 80 bp, Homo sapiens
  misc_feature 1..80: note = chr8:104513382-104513462
  misc_feature 1..80: note = hyper
  source 1..80: mol_type = genomic DNA
cctccctcccgctggcggcgcccaggccacgagggctgcggccagcgccggccgcccgggctgttttaggggtgtctgag

SEQ ID NO: 52936 - DNA, 120 bp, Homo sapiens; identical to SEQ ID NO: 20171
  misc_feature 1..120: note = chr8:105235249-105235369
  misc_feature 1..120: note = hyper
  source 1..120: mol_type = genomic DNA

SEQ ID NO: 52937 - DNA, 157 bp, Homo sapiens
  misc_feature 1..157: note = chr8:105479247-105479404
  misc_feature 1..157: note = hyper
  source 1..157: mol_type = genomic DNA
cgacagcccccgagctctgcctcaggctgcaaatccggagcccggcggcctgacgggtttatgacctggccgcatatgcggctcctccccccgggaaggctgggctggagcccaaaggccgggattgaacaggtccgcatggtccttgcacactcag

SEQ ID NO: 52938 - DNA, 155 bp, Homo sapiens; identical to SEQ ID NO: 9720
  misc_feature 1..155: note = chr8:105600526-105600681
  misc_feature 1..155: note = hyper
  source 1..155: mol_type = genomic DNA

SEQ ID NO: 52939 - DNA, 266 bp, Homo sapiens; identical to SEQ ID NO: 32219
  misc_feature 1..266: note = chr8:105601010-105601276
  misc_feature 1..266: note = hyper
  source 1..266: mol_type = genomic DNA

SEQ ID NO: 52940 - DNA, 58 bp, Homo sapiens; identical to SEQ ID NO: 32220
  misc_feature 1..58: note = chr8:105601510-105601568
  misc_feature 1..58: note = hyper
  source 1..58: mol_type = genomic DNA

SEQ ID NO: 52941 - DNA, 115 bp, Homo sapiens; identical to SEQ ID NO: 32221
  misc_feature 1..115: note = chr8:105601944-105602059
  misc_feature 1..115: note = hyper
  source 1..115: mol_type = genomic DNA

SEQ ID NO: 52942 - DNA, 38 bp, Homo sapiens; identical to SEQ ID NO: 32222
  misc_feature 1..38: note = chr8:106330435-106330473
  misc_feature 1..38: note = hyper
  source 1..38: mol_type = genomic DNA

SEQ ID NO: 52943 - DNA, 63 bp, Homo sapiens; identical to SEQ ID NO: 9724
  misc_feature 1..63: note = chr8:106331011-106331074
  misc_feature 1..63: note = hyper
  source 1..63: mol_type = genomic DNA

SEQ ID NO: 52944 - DNA, 77 bp, Homo sapiens; identical to SEQ ID NO: 20177
  misc_feature 1..77: note = chr8:106331083-106331160
  misc_feature 1..77: note = hyper
  source 1..77: mol_type = genomic DNA

SEQ ID NO: 52945 - DNA, 20 bp, Homo sapiens
  misc_feature 1..20: note = chr8:106331237-106331257
  misc_feature 1..20: note = hyper
  source 1..20: mol_type = genomic DNA
gtgggattattgcccaggag

SEQ ID NO: 52946 - DNA, 114 bp, Homo sapiens; identical to SEQ ID NO: 32225
  misc_feature 1..114: note = chr8:106331860-106331974
  misc_feature 1..114: note = hyper
  source 1..114: mol_type = genomic DNA

SEQ ID NO: 52947 - DNA, 30 bp, Homo sapiens; identical to SEQ ID NO: 32226
  misc_feature 1..30: note = chr8:107281960-107281990
  misc_feature 1..30: note = hyper
  source 1..30: mol_type = genomic DNA

SEQ ID NO: 52948 - DNA, 196 bp, Homo sapiens; identical to SEQ ID NO: 32227
  misc_feature 1..196: note = chr8:107282301-107282497
  misc_feature 1..196: note = hyper
  source 1..196: mol_type = genomic DNA

SEQ ID NO: 52949 - DNA, 57 bp, Homo sapiens; identical to SEQ ID NO: 32228
  misc_feature 1..57: note = chr8:107282838-107282895
  misc_feature 1..57: note = hyper
  source 1..57: mol_type = genomic DNA

SEQ ID NO: 52950 - DNA, 720 bp, Homo sapiens; identical to SEQ ID NO: 32229
  misc_feature 1..720: note = chr8:107283112-107283832
  misc_feature 1..720: note = hyper
  source 1..720: mol_type = genomic DNA

SEQ ID NO: 52951 - skipped

SEQ ID NO: 52952 - DNA, 147 bp, Homo sapiens
  misc_feature 1..147: note = chr8:107284075-107284222
  misc_feature 1..147: note = hyper
  source 1..147: mol_type = genomic DNA
tggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcac

SEQ ID NO: 52953 - DNA, 88 bp, Homo sapiens
  misc_feature 1..88: note = chr8:109094397-109094485
  misc_feature 1..88: note = hyper
  source 1..88: mol_type = genomic DNA
cagagagaagaacaacgacgacaaaaaaaaaatgcatgtcagataagaaatacgtcctaaagagacaagtttagatgaggaggtgggg

SEQ ID NO: 52954 - DNA, 245 bp, Homo sapiens; identical to SEQ ID NO: 20180
  misc_feature 1..245: note = chr8:109094595-109094840
  misc_feature 1..245: note = hyper
  source 1..245: mol_type = genomic DNA

SEQ ID NO: 52955 - DNA, 42 bp, Homo sapiens
  misc_feature 1..42: note = chr8:109095932-109095974
  misc_feature 1..42: note = hyper
  source 1..42: mol_type = genomic DNA
ctaaagccagaaacgtcccggtttccctgaggtcctaaagaa

SEQ ID NO: 52956 - DNA, 18 bp, Homo sapiens
  misc_feature 1..18: note = chr8:109799570-109799588
  misc_feature 1..18: note = hyper
  source 1..18: mol_type = genomic DNA
aggtacggatgtgtccgc

SEQ ID NO: 52957 - DNA, 15 bp, Homo sapiens
  misc_feature 1..15: note = chr8:109799888-109799903
  misc_feature 1..15: note = hyper
  source 1..15: mol_type = genomic DNA
cgggagttgtaggcc

SEQ ID NO: 52958 - DNA, 345 bp, Homo sapiens; identical to SEQ ID NO: 32238
  misc_feature 1..345: note = chr8:110703537-110703882
  misc_feature 1..345: note = hyper
  source 1..345: mol_type = genomic DNA

SEQ ID NO: 52959 - DNA, 65 bp, Homo sapiens; identical to SEQ ID NO: 32239
  misc_feature 1..65: note = chr8:110704189-110704254
  misc_feature 1..65: note = hyper
  source 1..65: mol_type = genomic DNA

SEQ ID NO: 52960 - DNA, 52 bp, Homo sapiens; identical to SEQ ID NO: 9735
  misc_feature 1..52: note = chr8:110986212-110986264
  misc_feature 1..52: note = hyper
  source 1..52: mol_type = genomic DNA

SEQ ID NO: 52961 - DNA, 115 bp, Homo sapiens; identical to SEQ ID NO: 20184
  misc_feature 1..115: note = chr8:110986328-110986443
  misc_feature 1..115: note = hyper
  source 1..115: mol_type = genomic DNA

SEQ ID NO: 52962 - DNA, 337 bp, Homo sapiens
  misc_feature 1..337: note = chr8:110986682-110987019
  misc_feature 1..337: note = hyper
  source 1..337: mol_type = genomic DNA
cgcgagggcggtggcacggcccctggtggcggccgggattccccgggctcccgaaggggttacctctccttggcgcaccctctccacccgctgtgcgccttcctcctcctgccgctagggagccgggagtgcgcggaagcagcgcacaagtggcagaaagaggagacagggagcagaggaagggtcgcgctaagagagaggatcaggtgaggtccaagcccgacacagtccctgtgcacactgccggtcgccctggcccttcccaaacgttgtcaccccgcctcccaacttcgcaattgcgattcccagcccaggaggtgtacagattgaatgactc

SEQ ID NO: 52963 - DNA, 202 bp, Homo sapiens; identical to SEQ ID NO: 9738
  misc_feature 1..202: note = chr8:110987020-110987222
  misc_feature 1..202: note = hyper
  source 1..202: mol_type = genomic DNA

SEQ ID NO: 52964 - DNA, 146 bp, Homo sapiens; identical to SEQ ID NO: 9739
  misc_feature 1..146: note = chr8:110987765-110987911
  misc_feature 1..146: note = hyper
  source 1..146: mol_type = genomic DNA

SEQ ID NO: 52965 - DNA, 15 bp, Homo sapiens
  misc_feature 1..15: note = chr8:114444379-114444394
  misc_feature 1..15: note = hyper
  source 1..15: mol_type = genomic DNA
ccaaccagatgattc

SEQ ID NO: 52966 - DNA, 34 bp, Homo sapiens; identical to SEQ ID NO: 32245
  misc_feature 1..34: note = chr8:114444481-114444515
  misc_feature 1..34: note = hyper
  source 1..34: mol_type = genomic DNA

SEQ ID NO: 52967 - DNA, 242 bp, Homo sapiens
  misc_feature 1..242: note = chr8:114445521-114445763
  misc_feature 1..242: note = hyper
  source 1..242: mol_type = genomic DNA
gttgggaaagactgtcgccttatgggcgaggactgtgggtgtcagtccccgggacacacgcggggctgaaagctccggacatggccacctgggcgggcgtctgtaaaaggtgctaatgagtgcctctggcagctcttccccctcataagacacccgcgcccctctccagtagcaactaactgcgggagaggatgcgatttccacttttccaaaagacctctgtggcaggagtagtatctcct

SEQ ID NO: 52968 - DNA, 80 bp, Homo sapiens
  misc_feature 1..80: note = chr8:114447368-114447448
  misc_feature 1..80: note = hyper
  source 1..80: mol_type = genomic DNA
gtaagcaacctgagccgtgctttgtacatttggcagtgtagttgtgccacttaggacaagcttttcggctcagagctgct

SEQ ID NO: 52969 - DNA, 32 bp, Homo sapiens; identical to SEQ ID NO: 32250
  misc_feature 1..32: note = chr8:114447789-114447821
  misc_feature 1..32: note = hyper
  source 1..32: mol_type = genomic DNA

SEQ ID NO: 52970 - DNA, 73 bp, Homo sapiens; identical to SEQ ID NO: 32251
  misc_feature 1..73: note = chr8:114448753-114448826
  misc_feature 1..73: note = hyper
  source 1..73: mol_type = genomic DNA

SEQ ID NO: 52971 - DNA, 148 bp, Homo sapiens
  misc_feature 1..148: note = chr8:114449402-114449550
  misc_feature 1..148: note = hyper
  source 1..148: mol_type = genomic DNA
cttgctttttttccccgaatagatcaattctgcctgtaaaagcagcccaagaaataatgttagtgagctctccgttgcaggctgcgaatacagaagcatgtcaaaggaatattttaatcggaggatctgtgttgcttttggggaaacc

SEQ ID NO: 52972 - DNA, 119 bp, Homo sapiens
  misc_feature 1..119: note = chr8:117950319-117950438
  misc_feature 1..119: note = hyper
  source 1..119: mol_type = genomic DNA
ctgggagcaaaggagcgtctctgaatggcggggcagttgcagcatcccacttggcaagggtccttgaattacctccgcccccgccctgaccccgccctaaacatcaaacttagaaactc

SEQ ID NO: 52973 - DNA, 315 bp, Homo sapiens
  misc_feature 1..315: note = chr8:117950468-117950783
  misc_feature 1..315: note = hyper
  source 1..315: mol_type = genomic DNA
caggcgtctccgcgatgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccc

SEQ ID NO: 52974 - DNA, 44 bp, Homo sapiens
  misc_feature 1..44: note = chr8:117950914-117950958
  misc_feature 1..44: note = hyper
  source 1..44: mol_type = genomic DNA
ctcaggtctggacacggcgttgacgcccccgcctccccagcatc

SEQ ID NO: 52975 - DNA, 107 bp, Homo sapiens; identical to SEQ ID NO: 32257
  misc_feature 1..107: note = chr8:120428615-120428722
  misc_feature 1..107: note = hyper
  source 1..107: mol_type = genomic DNA

SEQ ID NO: 52976 - DNA, 39 bp, Homo sapiens; identical to SEQ ID NO: 32258
  misc_feature 1..39: note = chr8:120429017-120429056
  misc_feature 1..39: note = hyper
  source 1..39: mol_type = genomic DNA

SEQ ID NO: 52977 - DNA, 30 bp, Homo sapiens; identical to SEQ ID NO: 32259
  misc_feature 1..30: note = chr8:121135998-121136028
  misc_feature 1..30: note = hyper
  source 1..30: mol_type = genomic DNA

SEQ ID NO: 52978 - DNA, 53 bp, Homo sapiens
  misc_feature 1..53: note = chr8:121136826-121136879
  misc_feature 1..53: note = hyper
  source 1..53: mol_type = genomic DNA
gcatcgctgctttggcgttttagagcccttggacttgttcacaagaggaagag

SEQ ID NO: 52979 - DNA, 42 bp, Homo sapiens; identical to SEQ ID NO: 32262
  misc_feature 1..42: note = chr8:122651743-122651785
  misc_feature 1..42: note = hyper
  source 1..42: mol_type = genomic DNA

SEQ ID NO: 52980 - DNA, 373 bp, Homo sapiens; identical to SEQ ID NO: 32263
  misc_feature 1..373: note = chr8:122652029-122652402
  misc_feature 1..373: note = hyper
  source 1..373: mol_type = genomic DNA

SEQ ID NO: 52981 - DNA, 151 bp, Homo sapiens; identical to SEQ ID NO: 20196
  misc_feature 1..151: note = chr8:124173095-124173246
  misc_feature 1..151: note = hyper
  source 1..151: mol_type = genomic DNA

SEQ ID NO: 52982 - DNA, 30 bp, Homo sapiens; identical to SEQ ID NO: 32265
  misc_feature 1..30: note = chr8:124934797-124934827
  misc_feature 1..30: note = hyper
  source 1..30: mol_type = genomic DNA

SEQ ID NO: 52983 - DNA, 30 bp, Homo sapiens; identical to SEQ ID NO: 32266
  misc_feature 1..30: note = chr8:126400946-126400976
  misc_feature 1..30: note = hyper
  source 1..30: mol_type = genomic DNA

SEQ ID NO: 52984 - DNA, 164 bp, Homo sapiens; identical to SEQ ID NO: 32267
  misc_feature 1..164: note = chr8:131455233-131455397
  misc_feature 1..164: note = hyper
  source 1..164: mol_type = genomic DNA

SEQ ID NO: 52985 - DNA, 476 bp, Homo sapiens; identical to SEQ ID NO: 32268
  misc_feature 1..476: note = chr8:131455603-131456079
  misc_feature 1..476: note = hyper
  source 1..476: mol_type = genomic DNA

SEQ ID NO: 52986 - DNA, 213 bp, Homo sapiens
  misc_feature 1..213: note = chr8:132051934-132052147
  misc_feature 1..213: note = hyper
  source 1..213: mol_type = genomic DNA
caggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagccccc

SEQ ID NO: 52987 - DNA, 324 bp, Homo sapiens; identical to SEQ ID NO: 32272
  misc_feature 1..324: note = chr8:132053217-132053541
  misc_feature 1..324: note = hyper
  source 1..324: mol_type = genomic DNA

SEQ ID NO: 52988 - DNA, 13 bp, Homo sapiens
  misc_feature 1..13: note = chr8:132054785-132054798
  misc_feature 1..13: note = hyper
  source 1..13: mol_type = genomic DNA
ccccctcagtccc

SEQ ID NO: 52989 - DNA, 312 bp, Homo sapiens; identical to SEQ ID NO: 32275
  misc_feature 1..312: note = chr8:133492319-133492631
  misc_feature 1..312: note = hyper
  source 1..312: mol_type = genomic DNA

SEQ ID NO: 52990 - DNA, 182 bp, Homo sapiens; identical to SEQ ID NO: 32276
  misc_feature 1..182: note = chr8:133492712-133492894
  misc_feature 1..182: note = hyper
  source 1..182: mol_type = genomic DNA

SEQ ID NO: 52991 - DNA, 135 bp, Homo sapiens; identical to SEQ ID NO: 32277
  misc_feature 1..135: note = chr8:133493617-133493752
  misc_feature 1..135: note = hyper
  source 1..135: mol_type = genomic DNA

SEQ ID NO: 52992 - DNA, 30 bp, Homo sapiens; identical to SEQ ID NO: 32278
  misc_feature 1..30: note = chr8:134581243-134581273
  misc_feature 1..30: note = hyper
  source 1..30: mol_type = genomic DNA

SEQ ID NO: 52993 - DNA, 48 bp, Homo sapiens
  misc_feature 1..48: note = chr8:139509693-139509741
  misc_feature 1..48: note = hyper
  source 1..48: mol_type = genomic DNA
cggggctcccctctcgagccaagaccccaggcctcgggcaggaaaagg

SEQ ID NO: 52994 - DNA, 30 bp, Homo sapiens; identical to SEQ ID NO: 9766
  misc_feature 1..30: note = chr8:139926700-139926730
  misc_feature 1..30: note = hyper
  source 1..30: mol_type = genomic DNA

SEQ ID NO: 52995 - DNA, 65 bp, Homo sapiens; identical to SEQ ID NO: 32282
  misc_feature 1..65: note = chr8:140643383-140643448
  misc_feature 1..65: note = hyper
  source 1..65: mol_type = genomic DNA

SEQ ID NO: 52996 - DNA, 250 bp, Homo sapiens; identical to SEQ ID NO: 20204
  misc_feature 1..250: note = chr8:140715219-140715469
  misc_feature 1..250: note = hyper
  source 1..250: mol_type = genomic DNA

SEQ ID NO: 52997 - DNA, 266 bp, Homo sapiens
  misc_feature 1..266: note = chr8:140715699-140715965
  misc_feature 1..266: note = hyper
  source 1..266: mol_type = genomic DNA
cgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcg

SEQ ID NO: 52998 - DNA, 498 bp, Homo sapiens; identical to SEQ ID NO: 32287
  misc_feature 1..498: note = chr8:140716681-140717179
  misc_feature 1..498: note = hyper
  source 1..498: mol_type = genomic DNA

SEQ ID NO: 52999 - DNA, 137 bp, Homo sapiens; identical to SEQ ID NO: 32288
  misc_feature 1..137: note = chr8:140717239-140717376
  misc_feature 1..137: note = hyper
  source 1..137: mol_type = genomic DNA

SEQ ID NO: 53000 - DNA, 153 bp, Homo sapiens; identical to SEQ ID NO: 32289
  misc_feature 1..153: note = chr8:140717707-140717860
  misc_feature 1..153: note = hyper
  source 1..153: mol_type = genomic DNA

SEQ ID NO: 53001 - DNA, 188 bp, Homo sapiens
  misc_feature 1..188: note = chr8:142528212-142528400
  misc_feature 1..188: note = hyper
  source 1..188: mol_type = genomic DNA
ctggccacctctcttcgcgcccggcctcctggtctcccgcctgcgcgggccgctcccggccctccccgccctgccgggcgttcactgtcccctccgcccgcaggtcccgcggcgcccccggagcccgccttcccggacatctacggcggggacgcgcagctctgggaggcgcatttccgcggcatcgg

SEQ ID NO: 53002 - DNA, 15 bp, Homo sapiens
  misc_feature 1..15: note = chr8:142529027-142529042
  misc_feature 1..15: note = hyper
  source 1..15: mol_type = genomic DNA
cggaggcaggccctc

SEQ ID NO: 53003 - DNA, 235 bp, Homo sapiens; identical to SEQ ID NO: 32295
  misc_feature 1..235: note = chr8:143530528-143530763
  misc_feature 1..235: note = hyper
  source 1..235: mol_type = genomic DNA

SEQ ID NO: 53004 - DNA, 751 bp, Homo sapiens; identical to SEQ ID NO: 32296
  misc_feature 1..751: note = chr8:143531020-143531771
  misc_feature 1..751: note = hyper
  source 1..751: mol_type = genomic DNA

SEQ ID NO: 53005 - DNA, 126 bp, Homo sapiens
  misc_feature 1..126: note = chr8:143531996-143532122
  misc_feature 1..126: note = hyper
  source 1..126: mol_type = genomic DNA
gacgtcctccccccacgcacagagctcggggcaggcaggagaaaaccccagactccttctcgaagccctcgctcgtagaagccctcgcctgtagacctggcattggcagtggagactccctggagg

SEQ ID NO: 53006 - DNA, 653 bp, Homo sapiens; identical to SEQ ID NO: 20213
  misc_feature 1..653: note = chr8:143532846-143533499
  misc_feature 1..653: note = hyper
  source 1..653: mol_type = genomic DNA

SEQ ID NO: 53007 - DNA, 111 bp, Homo sapiens; identical to SEQ ID NO: 20214
  misc_feature 1..111: note = chr8:143533500-143533611
  misc_feature 1..111: note = hyper
  source 1..111: mol_type = genomic DNA

SEQ ID NO: 53008 - DNA, 299 bp, Homo sapiens
  misc_feature 1..299: note = chr8:143533906-143534205
  misc_feature 1..299: note = hyper
  source 1..299: mol_type = genomic DNA
cgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctcca

SEQ ID NO: 53009 - DNA, 304 bp, Homo sapiens; identical to SEQ ID NO: 32301
  misc_feature 1..304: note = chr8:143534453-143534757
  misc_feature 1..304: note = hyper
  source 1..304: mol_type = genomic DNA

SEQ ID NO: 53010 - DNA, 255 bp, Homo sapiens; identical to SEQ ID NO: 32302
  misc_feature 1..255: note = chr8:143591552-143591807
  misc_feature 1..255: note = hyper
  source 1..255: mol_type = genomic DNA

SEQ ID NO: 53011 - DNA, 156 bp, Homo sapiens; identical to SEQ ID NO: 32303
  misc_feature 1..156: note = chr8:143591888-143592044
  misc_feature 1..156: note = hyper
  source 1..156: mol_type = genomic DNA

SEQ ID NO: 53012 - DNA, 178 bp, Homo sapiens; identical to SEQ ID NO: 32304
  misc_feature 1..178: note = chr8:143592101-143592279
  misc_feature 1..178: note = hyper
  source 1..178: mol_type = genomic DNA

SEQ ID NO: 53013 - DNA, 221 bp, Homo sapiens; identical to SEQ ID NO: 32305
  misc_feature 1..221: note = chr8:143592358-143592579
  misc_feature 1..221: note = hyper
  source 1..221: mol_type = genomic DNA

SEQ ID NO: 53014 - DNA, 200 bp, Homo sapiens; identical to SEQ ID NO: 32307
  misc_feature 1..200: note = chr8:143695463-143695663
  misc_feature 1..200: note = hyper
  source 1..200: mol_type = genomic DNA

SEQ ID NO: 53015 - DNA, 37 bp, Homo sapiens
  misc_feature 1..37: note = chr8:143858699-143858736
  misc_feature 1..37: note = hyper
  source 1..37: mol_type = genomic DNA
agcgcgagctcaccgcaggccccgccccaggcctgcc

SEQ ID NO: 53016 - DNA, 45 bp, Homo sapiens; identical to SEQ ID NO: 9788
  misc_feature 1..45: note = chr8:143859143-143859188
  misc_feature 1..45: note = hyper
  source 1..45: mol_type = genomic DNA

SEQ ID NO: 53017 - DNA, 56 bp, Homo sapiens; identical to SEQ ID NO: 32310
  misc_feature 1..56: note = chr8:144099611-144099667
  misc_feature 1..56: note = hyper
  source 1..56: mol_type = genomic DNA

SEQ ID NO: 53018 - DNA, 147 bp, Homo sapiens; identical to SEQ ID NO: 20220
  misc_feature 1..147: note = chr8:144241287-144241434
  misc_feature 1..147: note = hyper
  source 1..147: mol_type = genomic DNA

SEQ ID NO: 53019 - DNA, 87 bp, Homo sapiens; identical to SEQ ID NO: 3378
  misc_feature 1..87: note = chr8:144241435-144241522
  misc_feature 1..87: note = hyper
  source 1..87: mol_type = genomic DNA

SEQ ID NO: 53020 - DNA, 120 bp, Homo sapiens; identical to SEQ ID NO: 32313
  misc_feature 1..120: note = chr8:144241583-144241703
  misc_feature 1..120: note = hyper
  source 1..120: mol_type = genomic DNA

SEQ ID NO: 53021 - DNA, 114 bp, Homo sapiens
  misc_feature 1..114: note = chr8:144241757-144241871
  misc_feature 1..114: note = hyper
  source 1..114: mol_type = genomic DNA
cggggcggagccggggcgggggccgcgcggggggcgggggcggctgggagacgcgcggggcggggggcgcccggggctcgcggcccccacgcaggtagctggcccgggccctcc

SEQ ID NO: 53022 - DNA, 131 bp, Homo sapiens
  misc_feature 1..131: note = chr8:144328190-144328321
  misc_feature 1..131: note = hyper
  source 1..131: mol_type = genomic DNA
gctgggagcacatcccggaggggctgcctgcggcgggaggagcggcaggggccacgtggtgggggacggctcgccagggcgcgcacgcggtggcggcggcggtggaggcgttgcccgcctagctaggggcc

SEQ ID NO: 53023 - DNA, 31 bp, Homo sapiens
  misc_feature 1..31: note = chr8:144328565-144328596
  misc_feature 1..31: note = hyper
  source 1..31: mol_type = genomic DNA
tggtgggcgcagcctacgtgacagggtcggc

SEQ ID NO: 53024 - DNA, 49 bp, Homo sapiens; identical to SEQ ID NO: 32316
  misc_feature 1..49: note = chr8:144490051-144490100
  misc_feature 1..49: note = hyper
  source 1..49: mol_type = genomic DNA

SEQ ID NO: 53025 - DNA, 112 bp, Homo sapiens; identical to SEQ ID NO: 32317
  misc_feature 1..112: note = chr8:144503380-144503492
  misc_feature 1..112: note = hyper
  source 1..112: mol_type = genomic DNA

SEQ ID NO: 53026 - DNA, 50 bp, Homo sapiens; identical to SEQ ID NO: 32318
  misc_feature 1..50: note = chr8:144509068-144509118
  misc_feature 1..50: note = hyper
  source 1..50: mol_type = genomic DNA

SEQ ID NO: 53027 - DNA, 696 bp, Homo sapiens
  misc_feature 1..696: note = chr8:144510529-144511225
  misc_feature 1..696: note = hyper
  source 1..696: mol_type = genomic DNA
agattccacaaacaaaacgaaacacaatttaaattaaaataaaaacactttctccacccgccccatgccagaaggctctggcccaagcctcctcttaaaaaaaaaaattttctgctagaaatactgtgcattacttttttctttcacttctcttgaaggttaaaacaagatgtatttccccaggagttacagatatgttctggtgcatagagagacagcagctcgggatccgggccagcccccacccgactgagcacaggactcacccccctccccccacccccggttgagcatagtaggacagcaggcctggacacagcacgggtgacgtccctggcttcgacctccaaggaacgccggtagcagggtcgggggcaagcggggagggggcaggcaggggccgggcccctcctggcgagcgactcatgctgtgactcgcgactgagggcggaccccggctggggaaagaaggggcttcctccaaggttttcttttctaatcaccaagcataataattataaatacttcgaaaataagaccgattttaaaacggggaggggaagttaaaaaaggcaaggaaagggaggctgagaagagaacgaaggagggcgggggcaggcaggggccacccgggaagggacggcagcgcggtccctctaggctggcagggcgaaggtgggaacggagaaccacgtt

SEQ ID NO: 53028 - DNA, 617 bp, Homo sapiens; identical to SEQ ID NO: 20229
  misc_feature 1..617: note = chr8:144511424-144512041
  misc_feature 1..617: note = hyper
  source 1..617: mol_type = genomic DNA

SEQ ID NO: 53029 - DNA, 180 bp, Homo sapiens
  misc_feature 1..180: note = chr8:144512192-144512372
  misc_feature 1..180: note = hyper
  source 1..180: mol_type = genomic DNA
ggggttgaggtgatgctggtagccgctcatccagtacagatcctccagcgccggcttccccgaggtgcccccgacggcgccggggcccccgctcggcggcccgggggcgcccccggcctgagacgagccgccgccgccccccgcgccgccgccgccgccggtgcccgggctgggcgcgca

SEQ ID NO: 53030 - DNA, 226 bp, Homo sapiens; identical to SEQ ID NO: 32320
  misc_feature 1..226: note = chr8:144650887-144651113
  misc_feature 1..226: note = hyper
  source 1..226: mol_type = genomic DNA

SEQ ID NO: 53031 - DNA, 210 bp, Homo sapiens; identical to SEQ ID NO: 32321
  misc_feature 1..210: note = chr8:144651759-144651969
  misc_feature 1..210: note = hyper
  source 1..210: mol_type = genomic DNA

SEQ ID NO: 53032 - DNA, 154 bp, Homo sapiens; identical to SEQ ID NO: 32322
  misc_feature 1..154: note = chr8:145700252-145700406
  misc_feature 1..154: note = hyper
  source 1..154: mol_type = genomic DNA

SEQ ID NO: 53033 - DNA, 194 bp, Homo sapiens; identical to SEQ ID NO: 32323
  misc_feature 1..194: note = chr8:145700607-145700801
  misc_feature 1..194: note = hyper
  source 1..194: mol_type = genomic DNA

SEQ ID NO: 53034 - DNA, 62 bp, Homo sapiens; identical to SEQ ID NO: 32324
  misc_feature 1..62: note = chr8:145806186-145806248
  misc_feature 1..62: note = hyper
  source 1..62: mol_type = genomic DNA

SEQ ID NO: 53035 - DNA, 131 bp, Homo sapiens; identical to SEQ ID NO: 32325
  misc_feature 1..131: note = chr8:145925298-145925429
  misc_feature 1..131: note = hyper
  source 1..131: mol_type = genomic DNA

SEQ ID NO: 53036 - skipped

SEQ ID NO: 53037 - DNA, 154 bp, Homo sapiens
  misc_feature 1..154: note = chr8:145925491-145925645
  misc_feature 1..154: note = hyper
  source 1..154: mol_type = genomic DNA
ctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctga

SEQ ID NO: 53038 - DNA, 83 bp, Homo sapiens; identical to SEQ ID NO: 32327
  misc_feature 1..83: note = chr9:73223-73306
  misc_feature 1..83: note = hyper
  source 1..83: mol_type = genomic DNA

SEQ ID NO: 53039 - DNA, 31 bp, Homo sapiens
  misc_feature 1..31: note = chr9:113402-113433
  misc_feature 1..31: note = hyper
  source 1..31: mol_type = genomic DNA
accttcgccccaggccggcgcagcccagctt

SEQ ID NO: 53040 - DNA, 294 bp, Homo sapiens
  misc_feature 1..294: note = chr9:113556-113850
  misc_feature 1..294: note = hyper
  source 1..294: mol_type = genomic DNA
cccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactg

SEQ ID NO: 53041 - DNA, 269 bp, Homo sapiens; identical to SEQ ID NO: 20236
  misc_feature 1..269: note = chr9:113885-114154
  misc_feature 1..269: note = hyper
  source 1..269: mol_type = genomic DNA

SEQ ID NO: 53042 - DNA, 130 bp, Homo sapiens; identical to SEQ ID NO: 32330
  misc_feature 1..130: note = chr9:114722-114852
  misc_feature 1..130: note = hyper
  source 1..130: mol_type = genomic DNA

SEQ ID NO: 53043 - DNA, 12 bp, Homo sapiens
  misc_feature 1..12: note = chr9:117872-117884
  misc_feature 1..12: note = hyper
  source 1..12: mol_type = genomic DNA
caaactctgagg

SEQ ID NO: 53044 - DNA, 277 bp, Homo sapiens; identical to SEQ ID NO: 32332
  misc_feature 1..277: note = chr9:214944-215221
  misc_feature 1..277: note = hyper
  source 1..277: mol_type = genomic DNA

SEQ ID NO: 53045 - DNA, 39 bp, Homo sapiens; identical to SEQ ID NO: 32333
  misc_feature 1..39: note = chr9:841367-841406
  misc_feature 1..39: note = hyper
  source 1..39: mol_type = genomic DNA

SEQ ID NO: 53046 - DNA, 242 bp, Homo sapiens
  misc_feature 1..242: note = chr9:841449-841691
  misc_feature 1..242: note = hyper
  source 1..242: mol_type = genomic DNA
cgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacc

SEQ ID NO: 53047 - skipped

SEQ ID NO: 53048 - DNA, 75 bp, Homo sapiens
  misc_feature 1..75: note = chr9:842673-842748
  misc_feature 1..75: note = hyper
  source 1..75: mol_type = genomic DNA
ctgggagcgccggagacgcgtctgatcccgcccgccgggcagagttgcgggcttcgctcggctcggggttcccca

SEQ ID NO: 53049 - DNA, 186 bp, Homo sapiens; identical to SEQ ID NO: 32339
  misc_feature 1..186: note = chr9:842779-842965
  misc_feature 1..186: note = hyper
  source 1..186: mol_type = genomic DNA

SEQ ID NO: 53050 - DNA, 518 bp, Homo sapiens; identical to SEQ ID NO: 32340
  misc_feature 1..518: note = chr9:843202-843720
  misc_feature 1..518: note = hyper
  source 1..518: mol_type = genomic DNA

SEQ ID NO: 53051 - DNA, 29 bp, Homo sapiens
  misc_feature 1..29: note = chr9:969586-969615
  misc_feature 1..29: note = hyper
  source 1..29: mol_type = genomic DNA
ctgcggccgcgcggggaatggagccggac

SEQ ID NO: 53052 - DNA, 121 bp, Homo sapiens
  misc_feature 1..121: note = chr9:969667-969788
  misc_feature 1..121: note = hyper
  source 1..121: mol_type = genomic DNA
cgcgcccaccttgccggcgtgttcgcgggcccctgcccactgccccccctctttctttaggtctggcttttgaggatcccggagtcttgcagctcccgccattccgcagataacctccgca

SEQ ID NO: 53053 - DNA, 250 bp, Homo sapiens
  misc_feature 1..250: note = chr9:969846-970096
  misc_feature 1..250: note = hyper
  source 1..250: mol_type = genomic DNA
agtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttc

SEQ ID NO: 53054 - DNA, 372 bp, Homo sapiens
  misc_feature 1..372: note = chr9:970525-970897
  misc_feature 1..372: note = hyper
  source 1..372: mol_type = genomic DNA
gtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttg

SEQ ID NO: 53055 - DNA, 142 bp, Homo sapiens; identical to SEQ ID NO: 32346
  misc_feature 1..142: note = chr9:971939-972081
  misc_feature 1..142: note = hyper
  source 1..142: mol_type = genomic DNA

SEQ ID NO: 53056 - DNA, 262 bp, Homo sapiens
  misc_feature 1..262: note = chr9:972759-973021
  misc_feature 1..262: note = hyper
  source 1..262: mol_type = genomic DNA
cctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcc

SEQ ID NO: 53057 - DNA, 43 bp, Homo sapiens; identical to SEQ ID NO: 32349
  misc_feature 1..43: note = chr9:973762-973805
  misc_feature 1..43: note = hyper
  source 1..43: mol_type = genomic DNA

SEQ ID NO: 53058 - DNA, 297 bp, Homo sapiens
  misc_feature 1..297: note = chr9:976321-976618
  misc_feature 1..297: note = hyper
  source 1..297: mol_type = genomic DNA
cttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcgg

SEQ ID NO: 53059 - DNA, 34 bp, Homo sapiens; identical to SEQ ID NO: 32352
  misc_feature 1..34: note = chr9:977171-977205
  misc_feature 1..34: note = hyper
  source 1..34: mol_type = genomic DNA

SEQ ID NO: 53060 - DNA, 159 bp, Homo sapiens; identical to SEQ ID NO: 32353
  misc_feature 1..159: note = chr9:977422-977581
  misc_feature 1..159: note = hyper
  source 1..159: mol_type = genomic DNA

SEQ ID NO: 53061 - DNA, 13 bp, Homo sapiens
  misc_feature 1..13: note = chr9:981830-981843
  misc_feature 1..13: note = hyper
  source 1..13: mol_type = genomic DNA
gctctttccttgg

SEQ ID NO: 53062 - DNA, 76 bp, Homo sapiens; identical to SEQ ID NO: 20247
  misc_feature 1..76: note = chr9:1042326-1042402
  misc_feature 1..76: note = hyper
  source 1..76: mol_type = genomic DNA

SEQ ID NO: 53063 - DNA, 76 bp, Homo sapiens; identical to SEQ ID NO: 32357
  misc_feature 1..76: note = chr9:1051563-1051639
  misc_feature 1..76: note = hyper
  source 1..76: mol_type = genomic DNA

SEQ ID NO: 53064 - DNA, 152 bp, Homo sapiens; identical to SEQ ID NO: 20248
  misc_feature 1..152: note = chr9:1052166-1052318
  misc_feature 1..152: note = hyper
  source 1..152: mol_type = genomic DNA

SEQ ID NO: 53065 - DNA, 380 bp, Homo sapiens; identical to SEQ ID NO: 32359
  misc_feature 1..380: note = chr9:2621312-2621692
  misc_feature 1..380: note = hyper
  source 1..380: mol_type = genomic DNA

SEQ ID NO: 53066 - DNA, 44 bp, Homo sapiens; identical to SEQ ID NO: 32360
  misc_feature 1..44: note = chr9:2622978-2623022
  misc_feature 1..44: note = hyper
  source 1..44: mol_type = genomic DNA

SEQ ID NO: 53067 - DNA, 30 bp, Homo sapiens; identical to SEQ ID NO: 32361
  misc_feature 1..30: note = chr9:3181153-3181183
  misc_feature 1..30: note = hyper
  source 1..30: mol_type = genomic DNA

SEQ ID NO: 53068 - DNA, 179 bp, Homo sapiens; identical to SEQ ID NO: 20249
  misc_feature 1..179: note = chr9:3181573-3181752
  misc_feature 1..179: note = hyper
  source 1..179: mol_type = genomic DNA

SEQ ID NO: 53069 - DNA, 11 bp, Homo sapiens
  misc_feature 1..11: note = chr9:3181869-3181880
  misc_feature 1..11: note = hyper
  source 1..11: mol_type = genomic DNA
ctttgcctgag

SEQ ID NO: 53070 - DNA, 30 bp, Homo sapiens; identical to SEQ ID NO: 9829
  misc_feature 1..30: note = chr9:4299034-4299064
  misc_feature 1..30: note = hyper
  source 1..30: mol_type = genomic DNA

SEQ ID NO: 53071 - DNA, 58 bp, Homo sapiens; identical to SEQ ID NO: 9830
  misc_feature 1..58: note = chr9:4299348-4299406
  misc_feature 1..58: note = hyper
  source 1..58: mol_type = genomic DNA

SEQ ID NO: 53072 - DNA, 58 bp, Homo sapiens; identical to SEQ ID NO: 32365
  misc_feature 1..58: note = chr9:4299639-4299697
  misc_feature 1..58: note = hyper
  source 1..58: mol_type = genomic DNA

SEQ ID NO: 53073 - DNA, 189 bp, Homo sapiens; identical to SEQ ID NO: 32366
  misc_feature 1..189: note = chr9:4299943-4300132
  misc_feature 1..189: note = hyper
  source 1..189: mol_type = genomic DNA

SEQ ID NO: 53074 - DNA, 91 bp, Homo sapiens
  misc_feature 1..91: note = chr9:6412809-6412900
  misc_feature 1..91: note = hyper
  source 1..91: mol_type = genomic DNA
cccctttccaggattatacaagtgcacgccagggtttcttatttttggtgtgtttttgagaccaaagaaccatatccgctaagcctgagga

SEQ ID NO: 53075 - DNA, 118 bp, Homo sapiens
  misc_feature 1..118: note = chr9:6644899-6645017
  misc_feature 1..118: note = hyper
  source 1..118: mol_type = genomic DNA
gatttcagttgcaaccggagctaaccggtaagcccactcttaatcagggggtcttcctcctcttgcaaagtttaggtccatccacagggccacttgggctgggggtggtttaaaaatg

SEQ ID NO: 53076 - DNA, 292 bp, Homo sapiens
  misc_feature 1..292: note = chr9:6645333-6645625
  misc_feature 1..292: note = hyper
  source 1..292: mol_type = genomic DNA
ggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggcc

SEQ ID NO: 53077 - DNA, 451 bp, Homo sapiens
  misc_feature 1..451: note = chr9:6645700-6646151
  misc_feature 1..451: note = hyper
  source 1..451: mol_type = genomic DNA
ccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctgggggactcggcggagatggaagatgattctcgaagctctccatttccttaattttgaggtatctttctctgtcacatttcatctcagggaaattaatatgggcagatggcggttcttttatctt

SEQ ID NO: 53078 - DNA, 37 bp, Homo sapiens; identical to SEQ ID NO: 32371
  misc_feature 1..37: note = chr9:6704532-6704569
  misc_feature 1..37: note = hyper
  source 1..37: mol_type = genomic DNA

SEQ ID NO: 53079 - DNA, 43 bp, Homo sapiens; identical to SEQ ID NO: 32372
  misc_feature 1..43: note = chr9:8857443-8857486
  misc_feature 1..43: note = hyper
  source 1..43: mol_type = genomic DNA

SEQ ID NO: 53080 - DNA, 147 bp, Homo sapiens; identical to SEQ ID NO: 32373
  misc_feature 1..147: note = chr9:8857685-8857832
  misc_feature 1..147: note = hyper
  source 1..147: mol_type = genomic DNA

SEQ ID NO: 53081 - DNA, 363 bp, Homo sapiens; identical to SEQ ID NO: 32374
  misc_feature 1..363: note = chr9:8858327-8858690
  misc_feature 1..363: note = hyper
  source 1..363: mol_type = genomic DNA

SEQ ID NO: 53082 - DNA, 123 bp, Homo sapiens; identical to SEQ ID NO: 32375
  misc_feature 1..123: note = chr9:10612684-10612807
  misc_feature 1..123: note = hyper
  source 1..123: mol_type = genomic DNA

SEQ ID NO: 53083 - skipped

SEQ ID NO: 53084 - DNA, 100 bp, Homo sapiens; identical to SEQ ID NO: 32377
  misc_feature 1..100: note = chr9:12775664-12775764
  misc_feature 1..100: note = hyper
  source 1..100: mol_type = genomic DNA

SEQ ID NO: 53085 - DNA, 70 bp, Homo sapiens; identical to SEQ ID NO: 20260
  misc_feature 1..70: note = chr9:13278748-13278818
  misc_feature 1..70: note = hyper
  source 1..70: mol_type = genomic DNA

SEQ ID NO: 53086 - DNA, 92 bp, Homo sapiens
  misc_feature 1..92: note = chr9:13278864-13278956
  misc_feature 1..92: note = hyper
  source 1..92: mol_type = genomic DNA
gcggatggggcgtccgggagcggcccctgcaggggagagcaacaggctcccgcgccctggaggcctggtctgcgctccgggcccccaggcta

SEQ ID NO: 53087 - DNA, 44 bp, Homo sapiens; identical to SEQ ID NO: 32379
  misc_feature 1..44: note = chr9:13279362-13279406
  misc_feature 1..44: note = hyper
  source 1..44: mol_type = genomic DNA

SEQ ID NO: 53088 - DNA, 116 bp, Homo sapiens; identical to SEQ ID NO: 32380
  misc_feature 1..116: note = chr9:13279633-13279749
  misc_feature 1..116: note = hyper
  source 1..116: mol_type = genomic DNA

SEQ ID NO: 53089 - DNA, 207 bp, Homo sapiens; identical to SEQ ID NO: 20263
  misc_feature 1..207: note = chr9:14348107-14348314
  misc_feature 1..207: note = hyper
  source 1..207: mol_type = genomic DNA

SEQ ID NO: 53090 - skipped

SEQ ID NO: 53091 - DNA, 26 bp, Homo sapiens
  misc_feature 1..26: note = chr9:16154745-16154771
  misc_feature 1..26: note = hyper
  source 1..26: mol_type = genomic DNA
cggcccggggacggcagggggcggct

SEQ ID NO: 53092 - DNA, 52 bp, Homo sapiens; identical to SEQ ID NO: 32385
  misc_feature 1..52: note = chr9:16870273-16870325
  misc_feature 1..52: note = hyper
  source 1..52: mol_type = genomic DNA

SEQ ID NO: 53093 - DNA, 463 bp, Homo sapiens; identical to SEQ ID NO: 32386
  misc_feature 1..463: note = chr9:16870661-16871124
  misc_feature 1..463: note = hyper
  source 1..463: mol_type = genomic DNA

SEQ ID NO: 53094 - DNA, 236 bp, Homo sapiens; identical to SEQ ID NO: 32387
  misc_feature 1..236: note = chr9:16871415-16871651
  misc_feature 1..236: note = hyper
  source 1..236: mol_type = genomic DNA

SEQ ID NO: 53095 - DNA, 30 bp, Homo sapiens; identical to SEQ ID NO: 32388
  misc_feature 1..30: note = chr9:16872003-16872033
  misc_feature 1..30: note = hyper
  source 1..30: mol_type = genomic DNA

SEQ ID NO: 53096 - DNA, 341 bp, Homo sapiens; identical to SEQ ID NO: 32389
  misc_feature 1..341: note = chr9:17135041-17135382
  misc_feature 1..341: note = hyper
  source 1..341: mol_type = genomic DNA

SEQ ID NO: 53097 - DNA, 87 bp, Homo sapiens; identical to SEQ ID NO: 32390
  misc_feature 1..87: note = chr9:17135632-17135719
  misc_feature 1..87: note = hyper
  source 1..87: mol_type = genomic DNA

SEQ ID NO: 53098 - DNA, 586 bp, Homo sapiens; identical to SEQ ID NO: 32391
  misc_feature 1..586: note = chr9:17578706-17579292
  misc_feature 1..586: note = hyper
  source 1..586: mol_type = genomic DNA

SEQ ID NO: 53099 - DNA, 297 bp, Homo sapiens; identical to SEQ ID NO: 32392
  misc_feature 1..297: note = chr9:17579402-17579699
  misc_feature 1..297: note = hyper
  source 1..297: mol_type = genomic DNA

SEQ ID NO: 53100 - DNA, 91 bp, Homo sapiens; identical to SEQ ID NO: 32393
  misc_feature 1..91: note = chr9:17906058-17906149
  misc_feature 1..91: note = hyper
  source 1..91: mol_type = genomic DNA

SEQ ID NO: 53101 - DNA, 22 bp, Homo sapiens
  misc_feature 1..22: note = chr9:17907061-17907083
  misc_feature 1..22: note = hyper
  source 1..22: mol_type = genomic DNA
caagtggcgcggggttggggct

SEQ ID NO: 53102 - DNA, 25 bp, Homo sapiens
  misc_feature 1..25: note = chr9:17907346-17907371
  misc_feature 1..25: note = hyper
  source 1..25: mol_type = genomic DNA
actcctccacacttccgcccttctg

SEQ ID NO: 53103 - DNA, 29 bp, Homo sapiens
  misc_feature 1..29: note = chr9:17907472-17907501
  misc_feature 1..29: note = hyper
  source 1..29: mol_type = genomic DNA
ccctggtgcctccgcggtctagaggtggc

SEQ ID NO: 53104 - DNA, 130 bp, Homo sapiens; identical to SEQ ID NO: 32399
  misc_feature 1..130: note = chr9:19127231-19127361
  misc_feature 1..130: note = hyper
  source 1..130: mol_type = genomic DNA

SEQ ID NO: 53105 - DNA, 547 bp, Homo sapiens; identical to SEQ ID NO: 32400
  misc_feature 1..547: note = chr9:19788355-19788902
  misc_feature 1..547: note = hyper
  source 1..547: mol_type = genomic DNA

SEQ ID NO: 53106 - DNA, 173 bp, Homo sapiens
  misc_feature 1..173: note = chr9:19788934-19789107
  misc_feature 1..173: note = hyper
  source 1..173: mol_type = genomic DNA
cgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgc

SEQ ID NO: 53107 - DNA, 322 bp, Homo sapiens
  misc_feature 1..322: note = chr9:21031412-21031734
  misc_feature 1..322: note = hyper
  source 1..322: mol_type = genomic DNA
aggggtgcctgggcacggtagcgctgcgccttgctggcgggcggggggtgccgcccgcccgcccgccgcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttg

SEQ ID NO: 53108 - DNA, 315 bp, Homo sapiens; identical to SEQ ID NO: 32403
  misc_feature 1..315: note = chr9:21395999-21396314
  misc_feature 1..315: note = hyper
  source 1..315: mol_type = genomic DNA

SEQ ID NO: 53109 - DNA, 46 bp, Homo sapiens
  misc_feature 1..46: note = chr9:21402571-21402617
  misc_feature 1..46: note = hyper
  source 1..46: mol_type = genomic DNA
cgccccagggtccagcgtgtccccttccccaagacgtccccgccct

SEQ ID NO: 53110 - DNA, 125 bp, Homo sapiens; identical to SEQ ID NO: 20276
  misc_feature 1..125: note = chr9:21403021-21403146
  misc_feature 1..125: note = hyper
  source 1..125: mol_type = genomic DNA

SEQ ID NO: 53111 - DNA, 134 bp, Homo sapiens; identical to SEQ ID NO: 32405
  misc_feature 1..134: note = chr9:21559984-21560118
  misc_feature 1..134: note = hyper
  source 1..134: mol_type = genomic DNA

SEQ ID NO: 53112 - DNA, 114 bp, Homo sapiens
  misc_feature 1..114: note = chr9:21964943-21965057
  misc_feature 1..114: note = hyper
  source 1..114: mol_type = genomic DNA
tgagacacgtgagatctggaaggaggtggaggtgaagaccctcccacctggcctgcatccagagtacttggggtgtggcactggcgtgggccccaggaaggatcccagccagtt

SEQ ID NO: 53113 - skipped

SEQ ID NO: 53114 - DNA, 35 bp, Homo sapiens; identical to SEQ ID NO: 32408
  misc_feature 1..35: note = chr9:21967367-21967402
  misc_feature 1..35: note = hyper
  source 1..35: mol_type = genomic DNA

SEQ ID NO: 53115 - DNA, 220 bp, Homo sapiens
  misc_feature 1..220: note = chr9:21968475-21968695
  misc_feature 1..220: note = hyper
  source 1..220: mol_type = genomic DNA
ggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctgg

SEQ ID NO: 53116 - DNA, 92 bp, Homo sapiens; identical to SEQ ID NO: 32411
  misc_feature 1..92: note = chr9:21969169-21969261
  misc_feature 1..92: note = hyper
  source 1..92: mol_type = genomic DNA

SEQ ID NO: 53117 - DNA, 141 bp, Homo sapiens; identical to SEQ ID NO: 32412
  misc_feature 1..141: note = chr9:21969747-21969888
  misc_feature 1..141: note = hyper
  source 1..141: mol_type = genomic DNA

SEQ ID NO: 53118 - DNA, 19 bp, Homo sapiens
  misc_feature 1..19: note = chr9:21970940-21970959
  misc_feature 1..19: note = hyper
  source 1..19: mol_type = genomic DNA
gcctctggtgccccccgca

SEQ ID NO: 53119 - DNA, 262 bp, Homo sapiens; identical to SEQ ID NO: 20280
  misc_feature 1..262: note = chr9:21974237-21974499
  misc_feature 1..262: note = hyper
  source 1..262: mol_type = genomic DNA

SEQ ID NO: 53120 - DNA, 323 bp, Homo sapiens; identical to SEQ ID NO: 20281
  misc_feature 1..323: note = chr9:21974794-21975117
  misc_feature 1..323: note = hyper
  source 1..323: mol_type = genomic DNA

SEQ ID NO: 53121 - DNA, 446 bp, Homo sapiens; identical to SEQ ID NO: 32415
  misc_feature 1..446: note = chr9:21975190-21975636
  misc_feature 1..446: note = hyper
  source 1..446: mol_type = genomic DNA

SEQ ID NO: 53122 - DNA, 32 bp, Homo sapiens; identical to SEQ ID NO: 32416
  misc_feature 1..32: note = chr9:22011013-22011045
  misc_feature 1..32: note = hyper
  source 1..32: mol_type = genomic DNA

SEQ ID NO: 53123 - DNA, 351 bp, Homo sapiens; identical to SEQ ID NO: 32417
  misc_feature 1..351: note = chr9:22446925-22447276
  misc_feature 1..351: note = hyper
  source 1..351: mol_type = genomic DNA

SEQ ID NO: 53124 - DNA, 122 bp, Homo sapiens; identical to SEQ ID NO: 32418
  misc_feature 1..122: note = chr9:23821297-23821419
  misc_feature 1..122: note = hyper
  source 1..122: mol_type = genomic DNA

SEQ ID NO: 53125 - DNA, 30 bp, Homo sapiens; identical to SEQ ID NO: 32419
  misc_feature 1..30: note = chr9:23822239-23822269
  misc_feature 1..30: note = hyper
  source 1..30: mol_type = genomic DNA

SEQ ID NO: 53126 - DNA, 33 bp, Homo sapiens
  misc_feature 1..33: note = chr9:23822606-23822639
  misc_feature 1..33: note = hyper
  source 1..33: mol_type = genomic DNA
acccaccccggagccacgcggctggagcacgtt

SEQ ID NO: 53127 - DNA, 549 bp, Homo sapiens
  misc_feature 1..549: note = chr9:23824012-23824561
  misc_feature 1..549: note = hyper
  source 1..549: mol_type = genomic DNA
ggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacac

SEQ ID NO: 53128 - DNA, 61 bp, Homo sapiens; identical to SEQ ID NO: 32422
  misc_feature 1..61: note = chr9:23826326-23826387
  misc_feature 1..61: note = hyper
  source 1..61: mol_type = genomic DNA

SEQ ID NO: 53129 - DNA, 40 bp, Homo sapiens; identical to SEQ ID NO: 32423
  misc_feature 1..40: note = chr9:23829874-23829914
  misc_feature 1..40: note = hyper
  source 1..40: mol_type = genomic DNA

SEQ ID NO: 53130 - DNA, 30 bp, Homo sapiens; identical to SEQ ID NO: 32424
  misc_feature 1..30: note = chr9:23830739-23830769
  misc_feature 1..30: note = hyper
  source 1..30: mol_type = genomic DNA

SEQ ID NO: 53131 - DNA, 15 bp, Homo sapiens
  misc_feature 1..15: note = chr9:23831450-23831465
  misc_feature 1..15: note = hyper
  source 1..15: mol_type = genomic DNA
cgggccacggtgaca

SEQ ID NO: 53132 - DNA, 30 bp, Homo sapiens; identical to SEQ ID NO: 32427
  misc_feature 1..30: note = chr9:23831747-23831777
  misc_feature 1..30: note = hyper
  source 1..30: mol_type = genomic DNA

SEQ ID NO: 53133 - DNA, 38 bp, Homo sapiens; identical to SEQ ID NO: 32428
  misc_feature 1..38: note = chr9:23849841-23849879
  misc_feature 1..38: note = hyper
  source 1..38: mol_type = genomic DNA

SEQ ID NO: 53134 - DNA, 45 bp, Homo sapiens; identical to SEQ ID NO: 32429
  misc_feature 1..45: note = chr9:23850410-23850455
  misc_feature 1..45: note = hyper
  source 1..45: mol_type = genomic DNA

SEQ ID NO: 53135 - DNA, 30 bp, Homo sapiens; identical to SEQ ID NO: 32430
  misc_feature 1..30: note = chr9:23850946-23850976
  misc_feature 1..30: note = hyper
  source 1..30: mol_type = genomic DNA

SEQ ID NO: 53136 - DNA, 30 bp, Homo sapiens; identical to SEQ ID NO: 32431
  misc_feature 1..30: note = chr9:25678053-25678083
  misc_feature 1..30: note = hyper
  source 1..30: mol_type = genomic DNA

SEQ ID NO: 53137 - DNA, 131 bp, Homo sapiens
  misc_feature 1..131: note = chr9:29212039-29212170
  misc_feature 1..131: note = hyper
  source 1..131: mol_type = genomic DNA
cagagaaccaagaggcgaaaggagagtggaggagaaagagggcattacctcccggggctgccctcagggtgcgggtcaggatctcatccccgaagtggctccagttcaaggcacagctttccagagctcag

SEQ ID NO: 53138 - DNA, 488 bp, Homo sapiens
  misc_feature 1..488: note = chr9:29212294-29212782
  misc_feature 1..488: note = hyper
  source 1..488: mol_type = genomic DNA
ctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgac

SEQ ID NO: 53139 - DNA, 46 bp, Homo sapiens; identical to SEQ ID NO: 32434
  misc_feature 1..46: note = chr9:29213181-29213227
  misc_feature 1..46: note = hyper
  source 1..46: mol_type = genomic DNA

SEQ ID NO: 53140 - DNA, 32 bp, Homo sapiens
  misc_feature 1..32: note = chr9:29213476-29213508
  misc_feature 1..32: note = hyper
  source 1..32: mol_type = genomic DNA
tgggcgggcggcgggcggcggcgccaggtgag

SEQ ID NO: 53141 - DNA, 379 bp, Homo sapiens
  misc_feature 1..379: note = chr9:29213651-29214030
  misc_feature 1..379: note = hyper
  source 1..379: mol_type = genomic DNA
ccgcggcccccggccagtggcgagcgaaaagtcgggagtcctgaggaggggtaggggttccaaggatgctgatgacagaaagagtcaatcaatcctcactagttagcggattgccggcaggcagttcctcgccgcacgccgttaagtccgttgggccacctctccgttctctgccctgtctggcatttcaactccctagctcttttcttgaagccagttacaccccctcgacacccagcgagaggccaccagactaaagatgagccccgttcccatcgccaccctccaggggccacctccgccccttctgtagtggagaattgaagtggctgcagcagctctcctgggagctgaggggctccccgaggtccttcgaata

SEQ ID NO: 53142 - DNA, 216 bp, Homo sapiens
  misc_feature 1..216: note = chr9:29214144-29214360
  misc_feature 1..216: note = hyper
  source 1..216: mol_type = genomic DNA
aaaatgaatttcttagggaattgtagtgcctagcttttggaactgggttaatttaggtgctacgcttatattgtaaactggacggtagcaggtgaacggctcagctggagaaaggggagggattaggagtctggagacccaacccctttagcagccatttccaaggttttgcaccaggagtagctgtccgggtctctggctagctcctgtcccaac

SEQ ID NO: 53143 - DNA, 39 bp, Homo sapiens
  misc_feature 1..39: note = chr9:29214430-29214469
  misc_feature 1..39: note = hyper
  source 1..39: mol_type = genomic DNA
agacttcgctctcagaagcgcccccgtgtcatccacaac

SEQ ID NO: 53144 - DNA, 48 bp, Homo sapiens
  misc_feature 1..48: note = chr9:29215086-29215134
  misc_feature 1..48: note = hyper
  source 1..48: mol_type = genomic DNA
cagggatgaacctgctttggattctgtttgagccgactcagtgcagag

SEQ ID NO: 53145 - DNA, 100 bp, Homo sapiens; identical to SEQ ID NO: 20290
  misc_feature 1..100: note = chr9:32783121-32783221
  misc_feature 1..100: note = hyper
  source 1..100: mol_type = genomic DNA

SEQ ID NO: 53146 - DNA, 87 bp, Homo sapiens; identical to SEQ ID NO: 20291
  misc_feature 1..87: note = chr9:32783259-32783346
  misc_feature 1..87: note = hyper
  source 1..87: mol_type = genomic DNA

SEQ ID NO: 53147 - DNA, 79 bp, Homo sapiens
  misc_feature 1..79: note = chr9:32783657-32783736
  misc_feature 1..79: note = hyper
  source 1..79: mol_type = genomic DNA
cacctccccgatgcagagtccgtgggggaaaccaggctttcctcccagaaccaagggagcgagccgagggggcagctgc

SEQ ID NO: 53148 - DNA, 300 bp, Homo sapiens; identical to SEQ ID NO: 32441
  misc_feature 1..300: note = chr9:33523982-33524282
  misc_feature 1..300: note = hyper
  source 1..300: mol_type = genomic DNA

SEQ ID NO: 53149 - DNA, 267 bp, Homo sapiens
  misc_feature 1..267: note = chr9:33524342-33524609
  misc_feature 1..267: note = hyper
  source 1..267: mol_type = genomic DNA
cgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggc

SEQ ID NO: 53150 - DNA, 154 bp, Homo sapiens
  misc_feature 1..154: note = chr9:33524687-33524841
  misc_feature 1..154: note = hyper
  source 1..154: mol_type = genomic DNA
agacaggtagcgggggctcagccctcggtgggagggggcccccaggcccggtttccccgcaccgcctgaggcggggtcgtcggagttcgccgggaccctgggagccgcggagccaaatggagcctcagctgctttccatcgctgggaatttccc

SEQ ID NO: 53151 - DNA, 559 bp, Homo sapiens; identical to SEQ ID NO: 20295
  misc_feature 1..559: note = chr9:33676801-33677360
  misc_feature 1..559: note = hyper
  source 1..559: mol_type = genomic DNA

SEQ ID NO: 53152 - DNA, 42 bp, Homo sapiens
  misc_feature 1..42: note = chr9:34589020-34589062
  misc_feature 1..42: note = hyper
  source 1..42: mol_type = genomic DNA
agaaaaccatggggacgccgaccgacacacacatgcacacac

SEQ ID NO: 53153 - DNA, 147 bp, Homo sapiens
  misc_feature 1..147: note = chr9:34589156-34589303
  misc_feature 1..147: note = hyper
  source 1..147: mol_type = genomic DNA
atttctgcccgagaaagaagccacctttgggcgcgcaaaggccactacgaacctccccaaacccaggaatttttccagaccccgcgcgtgcagctgaggggtggggagaacagggacactaggacaaaccgccggagccacctccct

SEQ ID NO: 53154 - DNA, 152 bp, Homo sapiens; identical to SEQ ID NO: 32445
  misc_feature 1..152: note = chr9:34590071-34590223
  misc_feature 1..152: note = hyper
  source 1..152: mol_type = genomic DNA

SEQ ID NO: 53155 - DNA, 177 bp, Homo sapiens; identical to SEQ ID NO: 32446
  misc_feature 1..177: note = chr9:34591455-34591632
  misc_feature 1..177: note = hyper
  source 1..177: mol_type = genomic DNA

SEQ ID NO: 53156 - DNA, 148 bp, Homo sapiens; identical to SEQ ID NO: 32447
  misc_feature 1..148: note = chr9:34665047-34665195
  misc_feature 1..148: note = hyper
  source 1..148: mol_type = genomic DNA

SEQ ID NO: 53157 - DNA, 187 bp, Homo sapiens; identical to SEQ ID NO: 32448
  misc_feature 1..187: note = chr9:34701358-34701545
  misc_feature 1..187: note = hyper
  source 1..187: mol_type = genomic DNA

SEQ ID NO: 53158 - DNA, 135 bp, Homo sapiens; identical to SEQ ID NO: 32449
  misc_feature 1..135: note = chr9:35162260-35162395
  misc_feature 1..135: note = hyper
  source 1..135: mol_type = genomic DNA

SEQ ID NO: 53159 - DNA, 369 bp, Homo sapiens
  misc_feature 1..369: note = chr9:35616922-35617291
  misc_feature 1..369: note = hyper
  source 1..369: mol_type = genomic DNA
gaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgc

SEQ ID NO: 53160 - DNA, 45 bp, Homo sapiens; identical to SEQ ID NO: 20298
  misc_feature 1..45: note = chr9:35675494-35675539
  misc_feature 1..45: note = hyper
  source 1..45: mol_type = genomic DNA

SEQ ID NO: 53161 - DNA, 65 bp, Homo sapiens; identical to SEQ ID NO: 9890
  misc_feature 1..65: note = chr9:35728859-35728924
  misc_feature 1..65: note = hyper
  source 1..65: mol_type = genomic DNA

SEQ ID NO: 53162 - DNA, 285 bp, Homo sapiens
  misc_feature 1..285: note = chr9:36036783-36037068
  misc_feature 1..285: note = hyper
  source 1..285: mol_type = genomic DNA
caaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtgg

SEQ ID NO: 53163 - DNA, 497 bp, Homo sapiens
  misc_feature 1..497: note = chr9:36037098-36037595
  misc_feature 1..497: note = hyper
  source 1..497: mol_type = genomic DNA
agtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacatt

SEQ ID NO: 53164 - DNA, 151 bp, Homo sapiens; identical to SEQ ID NO: 32455
  misc_feature 1..151: note = chr9:36257863-36258014
  misc_feature 1..151: note = hyper
  source 1..151: mol_type = genomic DNA

SEQ ID NO: 53165 - DNA, 364 bp, Homo sapiens; identical to SEQ ID NO: 32456
  misc_feature 1..364: note = chr9:36258282-36258646
  misc_feature 1..364: note = hyper
  source 1..364: mol_type = genomic DNA

SEQ ID NO: 53166 - DNA, 321 bp, Homo sapiens; identical to SEQ ID NO: 9893
  misc_feature 1..321: note = chr9:36258697-36259018
  misc_feature 1..321: note = hyper
  source 1..321: mol_type = genomic DNA

SEQ ID NO: 53167 - DNA, 20 bp, Homo sapiens
  misc_feature 1..20: note = chr9:36739980-36740000
  misc_feature 1..20: note = hyper
  source 1..20: mol_type = genomic DNA
tgctccggagccagggtaca

SEQ ID NO: 53168 - DNA, 35 bp, Homo sapiens
  misc_feature 1..35: note = chr9:37003077-37003112
  misc_feature 1..35: note = hyper
  source 1..35: mol_type = genomic DNA
ctatccatggatgcaggaagcaggggatggagagg

SEQ ID NO: 53169 - DNA, 258 bp, Homo sapiens; identical to SEQ ID NO: 20304
  misc_feature 1..258: note = chr9:37025306-37025564
  misc_feature 1..258: note = hyper
  source 1..258: mol_type = genomic DNA

SEQ ID NO: 53170 - DNA, 363 bp, Homo sapiens; identical to SEQ ID NO: 20305
  misc_feature 1..363: note = chr9:37025783-37026146
  misc_feature 1..363: note = hyper
  source 1..363: mol_type = genomic DNA

SEQ ID NO: 53171 - DNA, 209 bp, Homo sapiens; identical to SEQ ID NO: 20306
  misc_feature 1..209: note = chr9:37026622-37026831
  misc_feature 1..209: note = hyper
  source 1..209: mol_type = genomic DNA

SEQ ID NO: 53172 - DNA, 388 bp, Homo sapiens; identical to SEQ ID NO: 20307
  misc_feature 1..388: note = chr9:37027412-37027800
  misc_feature 1..388: note = hyper
  source 1..388: mol_type = genomic DNA

SEQ ID NO: 53173 - DNA, 198 bp, Homo sapiens
  misc_feature 1..198: note = chr9:37027829-37028027
  misc_feature 1..198: note = hyper
  source 1..198: mol_type = genomic DNA
gcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccc

SEQ ID NO: 53174 - DNA, 40 bp, Homo sapiens; identical to SEQ ID NO: 32465
  misc_feature 1..40: note = chr9:37028470-37028510
  misc_feature 1..40: note = hyper
  source 1..40: mol_type = genomic DNA

SEQ ID NO: 53175 - DNA, 186 bp, Homo sapiens
  misc_feature 1..186: note = chr9:37029348-37029534
  misc_feature 1..186: note = hyper
  source 1..186: mol_type = genomic DNA
cagtagacaagtttccggcgctgacacccgtccccaccccccaccagggcacagctgcggaaaacggccccaggcgggactctggggacccaggaggctgcagtgcgcgccggggtggagtggcggcgttatctcttctttgtctggaaccccgcctgtccggatcttcccctttcacccccggcc

SEQ ID NO: 53176 - DNA, 122 bp, Homo sapiens
  misc_feature 1..122: note = chr9:37030655-37030777
  misc_feature 1..122: note = hyper
  source 1..122: mol_type = genomic DNA
agttttagtactgaaagacagcccattgagaataatgtgtgagaagccagagacctcgtttcactggggacacaccccctcccggcttccctttccacgcctcccagcgcactgcattaccg

SEQ ID NO: 53177 - DNA, 369 bp, Homo sapiens; identical to SEQ ID NO: 20311
  misc_feature 1..369: note = chr9:37034247-37034616
  misc_feature 1..369: note = hyper
  source 1..369: mol_type = genomic DNA

SEQ ID NO: 53178 - DNA, 216 bp, Homo sapiens
  misc_feature 1..216: note = chr9:37034731-37034947
  misc_feature 1..216: note = hyper
  source 1..216: mol_type = genomic DNA
gaagaaattaactgctcggccaagcaggtgcttttgaaaggggttgcaaaggctggcagtgttgccaggcaccgaggcgacgttccggtttactccgattcacccctagggcggcgcccgaccccagggttcccagccatccaacccccaccccaatttgttggggtcctgactattgctgggcccctgaccctagggcagcgccagatccctaaa

SEQ ID NO: 53179 - DNA, 86 bp, Homo sapiens
  misc_feature 1..86: note = chr9:37035734-37035820
  misc_feature 1..86: note = hyper
  source 1..86: mol_type = genomic DNA
ggccatctccgagtgctcgactctttccctccgcagcccagccccagcccaggcttcccgccctcccgcctcgcccgcgccgggag

SEQ ID NO: 53180 - DNA, 298 bp, Homo sapiens
  misc_feature 1..298: note = chr9:37036127-37036425
  misc_feature 1..298: note = hyper
  source 1..298: mol_type = genomic DNA
tgtctttttgtgtgtcgtttgtaaggcttttccttctccgcggtgtttagatgtgttttgatttggtgtgagtgggtgtcgtctgtgtgtgtgttgccttagggaatttcgtgttgtgtgtgttttgtttccttcgatttgaattttatttttttgaactgtacgttttggtgggggatcgggttatattttcatgtgttgtctttagtttttgtgtttgtgagatgcgctggtgagagtttgcgtgtgtattttggcttttgtggggctttgggattagggaggggacatcagccgc

SEQ ID NO: 53181 - DNA, 483 bp, Homo sapiens
  misc_feature 1..483: note = chr9:37036647-37037130
  misc_feature 1..483: note = hyper
  source 1..483: mol_type = genomic DNA
cagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccag

SEQ ID NO: 53182 - DNA, 241 bp, Homo sapiens
  misc_feature 1..241: note = chr9:37037430-37037671
  misc_feature 1..241: note = hyper
  source 1..241: mol_type = genomic DNA
ggaaaagaaaagagacgcagaaggggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggc

SEQ ID NO: 53183 - DNA, 88 bp, Homo sapiens; identical to SEQ ID NO: 32473
  misc_feature 1..88: note = chr9:37576058-37576146
  misc_feature 1..88: note = hyper
  source 1..88: mol_type = genomic DNA

SEQ ID NO: 53184 - DNA, 290 bp, Homo sapiens; identical to SEQ ID NO: 32474
  misc_feature 1..290: note = chr9:38424315-38424605
  misc_feature 1..290: note = hyper
  source 1..290: mol_type = genomic DNA

SEQ ID NO: 53185 - DNA, 124 bp, Homo sapiens; identical to SEQ ID NO: 32475
  misc_feature 1..124: note = chr9:38620225-38620349
  misc_feature 1..124: note = hyper
  source 1..124: mol_type = genomic DNA

SEQ ID NO: 53186 - DNA, 257 bp, Homo sapiens; identical to SEQ ID NO: 32476
  misc_feature 1..257: note = chr9:38620735-38620992
  misc_feature 1..257: note = hyper
  source 1..257: mol_type = genomic DNA

SEQ ID NO: 53187 - DNA, 508 bp, Homo sapiens; identical to SEQ ID NO: 32477
  misc_feature 1..508: note = chr9:38621429-38621937
  misc_feature 1..508: note = hyper
  source 1..508: mol_type = genomic DNA

SEQ ID NO: 53188 - DNA, 55 bp, Homo sapiens; identical to SEQ ID NO: 32478
  misc_feature 1..55: note = chr9:38622559-38622614
  misc_feature 1..55: note = hyper
  source 1..55: mol_type = genomic DNA

SEQ ID NO: 53189 - DNA, 72 bp, Homo sapiens; identical to SEQ ID NO: 32479
  misc_feature 1..72: note = chr9:66455725-66455797
  misc_feature 1..72: note = hyper
  source 1..72: mol_type = genomic DNA

SEQ ID NO: 53190 - DNA, 300 bp, Homo sapiens; identical to SEQ ID NO: 32480
  misc_feature 1..300: note = chr9:66458276-66458576
  misc_feature 1..300: note = hyper
  source 1..300: mol_type = genomic DNA

SEQ ID NO: 53191 - DNA, 180 bp, Homo sapiens; identical to SEQ ID NO: 32481
  misc_feature 1..180: note = chr9:66494102-66494282
  misc_feature 1..180: note = hyper
  source 1..180: mol_type = genomic DNA

SEQ ID NO: 53192 - DNA, 30 bp, Homo sapiens; identical to SEQ ID NO: 32484
  misc_feature 1..30: note = chr9:71939754-71939784
  misc_feature 1..30: note = hyper
  source 1..30: mol_type = genomic DNA

SEQ ID NO: 53193 - DNA, 87 bp, Homo sapiens; identical to SEQ ID NO: 32485
  misc_feature 1..87: note = chr9:74061672-74061759
  misc_feature 1..87: note = hyper
  source 1..87: mol_type = genomic DNA

SEQ ID NO: 53194 - DNA, 51 bp, Homo sapiens; identical to SEQ ID NO: 20322
  misc_feature 1..51: note = chr9:74061787-74061838
  misc_feature 1..51: note = hyper
  source 1..51: mol_type = genomic DNA

SEQ ID NO: 53195 - DNA, 40 bp, Homo sapiens
  misc_feature 1..40: note = chr9:74062070-74062110
  misc_feature 1..40: note = hyper
  source 1..40: mol_type = genomic DNA
atgcgccgcagggtagcgctcccagcggtcacctcaccct

SEQ ID NO: 53196 - DNA, 250 bp, Homo sapiens
  misc_feature 1..250: note = chr9:74764297-74764547
  misc_feature 1..250: note = hyper
  source 1..250: mol_type = genomic DNA
gagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgc

SEQ ID NO: 53197 - DNA, 215 bp, Homo sapiens
  misc_feature 1..215: note = chr9:74764648-74764863
  misc_feature 1..215: note = hyper
  source 1..215: mol_type = genomic DNA
aaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagag

SEQ ID NO: 53198 - DNA, 577 bp, Homo sapiens; identical to SEQ ID NO: 32488
  misc_feature 1..577: note = chr9:77111763-77112340
  misc_feature 1..577: note = hyper
  source 1..577: mol_type = genomic DNA

SEQ ID NO: 53199 - DNA, 167 bp, Homo sapiens; identical to SEQ ID NO: 32489
  misc_feature 1..167: note = chr9:77112729-77112896
  misc_feature 1..167: note = hyper
  source 1..167: mol_type = genomic DNA

SEQ ID NO: 53200 - DNA, 96 bp, Homo sapiens; identical to SEQ ID NO: 20327
  misc_feature 1..96: note = chr9:77112897-77112993
  misc_feature 1..96: note = hyper
  source 1..96: mol_type = genomic DNA

SEQ ID NO: 53201 - DNA, 237 bp, Homo sapiens
  misc_feature 1..237: note = chr9:77113825-77114062
  misc_feature 1..237: note = hyper
  source 1..237: mol_type = genomic DNA
gactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctct

SEQ ID NO: 53202 - DNA, 301 bp, Homo sapiens
  misc_feature 1..301: note = chr9:77114444-77114745
  misc_feature 1..301: note = hyper
  source 1..301: mol_type = genomic DNA
atggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctggg

SEQ ID NO: 53203 - DNA, 18 bp, Homo sapiens
  misc_feature 1..18: note = chr9:77114851-77114869
  misc_feature 1..18: note = hyper
  source 1..18: mol_type = genomic DNA
gcgcggggtggggatggg

SEQ ID NO: 53204 - DNA, 209 bp, Homo sapiens; identical to SEQ ID NO: 32495
  misc_feature 1..209: note = chr9:77502024-77502233
  misc_feature 1..209: note = hyper
  source 1..209: mol_type = genomic DNA

SEQ ID NO: 53205 - DNA, 96 bp, Homo sapiens; identical to SEQ ID NO: 32496
  misc_feature 1..96: note = chr9:77502613-77502709
  misc_feature 1..96: note = hyper
  source 1..96: mol_type = genomic DNA

SEQ ID NO: 53206 - DNA, 20 bp, Homo sapiens
  misc_feature 1..20: note = chr9:78506416-78506436
  misc_feature 1..20: note = hyper
  source 1..20: mol_type = genomic DNA
atgctctgtctcctgcgcgc

SEQ ID NO: 53207 - DNA, 47 bp, Homo sapiens
  misc_feature 1..47: note = chr9:79627370-79627417
  misc_feature 1..47: note = hyper
  source 1..47: mol_type = genomic DNA
ggaggccaacagccgcttaggagagcccgaaacgagcaggctggagg

SEQ ID NO: 53208 - DNA, 35 bp, Homo sapiens; identical to SEQ ID NO: 9925
  misc_feature 1..35: note = chr9:79628238-79628273
  misc_feature 1..35: note = hyper
  source 1..35: mol_type = genomic DNA

SEQ ID NO: 53209 - DNA, 230 bp, Homo sapiens; identical to SEQ ID NO: 32500
  misc_feature 1..230: note = chr9:79628711-79628941
  misc_feature 1..230: note = hyper
  source 1..230: mol_type = genomic DNA

SEQ ID NO: 53210 - DNA, 176 bp, Homo sapiens
  misc_feature 1..176: note = chr9:79631016-79631192
  misc_feature 1..176: note = hyper
  source 1..176: mol_type = genomic DNA
gtcggaattaacctccggggaagtaggggaagaggagagcgcgcccccctccccaccgcggccccagctctgcaccccggcccagtgccgcgcttggaatcccccaggatcctccgcggcggccgcagcccgccactctccaaaacagacacgcgacccgagctccctgtctgcgc

SEQ ID NO: 53211 - DNA, 220 bp, Homo sapiens
  misc_feature 1..220: note = chr9:79631335-79631555
  misc_feature 1..220: note = hyper
  source 1..220: mol_type = genomic DNA
ccaggttgcgtggaacctggctcgccgaggccgaagacactggccaagcccctggcgtcccctggcgctgaacctgaggttgtggcggcgggtctgcgggctgtagcgagctcacccagtgagggcctggctcattttttgtgctcagggttcgcgttatgcgcccaagatttgtcccgggagtccctgaagggcccctcccctcgatcggttcccagga

SEQ ID NO: 53212 - DNA, 37 bp, Homo sapiens
  misc_feature 1..37: note = chr9:79632823-79632860
  misc_feature 1..37: note = hyper
  source 1..37: mol_type = genomic DNA
ccccagctcagacatcgccatcccagagaaacctcat

SEQ ID NO: 53213 - DNA, 147 bp, Homo sapiens
  misc_feature 1..147: note = chr9:79633250-79633397
  misc_feature 1..147: note = hyper
  source 1..147: mol_type = genomic DNA
gtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaaca

SEQ ID NO: 53214 - DNA, 266 bp, Homo sapiens
  misc_feature 1..266: note = chr9:79633904-79634170
  misc_feature 1..266: note = hyper
  source 1..266: mol_type = genomic DNA
cggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctag

SEQ ID NO: 53215 - DNA, 80 bp, Homo sapiens
  misc_feature 1..80: note = chr9:79637274-79637354
  misc_feature 1..80: note = hyper
  source 1..80: mol_type = genomic DNA
aagcttctctctggatatctatgctagccccgtgtgaaggtgtttcagttctccaaggatgaggccgtggtttgagtgcc

SEQ ID NO: 53216 - DNA, 151 bp, Homo sapiens; identical to SEQ ID NO: 32514
  misc_feature 1..151: note = chr9:80263366-80263517
  misc_feature 1..151: note = hyper
  source 1..151: mol_type = genomic DNA

SEQ ID NO: 53217 - DNA, 41 bp, Homo sapiens; identical to SEQ ID NO: 32515
  misc_feature 1..41: note = chr9:80646329-80646370
  misc_feature 1..41: note = hyper
  source 1..41: mol_type = genomic DNA

SEQ ID NO: 53218 - DNA, 30 bp, Homo sapiens; identical to SEQ ID NO: 32516
  misc_feature 1..30: note = chr9:82185353-82185383
  misc_feature 1..30: note = hyper
  source 1..30: mol_type = genomic DNA

SEQ ID NO: 53219 - DNA, 40 bp, Homo sapiens; identical to SEQ ID NO: 32517
  misc_feature 1..40: note = chr9:82185643-82185683
  misc_feature 1..40: note = hyper
  source 1..40: mol_type = genomic DNA

SEQ ID NO: 53220 - DNA, 348 bp, Homo sapiens
  misc_feature 1..348: note = chr9:86152417-86152765
  misc_feature 1..348: note = hyper
  source 1..348: mol_type = genomic DNA
ggcctctctcactctggggaaacttcgccaccgccccacgcggagaactaaagaccaccggcggagggtgagggggaccgacacggagcggaaagcaggttccgggactgagggcgtctccggagcctgggcgcgggagacagaaatgagtgaacccagctgatgcatgccttctccacgtggaagaagggaggaaataccagtgggcgacatgcaggtgcccctctcagccctcggagctcccatctcctggcggagtagggcccagaggggccagagtccctccggaggcagctgccccgcgcccctagcccgggcgcagtgagacgcgcgcgcagggtgcacgcg

SEQ ID NO: 53221 - DNA, 35 bp, Homo sapiens; identical to SEQ ID NO: 32519
  misc_feature 1..35: note = chr9:86153332-86153367
  misc_feature 1..35: note = hyper
  source 1..35: mol_type = genomic DNA

SEQ ID NO: 53222 - DNA, 161 bp, Homo sapiens
  misc_feature 1..161: note = chr9:86755952-86756113
  misc_feature 1..161: note = hyper
  source 1..161: mol_type = genomic DNA
ggaagattttgaaaacctgtatttatccgcccttcgcaaaaaatcagcttctctagggcgagcctttccaaccttttccgtcagggcacacagaaaatgacctgatttcaagagcatttggggtaaaactggaggggatttcagagcgtctctgtgaggtt

SEQ ID NO: 53223 - DNA, 628 bp, Homo sapiens
  misc_feature 1..628: note = chr9:87283038-87283666
  misc_feature 1..628: note = hyper
  source 1..628: mol_type = genomic DNA
ttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgtt

SEQ ID NO: 53224 - DNA, 30 bp, Homo sapiens; identical to SEQ ID NO: 9945
  misc_feature 1..30: note = chr9:87284009-87284039
  misc_feature 1..30: note = hyper
  source 1..30: mol_type = genomic DNA

SEQ ID NO: 53225 - DNA, 151 bp, Homo sapiens; identical to SEQ ID NO: 20339
  misc_feature 1..151: note = chr9:87284555-87284706
  misc_feature 1..151: note = hyper
  source 1..151: mol_type = genomic DNA

SEQ ID NO: 53226 - DNA, 196 bp, Homo sapiens; identical to SEQ ID NO: 20340
  misc_feature 1..196: note = chr9:87284798-87284994
  misc_feature 1..196: note = hyper
  source 1..196: mol_type = genomic DNA

SEQ ID NO: 53227 - DNA, 61 bp, Homo sapiens; identical to SEQ ID NO: 20341
  misc_feature 1..61: note = chr9:87285472-87285533
  misc_feature 1..61: note = hyper
  source 1..61: mol_type = genomic DNA

SEQ ID NO: 53228 - DNA, 85 bp, Homo sapiens; identical to SEQ ID NO: 32526
  misc_feature 1..85: note = chr9:87285748-87285833
  misc_feature 1..85: note = hyper
  source 1..85: mol_type = genomic DNA

SEQ ID NO: 53229 - DNA, 116 bp, Homo sapiens; identical to SEQ ID NO: 20342
  misc_feature 1..116: note = chr9:88137998-88138114
  misc_feature 1..116: note = hyper
  source 1..116: mol_type = genomic DNA

SEQ ID NO: 53230 - DNA, 66 bp, Homo sapiens
  misc_feature 1..66: note = chr9:89560694-89560760
  misc_feature 1..66: note = hyper
  source 1..66: mol_type = genomic DNA
cgagtggggtccaggcgccccggggcgccaagcggccgccgccgccgctgctcctgcgcccaggcc

SEQ ID NO: 53231 - DNA, 236 bp, Homo sapiens
  misc_feature 1..236: note = chr9:89560827-89561063
  misc_feature 1..236: note = hyper
  source 1..236: mol_type = genomic DNA
gccgtcgtcgtcgtccagcggctgctcaccacccgcgcccccggtgcgctgctcgtcatcgtagtcctcatcgtagtagtcgtccaggcccccgtccgagccgctgctgccggggccgttgcccagctcggcgccgaagcacaggcgggccatgttctccttgaccgactcgcagatgggccgctcgaggccgtcgcacacgcagtcgttgagcagcgccgccttgggcatagcca

SEQ ID NO: 53232 - DNA, 65 bp, Homo sapiens; identical to SEQ ID NO: 32530
  misc_feature 1..65: note = chr9:89763321-89763386
  misc_feature 1..65: note = hyper
  source 1..65: mol_type = genomic DNA

SEQ ID NO: 53233 - DNA, 53 bp, Homo sapiens; identical to SEQ ID NO: 32531
  misc_feature 1..53: note = chr9:90112803-90112856
  misc_feature 1..53: note = hyper
  source 1..53: mol_type = genomic DNA

SEQ ID NO: 53234 - skipped

SEQ ID NO: 53235 - DNA, 93 bp, Homo sapiens; identical to SEQ ID NO: 32533
  misc_feature 1..93: note = chr9:90589194-90589287
  misc_feature 1..93: note = hyper
  source 1..93: mol_type = genomic DNA

SEQ ID NO: 53236 - DNA, 108 bp, Homo sapiens; identical to SEQ ID NO: 32534
  misc_feature 1..108: note = chr9:91149171-91149279
  misc_feature 1..108: note = hyper
  source 1..108: mol_type = genomic DNA

SEQ ID NO: 53237 - DNA, 52 bp, Homo sapiens; identical to SEQ ID NO: 20346
  misc_feature 1..52: note = chr9:91150170-91150222
  misc_feature 1..52: note = hyper
  source 1..52: mol_type = genomic DNA

SEQ ID NO: 53238 - DNA, 25 bp, Homo sapiens
  misc_feature 1..25: note = chr9:91150335-91150360
  misc_feature 1..25: note = hyper
  source 1..25: mol_type = genomic DNA
tgcgtgtctgcgccatggttgacat

SEQ ID NO: 53239 - DNA, 40 bp, Homo sapiens; identical to SEQ ID NO: 32536
  misc_feature 1..40: note = chr9:91150621-91150661
  misc_feature 1..40: note = hyper
  source 1..40: mol_type = genomic DNA

SEQ ID NO: 53240 - DNA, 39 bp, Homo sapiens
  misc_feature 1..39: note = chr9:91605965-91606004
  misc_feature 1..39: note = hyper
  source 1..39: mol_type = genomic DNA
gcccaaacaaaccctcgctgtcagggcgacaggcgcccg

SEQ ID NO: 53241 - DNA, 305 bp, Homo sapiens
  misc_feature 1..305: note = chr9:91606058-91606363
  misc_feature 1..305: note = hyper
  source 1..305: mol_type = genomic DNA
cgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcacggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagttta

SEQ ID NO: 53242 - DNA, 30 bp, Homo sapiens; identical to SEQ ID NO: 32538
  misc_feature 1..30: note = chr9:91606806-91606836
  misc_feature 1..30: note = hyper
  source 1..30: mol_type = genomic DNA

SEQ ID NO: 53243 - DNA, 61 bp, Homo sapiens
  misc_feature 1..61: note = chr9:91792387-91792448
  misc_feature 1..61: note = hyper
  source 1..61: mol_type = genomic DNA
agcacagcatttggcctgctctgcaaggagctgggaattcttgctgcggggggcaacaaga

SEQ ID NO: 53244 - DNA, 179 bp, Homo sapiens
  misc_feature 1..179: note = chr9:91792907-91793086
  misc_feature 1..179: note = hyper
  source 1..179: mol_type = genomic DNA
cacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccg

SEQ ID NO: 53245 - DNA, 73 bp, Homo sapiens
  misc_feature 1..73: note = chr9:91793526-91793599
  misc_feature 1..73: note = hyper
  source 1..73: mol_type = genomic DNA
aggatggtgccctcccaccgttaaaagccagcacagcggcggccgcgcagccccggcccgggagaccgctgct

SEQ ID NO: 53246 - DNA, 193 bp, Homo sapiens; identical to SEQ ID NO: 32542
  misc_feature 1..193: note = chr9:91849616-91849809
  misc_feature 1..193: note = hyper
  source 1..193: mol_type = genomic DNA

SEQ ID NO: 53247 - DNA, 206 bp, Homo sapiens; identical to SEQ ID NO: 32543
  misc_feature 1..206: note = chr9:93405037-93405243
  misc_feature 1..206: note = hyper
  source 1..206: mol_type = genomic DNA

SEQ ID NO: 53248 - DNA, 84 bp, Homo sapiens; identical to SEQ ID NO: 32544
  misc_feature 1..84: note = chr9:93956485-93956569
  misc_feature 1..84: note = hyper
  source 1..84: mol_type = genomic DNA

SEQ ID NO: 53249 - DNA, 49 bp, Homo sapiens
  misc_feature 1..49: note = chr9:94183821-94183870
  misc_feature 1..49: note = hyper
  source 1..49: mol_type = genomic DNA
cgccactaccagacccgcccccagccccggattctcgcagaccccaccg

SEQ ID NO: 53250 - DNA, 539 bp, Homo sapiens; identical to SEQ ID NO: 32546
  misc_feature 1..539: note = chr9:94711379-94711918
  misc_feature 1..539: note = hyper
  source 1..539: mol_type = genomic DNA

SEQ ID NO: 53251 - DNA, 794 bp, Homo sapiens; identical to SEQ ID NO: 32547
  misc_feature 1..794: note = chr9:94712294-94713088
  misc_feature 1..794: note = hyper
  source 1..794: mol_type = genomic DNA

SEQ ID NO: 53252 - DNA, 425 bp, Homo sapiens
  misc_feature 1..425: note = chr9:95569822-95570247
  misc_feature 1..425: note = hyper
  source 1..425: mol_type = genomic DNA
gcagtgccgaaatcaaggacgcctggatgcttttcgttgcagagtgacaaaggttcaacaacaggaagaggatcaggggccaagacaagaagctgaagttcggcctgccaggaaccccgggccccagcatcccacccaaggcgctgctgcaggagttccagctgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccg

SEQ ID NO: 53253 - DNA, 324 bp, Homo sapiens
  misc_feature 1..324: note = chr9:95570434-95570758
  misc_feature 1..324: note = hyper
  source 1..324: mol_type = genomic DNA
ccagacaaggcaaccgaagttcatcctctctgagttgacttcgtgcgggcagcgggccggcgcccaggatgctggggagccctgcgcgccggaggccgacaagccgtggggctcagaggcgcctcagggcgagaaggcacccgtctcccagcgctttcaccccctggcctgcccggcccgcgtggtgtcccagtggctgcggccacgccaggcattctgccccgcggcggctgcacagggacgagaactgagaacccctgctcaaccccatccggggtgactgccaaatgcctatgccagcggccccgatctccctccggtgga

SEQ ID NO: 53254 - DNA, 39 bp, Homo sapiens; identical to SEQ ID NO: 32549
  misc_feature 1..39: note = chr9:95570878-95570917
  misc_feature 1..39: note = hyper
  source 1..39: mol_type = genomic DNA

SEQ ID NO: 53255 - DNA, 94 bp, Homo sapiens
  misc_feature 1..94: note = chr9:95571523-95571617
  misc_feature 1..94: note = hyper
  source 1..94: mol_type = genomic DNA
gccccctgcaggccacgcgggctcgggagcggtttccggagtccgagctggcgctgagctgcaggcgcgagcctaaaggcttagccggggccca

SEQ ID NO: 53256 - DNA, 171 bp, Homo sapiens; identical to SEQ ID NO: 20357
  misc_feature 1..171: note = chr9:95571760-95571931
  misc_feature 1..171: note = hyper
  source 1..171: mol_type = genomic DNA

SEQ ID NO: 53257 - DNA, 127 bp, Homo sapiens; identical to SEQ ID NO: 32552
  misc_feature 1..127: note = chr9:95572141-95572268
  misc_feature 1..127: note = hyper
  source 1..127: mol_type = genomic DNA

SEQ ID NO: 53258 - DNA, 132 bp, Homo sapiens; identical to SEQ ID NO: 32553
  misc_feature 1..132: note = chr9:95821259-95821391
  misc_feature 1..132: note = hyper
  source 1..132: mol_type = genomic DNA

SEQ ID NO: 53259 - DNA, 253 bp, Homo sapiens; identical to SEQ ID NO: 32554
  misc_feature 1..253: note = chr9:95946216-95946469
  misc_feature 1..253: note = hyper
  source 1..253: mol_type = genomic DNA

SEQ ID NO: 53260 - DNA, 113 bp, Homo sapiens; identical to SEQ ID NO: 32555
  misc_feature 1..113: note = chr9:96588627-96588740
  misc_feature 1..113: note = hyper
  source 1..113: mol_type = genomic DNA

SEQ ID NO: 53261 - DNA, 87 bp, Homo sapiens
  misc_feature 1..87: note = chr9:96588885-96588972
  misc_feature 1..87: note = hyper
  source 1..87: mol_type = genomic DNA
tacgggcggaggcaggggcgggcgggggctttcagcagctcgtccgcggaacatttgcatgtaatttgggagcgggtcacatgtggg

SEQ ID NO: 53262 - DNA, 259 bp, Homo sapiens; identical to SEQ ID NO: 32557
  misc_feature 1..259: note = chr9:96708199-96708458
  misc_feature 1..259: note = hyper
  source 1..259: mol_type = genomic DNA

SEQ ID NO: 53263 - DNA, 30 bp, Homo sapiens; identical to SEQ ID NO: 32558
  misc_feature 1..30: note = chr9:96710135-96710165
  misc_feature 1..30: note = hyper
  source 1..30: mol_type = genomic DNA

SEQ ID NO: 53264 - DNA, 267 bp, Homo sapiens; identical to SEQ ID NO: 20361
  misc_feature 1..267: note = chr9:96710991-96711258
  misc_feature 1..267: note = hyper
  source 1..267: mol_type = genomic DNA

SEQ ID NO: 53265 - DNA, 113 bp, Homo sapiens
  misc_feature 1..113: note = chr9:96717466-96717579
  misc_feature 1..113: note = hyper
  source 1..113: mol_type = genomic DNA
ggcggcgacggcttggctccggcgcggggcccgcgcggggctctaggccggcccgcagctcggggcggcgcgcgggcgccggctcatgccccctcccccgccggccggccggg

SEQ ID NO: 53266 - DNA, 122 bp, Homo sapiens
  misc_feature 1..122: note = chr9:96717857-96717979
  misc_feature 1..122: note = hyper
  source 1..122: mol_type = genomic DNA
gagagccggagagttcgggaggcaagacccccagagacgagagtcggagggatcaaacgacacaggtgagagaaggggcagaggcagacggcgtgggccaaacaagattccagacagtgatg

SEQ ID NO: 53267 - DNA, 50 bp, Homo sapiens; identical to SEQ ID NO: 20363
  misc_feature 1..50: note = chr9:96718149-96718199
  misc_feature 1..50: note = hyper
  source 1..50: mol_type = genomic DNA

SEQ ID NO: 53268 - DNA, 30 bp, Homo sapiens; identical to SEQ ID NO: 32569
  misc_feature 1..30: note = chr9:96722011-96722041
  misc_feature 1..30: note = hyper
  source 1..30: mol_type = genomic DNA

SEQ ID NO: 53269 - DNA, 57 bp, Homo sapiens; identical to SEQ ID NO: 32572
  misc_feature 1..57: note = chr9:97402023-97402080
  misc_feature 1..57: note = hyper
  source 1..57: mol_type = genomic DNA

SEQ ID NO: 53270 - DNA, 16 bp, Homo sapiens
  misc_feature 1..16: note = chr9:98111349-98111365
  misc_feature 1..16: note = hyper
  source 1..16: mol_type = genomic DNA
ctaccaggacacatgc

SEQ ID NO: 53271 - DNA, 355 bp, Homo sapiens; identical to SEQ ID NO: 32576
  misc_feature 1..355: note = chr9:98277959-98278314
  misc_feature 1..355: note = hyper
  source 1..355: mol_type = genomic DNA

SEQ ID NO: 53272 - DNA, 30 bp, Homo sapiens; identical to SEQ ID NO: 32577
  misc_feature 1..30: note = chr9:98315763-98315793
  misc_feature 1..30: note = hyper
  source 1..30: mol_type = genomic DNA

SEQ ID NO: 53273 - DNA, 315 bp, Homo sapiens; identical to SEQ ID NO: 32578
  misc_feature 1..315: note = chr9:98783210-98783525
  misc_feature 1..315: note = hyper
  source 1..315: mol_type = genomic DNA

SEQ ID NO: 53274 - DNA, 252 bp, Homo sapiens; identical to SEQ ID NO: 32579
  misc_feature 1..252: note = chr9:98784084-98784336
  misc_feature 1..252: note = hyper
  source 1..252: mol_type = genomic DNA

SEQ ID NO: 53275 - DNA, 40 bp, Homo sapiens; identical to SEQ ID NO: 32580
  misc_feature 1..40: note = chr9:98784337-98784377
  misc_feature 1..40: note = hyper
  source 1..40: mol_type = genomic DNA

SEQ ID NO: 53276 - DNA, 118 bp, Homo sapiens
  misc_feature 1..118: note = chr9:98784802-98784920
  misc_feature 1..118: note = hyper
  source 1..118: mol_type = genomic DNA
ggagtaattcagagcccgtcagccccacgccgagtttattcaccctggcaggggcttccgcgggagccatgacccttcctaactggggtggaaggacccgcagcgccagccgggtccg

SEQ ID NO: 53277 - DNA, 13 bp, Homo sapiens
  misc_feature 1..13: note = chr9:98790000-98790013
  misc_feature 1..13: note = hyper
  source 1..13: mol_type = genomic DNA
cctccaaggcccc

SEQ ID NO: 53278 - DNA, 97 bp, Homo sapiens; identical to SEQ ID NO: 32583
  misc_feature 1..97: note = chr9:99381503-99381600
  misc_feature 1..97: note = hyper
  source 1..97: mol_type = genomic DNA

SEQ ID NO: 53279 - DNA, 30 bp, Homo sapiens; identical to SEQ ID NO: 32585
  misc_feature 1..30: note = chr9:99539965-99539995
  misc_feature 1..30: note = hyper
  source 1..30: mol_type = genomic DNA

SEQ ID NO: 53280 - DNA, 41 bp, Homo sapiens
  misc_feature 1..41: note = chr9:99639580-99639621
  misc_feature 1..41: note = hyper
  source 1..41: mol_type = genomic DNA
cctgggggccgcgggcgaaggaacacccccagatgccgctg

SEQ ID NO: 53281 - DNA, 115 bp, Homo sapiens
  misc_feature 1..115: note = chr9:99639942-99640057
  misc_feature 1..115: note = hyper
  source 1..115: mol_type = genomic DNA
gcggtcttgaagcaatttcccggcaaagtcccgggacagcgggaaagaaactggtctccctgcctggggtcgttcccggtggatgtgcctcttcatcagacggaattttccgtct

SEQ ID NO: 53282 - DNA, 241 bp, Homo sapiens
  misc_feature 1..241: note = chr9:99983170-99983411
  misc_feature 1..241: note = hyper
  source 1..241: mol_type = genomic DNA
attgccagggatggaaagcagctgaggctccatttggcttcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttcc

SEQ ID NO: 53283 - DNA, 187 bp, Homo sapiens
  misc_feature 1..187: note = chr9:99983824-99984011
  misc_feature 1..187: note = hyper
  source 1..187: mol_type = genomic DNA
gcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatcccggaatcg

SEQ ID NO: 53284 - DNA, 30 bp, Homo sapiens; identical to SEQ ID NO: 32589
  misc_feature 1..30: note = chr9:100000368-100000398
  misc_feature 1..30: note = hyper
  source 1..30: mol_type = genomic DNA

SEQ ID NO: 53285 - DNA, 30 bp, Homo sapiens; identical to SEQ ID NO: 32590
  misc_feature 1..30: note = chr9:100000837-100000867
  misc_feature 1..30: note = hyper
  source 1..30: mol_type = genomic DNA

SEQ ID NO: 53286 - DNA, 30 bp, Homo sapiens; identical to SEQ ID NO: 32591
  misc_feature 1..30: note = chr9:100264785-100264815
  misc_feature 1..30: note = hyper
  source 1..30: mol_type = genomic DNA

SEQ ID NO: 53287 - DNA, 174 bp, Homo sapiens
  misc_feature 1..174: note = chr9:100503451-100503625
  misc_feature 1..174: note = hyper
  source 1..174: mol_type = genomic DNA
aaggttccaggagggcgcctgcctgcctagagtccccttgccggtctcaccctggaaaggtaggcggaactagaacaggcgggccccactgcctgcagcctgcgaggagacgccagggctgcaagcccccccgccctcctccgcccctgccgggacagtcagccgctaggggat

SEQ ID NO: 53288 - DNA, 23 bp, Homo sapiens
  misc_feature 1..23: note = chr9:100503937-100503960
  misc_feature 1..23: note = hyper
  source 1..23: mol_type = genomic DNA
gcgacgggcgccatcccttccag

SEQ ID NO: 53289 - DNA, 103 bp, Homo sapiens; identical to SEQ ID NO: 20372
  misc_feature 1..103: note = chr9:100610218-100610321
  misc_feature 1..103: note = hyper
  source 1..103: mol_type = genomic DNA

SEQ ID NO: 53290 - DNA, 141 bp, Homo sapiens
  misc_feature 1..141: note = chr9:100613687-100613828
  misc_feature 1..141: note = hyper
  source 1..141: mol_type = genomic DNA
cgttaggacaacggtcgtccagaatttaaaatctagatatctgaatctcagaatcttgaaagttactgagagccacgaaatcccgtattaaaaggtgcctataatataatccagttaaaaattttaaaatttgaagttttt

SEQ ID NO: 53291 - DNA, 97 bp, Homo sapiens
  misc_feature 1..97: note = chr9:100614325-100614422
  misc_feature 1..97: note = hyper
  source 1..97: mol_type = genomic DNA
gccctccagctgctatttaacagagtagaacactgaggccctgcgaggggacaaggacaggccctggatctcccagtgaatggccagggaacgaacc

SEQ ID NO: 53292 - DNA, 100 bp, Homo sapiens
  misc_feature 1..100: note = chr9:100614441-100614541
  misc_feature 1..100: note = hyper
  source 1..100: mol_type = genomic DNA
cgcgaggatctcaggttaggaccaagttccggctcagggacagcaggaaaggaactcagaaattggacacccatgaagcaaacgtgtcccgactgcccgc

SEQ ID NO: 53293 - skipped

SEQ ID NO: 53294 - DNA, 317 bp, Homo sapiens
  misc_feature 1..317: note = chr9:100617365-100617682
  misc_feature 1..317: note = hyper
  source 1..317: mol_type = genomic DNA
tccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttcca

SEQ ID NO: 53295 - DNA, 102 bp, Homo sapiens
  misc_feature 1..102: note = chr9:100619620-100619722
  misc_feature 1..102: note = hyper
  source 1..102: mol_type = genomic DNA
agtcccttctcctctcgggtcgtcatttgtgaaatgggaatttgtgactgctacctcagataattttcctgaagttaaacgagaggagaggtgaaaagcgct

SEQ ID NO: 53296 - DNA, 261 bp, Homo sapiens
  misc_feature 1..261: note = chr9:100620069-100620330
  misc_feature 1..261: note = hyper
  source 1..261: mol_type = genomic DNA
ctcgcgcaccggccgggccaggtgggaatgggcgccgcgcaggggagcgagtacctcggagacagtgcgcgccgcccggggcctcatccacagcggggtcgcgggcggcccccttagcccgcgtgactgtgggatcctgagaacattccgctgtatgtcttggaaccttctaaccctaggaatttgcaaacccctcccagtccctcatctgggggctcagagactggaggtgccttttttatttttttcttcttcacttta

SEQ ID NO: 53297 - DNA, 88 bp, Homo sapiens
  misc_feature 1..88: note = chr9:101469181-101469269
  misc_feature 1..88: note = hyper
  source 1..88: mol_type = genomic DNA
atgctcaggcaaagacgagggcgataggaatgtcattcggaaatgatttcacaccgggttagccctgcacagccagccagcttgcatc

SEQ ID NO: 53298 - DNA, 76 bp, Homo sapiens; identical to SEQ ID NO: 20377
  misc_feature 1..76: note = chr9:101469527-101469603
  misc_feature 1..76: note = hyper
  source 1..76: mol_type = genomic DNA

SEQ ID NO: 53299 - DNA, 320 bp, Homo sapiens
  misc_feature 1..320: note = chr9:101469796-101470116
  misc_feature 1..320: note = hyper
  source 1..320: mol_type = genomic DNA
ctggggcttcaggcagaacccaaaccgagggcgtggggaggggtcttgggatggaaagcccttggctctctggctccgctccggactgctctccaagtctgtgctccggctgctaggtcggatgcttcaagcctgagccgtgagaaactgcctgcagccgcccggccaacagcagcggcgcggccggacaccactgcacgtccgggacgagaactgccagggcactttctgagcaactaacccgaggcaggggtctcctgaaatcgctctggccacaggcagcgccgggcacgtccaggcagaagcgctgcagagccggt

SEQ ID NO: 53300 - DNA, 30 bp, Homo sapiens; identical to SEQ ID NO: 32606
  misc_feature 1..30: note = chr9:101470607-101470637
  misc_feature 1..30: note = hyper
  source 1..30: mol_type = genomic DNA

SEQ ID NO: 53301 - DNA, 90 bp, Homo sapiens; identical to SEQ ID NO: 32607
  misc_feature 1..90: note = chr9:101470839-101470929
  misc_feature 1..90: note = hyper
  source 1..90: mol_type = genomic DNA

SEQ ID NO: 53302 - DNA, 482 bp, Homo sapiens
  misc_feature 1..482: note = chr9:101471071-101471553
  misc_feature 1..482: note = hyper
  source 1..482: mol_type = genomic DNA
ggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgc

SEQ ID NO: 53303 - DNA, 16 bp, Homo sapiens
  misc_feature 1..16: note = chr9:101471554-101471570
  misc_feature 1..16: note = hyper
  source 1..16: mol_type = genomic DNA
gggagggccaccttcc

SEQ ID NO: 53304 - DNA, 239 bp, Homo sapiens
  misc_feature 1..239: note = chr9:101471621-101471860
  misc_feature 1..239: note = hyper
  source 1..239: mol_type = genomic DNA
cccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgc

SEQ ID NO: 53305 - DNA, 20 bp, Homo sapiens
  misc_feature 1..20: note = chr9:101705976-101705996
  misc_feature 1..20: note = hyper
  source 1..20: mol_type = genomic DNA
gcgcggggctttcctcgcag

SEQ ID NO: 53306 - DNA, 84 bp, Homo sapiens; identical to SEQ ID NO: 20382
  misc_feature 1..84: note = chr9:101706695-101706779
  misc_feature 1..84: note = hyper
  source 1..84: mol_type = genomic DNA

SEQ ID NO: 53307 - DNA, 109 bp, Homo sapiens; identical to SEQ ID NO: 32613
  misc_feature 1..109: note = chr9:102586680-102586789
  misc_feature 1..109: note = hyper
  source 1..109: mol_type = genomic DNA

SEQ ID NO: 53308 - skipped

SEQ ID NO: 53309 - DNA, 146 bp, Homo sapiens; identical to SEQ ID NO: 32615
  misc_feature 1..146: note = chr9:103235748-103235894
  misc_feature 1..146: note = hyper
  source 1..146: mol_type = genomic DNA

SEQ ID NO: 53310 - DNA, 137 bp, Homo sapiens; identical to SEQ ID NO: 32616
  misc_feature 1..137: note = chr9:103790552-103790689
  misc_feature 1..137: note = hyper
  source 1..137: mol_type = genomic DNA

SEQ ID NO: 53311 - DNA, 212 bp, Homo sapiens; identical to SEQ ID NO: 32617
  misc_feature 1..212: note = chr9:103791492-103791704
  misc_feature 1..212: note = hyper
  source 1..212: mol_type = genomic DNA

SEQ ID NO: 53312 - DNA, 113 bp, Homo sapiens; identical to SEQ ID NO: 32618
  misc_feature 1..113: note = chr9:103791967-103792080
  misc_feature 1..113: note = hyper
  source 1..113: mol_type = genomic DNA

SEQ ID NO: 53313 - DNA, 39 bp, Homo sapiens
  misc_feature 1..39: note = chr9:104248540-104248579
  misc_feature 1..39: note = hyper
  source 1..39: mol_type = genomic DNA
gggcagtccctgccacgcttgagcctcagtttcccaccc

SEQ ID NO: 53314 - DNA, 101 bp, Homo sapiens; identical to SEQ ID NO: 32620
  misc_feature 1..101: note = chr9:104248845-104248946
  misc_feature 1..101: note = hyper
  source 1..101: mol_type = genomic DNA

SEQ ID NO: 53315 - skipped

SEQ ID NO: 53316 - DNA, 30 bp, Homo sapiens; identical to SEQ ID NO: 32622
  misc_feature 1..30: note = chr9:104499932-104499962
  misc_feature 1..30: note = hyper
  source 1..30: mol_type = genomic DNA

SEQ ID NO: 53317 - DNA, 15 bp, Homo sapiens
  misc_feature 1..15: note = chr9:104500167-104500182
  misc_feature 1..15: note = hyper
  source 1..15: mol_type = genomic DNA
aggagctgggcaccc

SEQ ID NO: 53318 - DNA, 418 bp, Homo sapiens
  misc_feature 1..418: note = chr9:104500207-104500625
  misc_feature 1..418: note = hyper
  source 1..418: mol_type = genomic DNA
cggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaa

SEQ ID NO: 53319 - DNA, 174 bp, Homo sapiens; identical to SEQ ID NO: 10015
  misc_feature 1..174: note = chr9:104500856-104501030
  misc_feature 1..174: note = hyper
  source 1..174: mol_type = genomic DNA

SEQ ID NO: 53320 - DNA, 193 bp, Homo sapiens; identical to SEQ ID NO: 10016
  misc_feature 1..193: note = chr9:104501031-104501224
  misc_feature 1..193: note = hyper
  source 1..193: mol_type = genomic DNA

SEQ ID NO: 53321 - DNA, 476 bp, Homo sapiens; identical to SEQ ID NO: 32627
  misc_feature 1..476: note = chr9:108418471-108418947
  misc_feature 1..476: note = hyper
  source 1..476: mol_type = genomic DNA

SEQ ID NO: 53322 - DNA, 30 bp, Homo sapiens; identical to SEQ ID NO: 32628
  misc_feature 1..30: note = chr9:109622797-109622827
  misc_feature 1..30: note = hyper
  source 1..30: mol_type = genomic DNA

SEQ ID NO: 53323 - DNA, 168 bp, Homo sapiens; identical to SEQ ID NO: 32629
  misc_feature 1..168: note = chr9:109623048-109623216
  misc_feature 1..168: note = hyper
  source 1..168: mol_type = genomic DNA

SEQ ID NO: 53324 - DNA, 145 bp, Homo sapiens; identical to SEQ ID NO: 32630
  misc_feature 1..145: note = chr9:109623464-109623609
  misc_feature 1..145: note = hyper
  source 1..145: mol_type = genomic DNA

SEQ ID NO: 53325 - DNA, 60 bp, Homo sapiens; identical to SEQ ID NO: 32631
  misc_feature 1..60: note = chr9:109624462-109624522
  misc_feature 1..60: note = hyper
  source 1..60: mol_type = genomic DNA

SEQ ID NO: 53326 - DNA, 385 bp, Homo sapiens
  misc_feature 1..385: note = chr9:110227815-110228200
  misc_feature 1..385: note = hyper
  source 1..385: mol_type = genomic DNA
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagcaaaggcggcgcggagcgggtagccaggtccggagccgtcctgtgccgggccgtccggtggggggcactgcagaccgcgcgggcgctgcgcccgcctctagctccgggcgcagaggggtggccacgctctcctgagtccctcgcgcccctagccgcgcctgggagagcggactggcctcccagagaggatgcgggggaagccgcacaggggcccact

SEQ ID NO: 53327 - DNA, 42 bp, Homo sapiens
  misc_feature 1..42: note = chr9:110228602-110228644
  misc_feature 1..42: note = hyper
  source 1..42: mol_type = genomic DNA
gccacagccagcgggcgctctggccctcgcagaagccgccgc

SEQ ID NO: 53328 - DNA, 81 bp, Homo sapiens; identical to SEQ ID NO: 32633
  misc_feature 1..81: note = chr9:110251955-110252036
  misc_feature 1..81: note = hyper
  source 1..81: mol_type = genomic DNA

SEQ ID NO: 53329 - DNA, 45 bp, Homo sapiens; identical to SEQ ID NO: 32634
  misc_feature 1..45: note = chr9:110253522-110253567
  misc_feature 1..45: note = hyper
  source 1..45: mol_type = genomic DNA

SEQ ID NO: 53330 - DNA, 52 bp, Homo sapiens; identical to SEQ ID NO: 32635
  misc_feature 1..52: note = chr9:110400388-110400440
  misc_feature 1..52: note = hyper
  source 1..52: mol_type = genomic DNA

SEQ ID NO: 53331 - DNA, 182 bp, Homo sapiens; identical to SEQ ID NO: 32636
  misc_feature 1..182: note = chr9:111929136-111929318
  misc_feature 1..182: note = hyper
  source 1..182: mol_type = genomic DNA

SEQ ID NO: 53332 - DNA, 189 bp, Homo sapiens; identical to SEQ ID NO: 32637
  misc_feature 1..189: note = chr9:111929339-111929528
  misc_feature 1..189: note = hyper
  source 1..189: mol_type = genomic DNA

SEQ ID NO: 53333 - DNA, 15 bp, Homo sapiens
  misc_feature 1..15: note = chr9:111929585-111929600
  misc_feature 1..15: note = hyper
  source 1..15: mol_type = genomic DNA
cgcagcctccccctt

SEQ ID NO: 53334 - DNA, 80 bp, Homo sapiens; identical to SEQ ID NO: 32639
  misc_feature 1..80: note = chr9:112081693-112081773
  misc_feature 1..80: note = hyper
  source 1..80: mol_type = genomic DNA

SEQ ID NO: 53335 - DNA, 547 bp, Homo sapiens
  misc_feature 1..547: note = chr9:112402623-112403170
  misc_feature 1..547: note = hyper
  source 1..547: mol_type = genomic DNA
cttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgc

SEQ ID NO: 53336 - DNA, 101 bp, Homo sapiens
  misc_feature 1..101: note = chr9:112403200-112403301
  misc_feature 1..101: note = hyper
  source 1..101: mol_type = genomic DNA
gtgaccgcggcggcaggcagatcccgctcgggtccgcgtccaggatgggtgtttaatttcagccccgtgtgtacgcctggtgtttctatagcagccgccgc

SEQ ID NO: 53337 - DNA, 62 bp, Homo sapiens
  misc_feature 1..62: note = chr9:112403302-112403364
  misc_feature 1..62: note = hyper
  source 1..62: mol_type = genomic DNA
gcggcaggaggcaaggggtgggagccccgggtggcgtggtttttgcggctgccccttggcta

SEQ ID NO: 53338 - DNA, 74 bp, Homo sapiens
  misc_feature 1..74: note = chr9:112403394-112403468
  misc_feature 1..74: note = hyper
  source 1..74: mol_type = genomic DNA
gatgatgttgctaaggacggaggcatattctaggctttcctatctctgccccaagcttccgcttatcggggagt

SEQ ID NO: 53339 - DNA, 157 bp, Homo sapiens; identical to SEQ ID NO: 32642
  misc_feature 1..157: note = chr9:112542235-112542392
  misc_feature 1..157: note = hyper
  source 1..157: mol_type = genomic DNA

SEQ ID NO: 53340 - DNA, 30 bp, Homo sapiens; identical to SEQ ID NO: 32643
  misc_feature 1..30: note = chr9:112542670-112542700
  misc_feature 1..30: note = hyper
  source 1..30: mol_type = genomic DNA

SEQ ID NO: 53341 - DNA, 257 bp, Homo sapiens
  misc_feature 1..257: note = chr9:113341265-113341522
  misc_feature 1..257: note = hyper
  source 1..257: mol_type = genomic DNA
ccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgc

SEQ ID NO: 53342 - DNA, 334 bp, Homo sapiens
  misc_feature 1..334: note = chr9:113341965-113342299
  misc_feature 1..334: note = hyper
  source 1..334: mol_type = genomic DNA
cactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaa

SEQ ID NO: 53343 - DNA, 30 bp, Homo sapiens; identical to SEQ ID NO: 32647
  misc_feature 1..30: note = chr9:113800111-113800141
  misc_feature 1..30: note = hyper
  source 1..30: mol_type = genomic DNA

SEQ ID NO: 53344 - DNA, 64 bp, Homo sapiens; identical to SEQ ID NO: 32648
  misc_feature 1..64: note = chr9:113800385-113800449
  misc_feature 1..64: note = hyper
  source 1..64: mol_type = genomic DNA

SEQ ID NO: 53345 - DNA, 300 bp, Homo sapiens; identical to SEQ ID NO: 32649
  misc_feature 1..300: note = chr9:113801080-113801380
  misc_feature 1..300: note = hyper
  source 1..300: mol_type = genomic DNA

SEQ ID NO: 53346 - DNA, 136 bp, Homo sapiens; identical to SEQ ID NO: 10028
  misc_feature 1..136: note = chr9:114287491-114287627
  misc_feature 1..136: note = hyper
  source 1..136: mol_type = genomic DNA

SEQ ID NO: 53347 - DNA, 138 bp, Homo sapiens; identical to SEQ ID NO: 32651
  misc_feature 1..138: note = chr9:114287962-114288100
  misc_feature 1..138: note = hyper
  source 1..138: mol_type = genomic DNA

SEQ ID NO: 53348 - DNA, 30 bp, Homo sapiens; identical to SEQ ID NO: 32652
  misc_feature 1..30: note = chr9:114361785-114361815
  misc_feature 1..30: note = hyper
  source 1..30: mol_type = genomic DNA

SEQ ID NO: 53349 - DNA, 50 bp, Homo sapiens; identical to SEQ ID NO: 32653
  misc_feature 1..50: note = chr9:114362053-114362103
  misc_feature 1..50: note = hyper
  source 1..50: mol_type = genomic DNA

SEQ ID NO: 53350 - DNA, 30 bp, Homo sapiens
  misc_feature 1..30: note = chr9:115652936-115652966
  misc_feature 1..30: note = hyper
  source 1..30: mol_type = genomic DNA
gcgggcaggtgacctcggggctcatgtgac

SEQ ID NO: 53351 - DNA, 132 bp, Homo sapiens; identical to SEQ ID NO: 20400
  misc_feature 1..132: note = chr9:115653425-115653557
  misc_feature 1..132: note = hyper
  source 1..132: mol_type = genomic DNA

SEQ ID NO: 53352 - DNA, 30 bp, Homo sapiens; identical to SEQ ID NO: 32655
  misc_feature 1..30: note = chr9:116756509-116756539
  misc_feature 1..30: note = hyper
  source 1..30: mol_type = genomic DNA

SEQ ID NO: 53353 - DNA, 43 bp, Homo sapiens; identical to SEQ ID NO: 32656
  misc_feature 1..43: note = chr9:116916374-116916417
  misc_feature 1..43: note = hyper
  source 1..43: mol_type = genomic DNA

SEQ ID NO: 53354 - DNA, 127 bp, Homo sapiens; identical to SEQ ID NO: 32657
  misc_feature 1..127: note = chr9:117267169-117267296
  misc_feature 1..127: note = hyper
  source 1..127: mol_type = genomic DNA

SEQ ID NO: 53355 - DNA, 59 bp, Homo sapiens; identical to SEQ ID NO: 32658
  misc_feature 1..59: note = chr9:117880343-117880402
  misc_feature 1..59: note = hyper
  source 1..59: mol_type = genomic DNA

SEQ ID NO: 53356 - DNA, 212 bp, Homo sapiens; identical to SEQ ID NO: 32659
  misc_feature 1..212: note = chr9:118916583-118916795
  misc_feature 1..212: note = hyper
  source 1..212: mol_type = genomic DNA

SEQ ID NO: 53357 - DNA, 30 bp, Homo sapiens; identical to SEQ ID NO: 10032
  misc_feature 1..30: note = chr9:118917350-118917380
  misc_feature 1..30: note = hyper
  source 1..30: mol_type = genomic DNA

SEQ ID NO: 53358 - DNA, 45 bp, Homo sapiens; identical to SEQ ID NO: 32661
  misc_feature 1..45: note = chr9:118917733-118917778
  misc_feature 1..45: note = hyper
  source 1..45: mol_type = genomic DNA

SEQ ID NO: 53359 - DNA, 30 bp, Homo sapiens; identical to SEQ ID NO: 32662
  misc_feature 1..30: note = chr9:118919318-118919348
  misc_feature 1..30: note = hyper
  source 1..30: mol_type = genomic DNA

SEQ ID NO: 53360 - DNA, 246 bp, Homo sapiens
  misc_feature 1..246: note = chr9:120175549-120175795
  misc_feature 1..246: note = hyper
  source 1..246: mol_type = genomic DNA
gcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaa

SEQ ID NO: 53361 - DNA, 272 bp, Homo sapiens
  misc_feature 1..272: note = chr9:120175832-120176104
  misc_feature 1..272: note = hyper
  source 1..272: mol_type = genomic DNA
atcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggta

SEQ ID NO: 53362 - DNA, 147 bp, Homo sapiens
  misc_feature 1..147: note = chr9:120176151-120176298
  misc_feature 1..147: note = hyper
  source 1..147: mol_type = genomic DNA
cagcaaccactcaagtctctccagccctatttcacagatggccagaactgaggctcagagaagggaagcgacttggccaaggtcactcagcccatgcggaagccacgcttttgcgggttgagcgattccacacggaactactccatt

SEQ ID NO: 53363 - DNA, 50 bp, Homo sapiens
  misc_feature 1..50: note = chr9:120176817-120176867
  misc_feature 1..50: note = hyper
  source 1..50: mol_type = genomic DNA
caccgcgatgcgccccggcagctcgttacgcacaaagagcaggaggcgcg

SEQ ID NO: 53364 - DNA, 612 bp, Homo sapiens
  misc_feature 1..612: note = chr9:120176897-120177509
  misc_feature 1..612: note = hyper
  source 1..612: mol_type = genomic DNA
agcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccaggacgcccgagctaaggagcggagagagccgctcgccagcagcccccagctccgggctccgcctcccgatcggccctggaccgcccccccgcgccgcctcccggggcccagccgcccgtccccgatctccggctccccccgcagaccccgagcgtttcggaggctccgcccggcctcgtgcaagtcccagt

SEQ ID NO: 53365 - DNA, 140 bp, Homo sapiens; identical to SEQ ID NO: 32665
  misc_feature 1..140: note = chr9:120177898-120178038
  misc_feature 1..140: note = hyper
  source 1..140: mol_type = genomic DNA

SEQ ID NO: 53366 - DNA, 211 bp, Homo sapiens; identical to SEQ ID NO: 32666
  misc_feature 1..211: note = chr9:122131005-122131216
  misc_feature 1..211: note = hyper
  source 1..211: mol_type = genomic DNA

SEQ ID NO: 53367 - DNA, 42 bp, Homo sapiens; identical to SEQ ID NO: 20409
  misc_feature 1..42: note = chr9:122131838-122131880
  misc_feature 1..42: note = hyper
  source 1..42: mol_type = genomic DNA

SEQ ID NO: 53368 - DNA, 42 bp, Homo sapiens; identical to SEQ ID NO: 32670
  misc_feature 1..42: note = chr9:124361888-124361930
  misc_feature 1..42: note = hyper
  source 1..42: mol_type = genomic DNA

SEQ ID NO: 53369 - DNA, 231 bp, Homo sapiens; identical to SEQ ID NO: 32671
  misc_feature 1..231: note = chr9:124990555-124990786
  misc_feature 1..231: note = hyper
  source 1..231: mol_type = genomic DNA

SEQ ID NO: 53370 - DNA, 114 bp, Homo sapiens; identical to SEQ ID NO: 32672
  misc_feature 1..114: note = chr9:124990828-124990942
  misc_feature 1..114: note = hyper
  source 1..114: mol_type = genomic DNA

SEQ ID NO: 53371 - DNA, 63 bp, Homo sapiens; identical to SEQ ID NO: 32673
  misc_feature 1..63: note = chr9:126138079-126138142
  misc_feature 1..63: note = hyper
  source 1..63: mol_type = genomic DNA

SEQ ID NO: 53372 - DNA, 189 bp, Homo sapiens; identical to SEQ ID NO: 32674
  misc_feature 1..189: note = chr9:126760259-126760448
  misc_feature 1..189: note = hyper
  source 1..189: mol_type = genomic DNA

SEQ ID NO: 53373 - DNA, 127 bp, Homo sapiens; identical to SEQ ID NO: 32675
  misc_feature 1..127: note = chr9:126761476-126761603
  misc_feature 1..127: note = hyper
  source 1..127: mol_type = genomic DNA

SEQ ID NO: 53374 - DNA, 1042 bp, Homo sapiens
  misc_feature 1..1042: note = chr9:126770490-126771532
  misc_feature 1..1042: note = hyper
  source 1..1042: mol_type = genomic DNA
acacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggag

SEQ ID NO: 53375 - DNA, 103 bp, Homo sapiens
  misc_feature 1..103: note = chr9:126771705-126771808
  misc_feature 1..103: note = hyper
  source 1..103: mol_type = genomic DNA
cacgtttcttgagcagcccgcggcaagagttgctgagtaccccaccccccgcccccagatcctaaggcagcccctcgagctttccaaacgtattgtatccagc

SEQ ID NO: 53376 - DNA, 528 bp, Homo sapiens; identical to SEQ ID NO: 32677
  misc_feature 1..528: note = chr9:126773252-126773780
  misc_feature 1..528: note = hyper
  source 1..528: mol_type = genomic DNA

SEQ ID NO: 53377 - DNA, 339 bp, Homo sapiens; identical to SEQ ID NO: 32678
  misc_feature 1..339: note = chr9:126773939-126774278
  misc_feature 1..339: note = hyper
  source 1..339: mol_type = genomic DNA

SEQ ID NO: 53378 - DNA, 96 bp, Homo sapiens; identical to SEQ ID NO: 32680
  misc_feature 1..96: note = chr9:126775412-126775508
  misc_feature 1..96: note = hyper
  source 1..96: mol_type = genomic DNA

SEQ ID NO: 53379 - DNA, 17 bp, Homo sapiens
  misc_feature 1..17: note = chr9:126778496-126778513
  misc_feature 1..17: note = hyper
  source 1..17: mol_type = genomic DNA
ctcgcgccggggtgggg

SEQ ID NO: 53380 - DNA, 15 bp, Homo sapiens
  misc_feature 1..15: note = chr9:126779147-126779162
  misc_feature 1..15: note = hyper
  source 1..15: mol_type = genomic DNA
aaaccgagttcagac

SEQ ID NO: 53381 - DNA, 247 bp, Homo sapiens
  misc_feature 1..247: note = chr9:126780564-126780811
  misc_feature 1..247: note = hyper
  source 1..247: mol_type = genomic DNA
aggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttcccc

SEQ ID NO: 53382 - DNA, 110 bp, Homo sapiens; identical to SEQ ID NO: 32688
  misc_feature 1..110: note = chr9:126781196-126781306
  misc_feature 1..110: note = hyper
  source 1..110: mol_type = genomic DNA

SEQ ID NO: 53383 - DNA, 30 bp, Homo sapiens; identical to SEQ ID NO: 32689
  misc_feature 1..30: note = chr9:126782415-126782445
  misc_feature 1..30: note = hyper
  source 1..30: mol_type = genomic DNA

SEQ ID NO: 53384 - DNA, 41 bp, Homo sapiens
  misc_feature 1..41: note = chr9:126783499-126783540
  misc_feature 1..41: note = hyper
  source 1..41: mol_type = genomic DNA
tactttgccattaaccacaaccccgacgccaaggacttgaa

SEQ ID NO: 53385 - DNA, 294 bp, Homo sapiens; identical to SEQ ID NO: 32691
  misc_feature 1..294: note = chr9:126785057-126785351
  misc_feature 1..294: note = hyper
  source 1..294: mol_type = genomic DNA

SEQ ID NO: 53386 - DNA, 36 bp, Homo sapiens; identical to SEQ ID NO: 32692
  misc_feature 1..36: note = chr9:126872665-126872701
  misc_feature 1..36: note = hyper
  source 1..36: mol_type = genomic DNA

SEQ ID NO: 53387 - DNA, 197 bp, Homo sapiens
  misc_feature 1..197: note = chr9:127212654-127212851
  misc_feature 1..197: note = hyper
  source 1..197: mol_type = genomic DNA
aggggcggggtctcccgggccgaggggcgggatctcctggtatctgccagagcccgccgctgcctccccgacttcagtccccgcagatgcctcgcagacggtgaacggccacaggcgccaggccagccatagcgggtgaggaactggagctgggaacaggggagggaccagcggatgaaggggaggcccctgactca

SEQ ID NO: 53388 - DNA, 64 bp, Homo sapiens; identical to SEQ ID NO: 32694
  misc_feature 1..64: note = chr9:127215890-127215954
  misc_feature 1..64: note = hyper
  source 1..64: mol_type = genomic DNA

SEQ ID NO: 53389 - DNA, 172 bp, Homo sapiens; identical to SEQ ID NO: 32695
  misc_feature 1..172: note = chr9:127239776-127239948
  misc_feature 1..172: note = hyper
  source 1..172: mol_type = genomic DNA

SEQ ID NO: 53390 - DNA, 66 bp, Homo sapiens
  misc_feature 1..66: note = chr9:127266025-127266091
  misc_feature 1..66: note = hyper
  source 1..66: mol_type = genomic DNA
gagatgggctcagccgcggggaagacgccaggggacccaggagcgctggggcgcccggcccgggtg

SEQ ID NO: 53391 - DNA, 56 bp, Homo sapiens
  misc_feature 1..56: note = chr9:127266331-127266387
  misc_feature 1..56: note = hyper
  source 1..56: mol_type = genomic DNA
gagagagagagagagagagagaaacgaggggtgggggattggatcagagactcgga

SEQ ID NO: 53392 - DNA, 54 bp, Homo sapiens; identical to SEQ ID NO: 20419
  misc_feature 1..54: note = chr9:127266534-127266588
  misc_feature 1..54: note = hyper
  source 1..54: mol_type = genomic DNA

SEQ ID NO: 53393 - DNA, 219 bp, Homo sapiens; identical to SEQ ID NO: 10058
  misc_feature 1..219: note = chr9:127266628-127266847
  misc_feature 1..219: note = hyper
  source 1..219: mol_type = genomic DNA

SEQ ID NO: 53394 - DNA, 201 bp, Homo sapiens; identical to SEQ ID NO: 32699
  misc_feature 1..201: note = chr9:127266865-127267066
  misc_feature 1..201: note = hyper
  source 1..201: mol_type = genomic DNA

SEQ ID NO: 53395 - DNA, 158 bp, Homo sapiens; identical to SEQ ID NO: 32700
  misc_feature 1..158: note = chr9:127267338-127267496
  misc_feature 1..158: note = hyper
  source 1..158: mol_type = genomic DNA

SEQ ID NO: 53396 - DNA, 59 bp, Homo sapiens; identical to SEQ ID NO: 32701
  misc_feature 1..59: note = chr9:127421470-127421529
  misc_feature 1..59: note = hyper
  source 1..59: mol_type = genomic DNA

SEQ ID NO: 53397 - DNA, 274 bp, Homo sapiens; identical to SEQ ID NO: 20423
  misc_feature 1..274: note = chr9:128651926-128652200
  misc_feature 1..274: note = hyper
  source 1..274: mol_type = genomic DNA

SEQ ID NO: 53398 - DNA, 182 bp, Homo sapiens
  misc_feature 1..182: note = chr9:128652232-128652414
  misc_feature 1..182: note = hyper
  source 1..182: mol_type = genomic DNA
ctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatg

SEQ ID NO: 53399 - DNA, 169 bp, Homo sapiens; identical to SEQ ID NO: 32703
  misc_feature 1..169: note = chr9:128984848-128985017
  misc_feature 1..169: note = hyper
  source 1..169: mol_type = genomic DNA

SEQ ID NO: 53400 - DNA, 94 bp, Homo sapiens
  misc_feature 1..94: note = chr9:129276624-129276718
  misc_feature 1..94: note = hyper
  source 1..94: mol_type = genomic DNA
ctccgcccccaaacacgggttctcacgcggtccggccgcgcgggggcgcccggctccccggccctcgctgggccctgcgggaacgccccggccg

SEQ ID NO: 53401 - DNA, 112 bp, Homo sapiens
  misc_feature 1..112: note = chr9:129276820-129276932
  misc_feature 1..112: note = hyper
  source 1..112: mol_type = genomic DNA
aggctagcccgccgcgcaagtccccgcagcgccccgccggcctcccaccccctgcggcgtccggacctcgtggacctggggtggctcccatagactgcggggccgggcccag

SEQ ID NO: 53402 - DNA, 207 bp, Homo sapiens
  misc_feature 1..207: note = chr9:129372722-129372929
  misc_feature 1..207: note = hyper
  source 1..207: mol_type = genomic DNA
ggcagctcatagagccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccc

SEQ ID NO: 53403 - DNA, 51 bp, Homo sapiens; identical to SEQ ID NO: 32706
  misc_feature 1..51: note = chr9:129373250-129373301
  misc_feature 1..51: note = hyper
  source 1..51: mol_type = genomic DNA

SEQ ID NO: 53404 - DNA, 30 bp, Homo sapiens; identical to SEQ ID NO: 32707
  misc_feature 1..30: note = chr9:129374814-129374844
  misc_feature 1..30: note = hyper
  source 1..30: mol_type = genomic DNA

SEQ ID NO: 53405 - DNA, 256 bp, Homo sapiens; identical to SEQ ID NO: 32708
  misc_feature 1..256: note = chr9:129375725-129375981
  misc_feature 1..256: note = hyper
  source 1..256: mol_type = genomic DNA

SEQ ID NO: 53406 - DNA, 119 bp, Homo sapiens
  misc_feature 1..119: note = chr9:129376199-129376318
  misc_feature 1..119: note = hyper
  source 1..119: mol_type = genomic DNA
cgccgccagccccagctctaaacccggcggctcagcgggcgcaccatggcactggagtagcgcggggagcgcgcccggagccccgcggcccgctgcgccccgcccgggaccccgctgcg

SEQ ID NO: 53407 - DNA, 131 bp, Homo sapiens; identical to SEQ ID NO: 32710
  misc_feature 1..131: note = chr9:129376549-129376680
  misc_feature 1..131: note = hyper
  source 1..131: mol_type = genomic DNA

SEQ ID NO: 53408 - DNA, 110 bp, Homo sapiens
  misc_feature 1..110: note = chr9:129377104-129377214
  misc_feature 1..110: note = hyper
  source 1..110: mol_type = genomic DNA
ctagagctgccactccgatgtggtaggtggcgggtggcaggggtgatggaggacctagcaatcaccttggcgagcttgggagaggcgcaaggtcacctggggtgggggag

SEQ ID NO: 53409 - DNA, 36 bp, Homo sapiens
  misc_feature 1..36: note = chr9:129377316-129377352
  misc_feature 1..36: note = hyper
  source 1..36: mol_type = genomic DNA
gcgccccagcctcacctcgcctgtcttggtcccagc

SEQ ID NO: 53410 - DNA, 12 bp, Homo sapiens
  misc_feature 1..12: note = chr9:129377592-129377604
  misc_feature 1..12: note = hyper
  source 1..12: mol_type = genomic DNA
ggtgcgaccggg

SEQ ID NO: 53411 - DNA, 30 bp, Homo sapiens; identical to SEQ ID NO: 32714
  misc_feature 1..30: note = chr9:129380664-129380694
  misc_feature 1..30: note = hyper
  source 1..30: mol_type = genomic DNA

SEQ ID NO: 53412 - DNA, 137 bp, Homo sapiens; identical to SEQ ID NO: 32715
  misc_feature 1..137: note = chr9:129386060-129386197
  misc_feature 1..137: note = hyper
  source 1..137: mol_type = genomic DNA

SEQ ID NO: 53413 - DNA, 193 bp, Homo sapiens; identical to SEQ ID NO: 32716
  misc_feature 1..193: note = chr9:129386429-129386622
  misc_feature 1..193: note = hyper
  source 1..193: mol_type = genomic DNA

SEQ ID NO: 53414 - DNA, 121 bp, Homo sapiens
  misc_feature 1..121: note = chr9:129388200-129388321
  misc_feature 1..121: note = hyper
  source 1..121: mol_type = genomic DNA
cgggcgtcggagaagcggccgcgctgttccgggtcactgcaccggctgaaaaaaccaaaagcaaaaccaacacccagaaacgaagcctgcgtgcccccgggggctccgttttgctcccctc

SEQ ID NO: 53415 - DNA, 104 bp, Homo sapiens
  misc_feature 1..104: note = chr9:129388892-129388996
  misc_feature 1..104: note = hyper
  source 1..104: mol_type = genomic DNA
agagactttctccctcgaaacacttgataccaactttgtttttttggcaagaaaaataagccttgtttggaaaggggtgggtggggggcgtcgagcgagcgagg

SEQ ID NO: 53416 - DNA, 52 bp, Homo sapiens
  misc_feature 1..52: note = chr9:129389192-129389244
  misc_feature 1..52: note = hyper
  source 1..52: mol_type = genomic DNA
tcagcccggccgggcccgcagcgtccgccggtccgtccgggctcctctgcag

SEQ ID NO: 53417 - DNA, 138 bp, Homo sapiens
  misc_feature 1..138: note = chr9:129400848-129400986
  misc_feature 1..138: note = hyper
  source 1..138: mol_type = genomic DNA
agtgattgccaggcccgcttggcagtttttaatcattttatctctgttctcggctctcgggggagacagccagtgcttagcagtctgctcagaaagacctcggggcgcgtggcgcagcggcggctcggagctcccatt

SEQ ID NO: 53418 - DNA, 93 bp, Homo sapiens; identical to SEQ ID NO: 32720
  misc_feature 1..93: note = chr9:129414430-129414523
  misc_feature 1..93: note = hyper
  source 1..93: mol_type = genomic DNA

SEQ ID NO: 53419 - DNA, 217 bp, Homo sapiens
  misc_feature 1..217: note = chr9:129445566-129445783
  misc_feature 1..217: note = hyper
  source 1..217: mol_type = genomic DNA
cggctcccgccgccgcccgcccggcccgcggccgccgcatcaaagcagatgtttgcagctggtttgagttggatccccatcaacaggcccttttttgtctcaaaataaaaaacagctacgcccggaatgataaggacgcggcaggcacgtgggggagatgtcagcgagtccggcagggaggaggccgggcggctccctctctaagtgacaggctgac

SEQ ID NO: 53420 - DNA, 82 bp, Homo sapiens
  misc_feature 1..82: note = chr9:129445813-129445895
  misc_feature 1..82: note = hyper
  source 1..82: mol_type = genomic DNA
gtctagggtcctgtcgcctagctcctgtgaactgcagctcatccttcagccggcatcatcagagccccgtcccgcccacaac

SEQ ID NO: 53421 - DNA, 92 bp, Homo sapiens; identical to SEQ ID NO: 32722
  misc_feature 1..92: note = chr9:129485680-129485772
  misc_feature 1..92: note = hyper
  source 1..92: mol_type = genomic DNA

SEQ ID NO: 53422 - DNA, 189 bp, Homo sapiens; identical to SEQ ID NO: 20437
  misc_feature 1..189: note = chr9:130461742-130461931
  misc_feature 1..189: note = hyper
  source 1..189: mol_type = genomic DNA

SEQ ID NO: 53423 - DNA, 30 bp, Homo sapiens; identical to SEQ ID NO: 32724
  misc_feature 1..30: note = chr9:130689420-130689450
  misc_feature 1..30: note = hyper
  source 1..30: mol_type = genomic DNA

SEQ ID NO: 53424 - DNA, 115 bp, Homo sapiens; identical to SEQ ID NO: 32725
  misc_feature 1..115: note = chr9:131127226-131127341
  misc_feature 1..115: note = hyper
  source 1..115: mol_type = genomic DNA

SEQ ID NO: 53425 - DNA, 193 bp, Homo sapiens; identical to SEQ ID NO: 32726
  misc_feature 1..193: note = chr9:131159439-131159632
  misc_feature 1..193: note = hyper
  source 1..193: mol_type = genomic DNA

SEQ ID NO: 53426 - DNA, 345 bp, Homo sapiens; identical to SEQ ID NO: 32727
  misc_feature 1..345: note = chr9:131872500-131872845
  misc_feature 1..345: note = hyper
  source 1..345: mol_type = genomic DNA

SEQ ID NO: 53427 - DNA, 64 bp, Homo sapiens; identical to SEQ ID NO: 32728
  misc_feature 1..64: note = chr9:131872856-131872920
  misc_feature 1..64: note = hyper
  source 1..64: mol_type = genomic DNA

SEQ ID NO: 53428 - DNA, 164 bp, Homo sapiens; identical to SEQ ID NO: 32729
  misc_feature 1..164: note = chr9:132020946-132021110
  misc_feature 1..164: note = hyper
  source 1..164: mol_type = genomic DNA

SEQ ID NO: 53429 - DNA, 95 bp, Homo sapiens; identical to SEQ ID NO: 32730
  misc_feature 1..95: note = chr9:132382260-132382355
  misc_feature 1..95: note = hyper
  source 1..95: mol_type = genomic DNA

SEQ ID NO: 53430 - DNA, 71 bp, Homo sapiens; identical to SEQ ID NO: 32732
  misc_feature 1..71: note = chr9:132428052-132428123
  misc_feature 1..71: note = hyper
  source 1..71: mol_type = genomic DNA

SEQ ID NO: 53431 - DNA, 256 bp, Homo sapiens; identical to SEQ ID NO: 32733
  misc_feature 1..256: note = chr9:132428401-132428657
  misc_feature 1..256: note = hyper
  source 1..256: mol_type = genomic DNA

SEQ ID NO: 53432 - DNA, 30 bp, Homo sapiens; identical to SEQ ID NO: 32734
  misc_feature 1..30: note = chr9:132459828-132459858
  misc_feature 1..30: note = hyper
  source 1..30: mol_type = genomic DNA

SEQ ID NO: 53433 - DNA, 26 bp, Homo sapiens
  misc_feature 1..26: note = chr9:133308867-133308893
  misc_feature 1..26: note = hyper
  source 1..26: mol_type = genomic DNA
ggcgtccccgccaaccgcaccgagct

SEQ ID NO: 53434 - DNA, 100 bp, Homo sapiens
  misc_feature 1..100: note = chr9:133308941-133309041
  misc_feature 1..100: note = hyper
  source 1..100: mol_type = genomic DNA
gcgcgcgggccttggcgcggtctacacccgtcgcgcgctcacccgcgccggcctctaccggctcaccgtgcgtgctgcggcaccgcgccaccaaagcgtc

SEQ ID NO: 53435 - DNA, 112 bp, Homo sapiens; identical to SEQ ID NO: 32737
  misc_feature 1..112: note = chr9:133320662-133320774
  misc_feature 1..112: note = hyper
  source 1..112: mol_type = genomic DNA

SEQ ID NO: 53436 - DNA, 103 bp, Homo sapiens
  misc_feature 1..103: note = chr9:133534580-133534683
  misc_feature 1..103: note = hyper
  source 1..103: mol_type = genomic DNA
cgagtctttgtacccctgcgtctccgactcggcctttcatctgctccctccacctcggcatcgccttgcctcagtctcccccgacccctgtctcgccccctct

SEQ ID NO: 53437 - DNA, 257 bp, Homo sapiens
  misc_feature 1..257: note = chr9:133534713-133534970
  misc_feature 1..257: note = hyper
  source 1..257: mol_type = genomic DNA
caccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttg

SEQ ID NO: 53438 - DNA, 189 bp, Homo sapiens; identical to SEQ ID NO: 32739
  misc_feature 1..189: note = chr9:133535296-133535485
  misc_feature 1..189: note = hyper
  source 1..189: mol_type = genomic DNA

SEQ ID NO: 53439 - DNA, 95 bp, Homo sapiens; identical to SEQ ID NO: 20447
  misc_feature 1..95: note = chr9:133535839-133535934
  misc_feature 1..95: note = hyper
  source 1..95: mol_type = genomic DNA

SEQ ID NO: 53440 - DNA, 126 bp, Homo sapiens; identical to SEQ ID NO: 20448
  misc_feature 1..126: note = chr9:133535971-133536097
  misc_feature 1..126: note = hyper
  source 1..126: mol_type = genomic DNA

SEQ ID NO: 53441 - skipped

SEQ ID NO: 53442 - DNA, 184 bp, Homo sapiens; identical to SEQ ID NO: 32743
  misc_feature 1..184: note = chr9:133536346-133536530
  misc_feature 1..184: note = hyper
  source 1..184: mol_type = genomic DNA

SEQ ID NO: 53443 - skipped

SEQ ID NO: 53444 - DNA, 313 bp, Homo sapiens
  misc_feature 1..313: note = chr9:133536869-133537182
  misc_feature 1..313: note = hyper
  source 1..313: mol_type = genomic DNA
agcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcg

SEQ ID NO: 53445 - DNA, 569 bp, Homo sapiens
  misc_feature 1..569: note = chr9:133537600-133538169
  misc_feature 1..569: note = hyper
  source 1..569: mol_type = genomic DNA
tggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgct

SEQ ID NO: 53446 - DNA, 492 bp, Homo sapiens
  misc_feature 1..492: note = chr9:133538728-133539220
  misc_feature 1..492: note = hyper
  source 1..492: mol_type = genomic DNA
tttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 53447 - DNA, 523 bp, Homo sapiens
  misc_feature 1..523: note = chr9:133539709-133540232
  misc_feature 1..523: note = hyper
  source 1..523: mol_type = genomic DNA
ctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcacc

SEQ ID NO: 53448 - DNA, 37 bp, Homo sapiens; identical to SEQ ID NO: 10093
  misc_feature 1..37: note = chr9:133540453-133540490
  misc_feature 1..37: note = hyper
  source 1..37: mol_type = genomic DNA

SEQ ID NO: 53449 - DNA, 273 bp, Homo sapiens; identical to SEQ ID NO: 20456
  misc_feature 1..273: note = chr9:133541192-133541465
  misc_feature 1..273: note = hyper
  source 1..273: mol_type = genomic DNA

SEQ ID NO: 53450 - DNA, 24 bp, Homo sapiens
  misc_feature 1..24: note = chr9:133541665-133541689
  misc_feature 1..24: note = hyper
  source 1..24: mol_type = genomic DNA
attcttaaacttatccggggcaga

SEQ ID NO: 53451 - DNA, 85 bp, Homo sapiens
  misc_feature 1..85: note = chr9:133542337-133542422
  misc_feature 1..85: note = hyper
  source 1..85: mol_type = genomic DNA
cccgagcctggagctcaccccgcctctaggctcctcccaacccgtgccgaaaatccgaccctccttcccccggacaccctggcag

SEQ ID NO: 53452 - DNA, 42 bp, Homo sapiens; identical to SEQ ID NO: 32750
  misc_feature 1..42: note = chr9:133884491-133884533
  misc_feature 1..42: note = hyper
  source 1..42: mol_type = genomic DNA

SEQ ID NO: 53453 - DNA, 30 bp, Homo sapiens; identical to SEQ ID NO: 32751
  misc_feature 1..30: note = chr9:133884902-133884932
  misc_feature 1..30: note = hyper
  source 1..30: mol_type = genomic DNA

SEQ ID NO: 53454 - DNA, 546 bp, Homo sapiens; identical to SEQ ID NO: 32752
  misc_feature 1..546: note = chr9:134151976-134152522
  misc_feature 1..546: note = hyper
  source 1..546: mol_type = genomic DNA

SEQ ID NO: 53455 - DNA, 225 bp, Homo sapiens; identical to SEQ ID NO: 32753
  misc_feature 1..225: note = chr9:134158243-134158468
  misc_feature 1..225: note = hyper
  source 1..225: mol_type = genomic DNA

SEQ ID NO: 53456 - DNA, 32 bp, Homo sapiens; identical to SEQ ID NO: 32754
  misc_feature 1..32: note = chr9:134421906-134421938
  misc_feature 1..32: note = hyper
  source 1..32: mol_type = genomic DNA

SEQ ID NO: 53457 - DNA, 84 bp, Homo sapiens; identical to SEQ ID NO: 32755
  misc_feature 1..84: note = chr9:135036830-135036914
  misc_feature 1..84: note = hyper
  source 1..84: mol_type = genomic DNA

SEQ ID NO: 53458 - DNA, 111 bp, Homo sapiens; identical to SEQ ID NO: 32758
  misc_feature 1..111: note = chr9:135038352-135038463
  misc_feature 1..111: note = hyper
  source 1..111: mol_type = genomic DNA

SEQ ID NO: 53459 - DNA, 153 bp, Homo sapiens; identical to SEQ ID NO: 32759
  misc_feature 1..153: note = chr9:135116312-135116465
  misc_feature 1..153: note = hyper
  source 1..153: mol_type = genomic DNA

SEQ ID NO: 53460 - DNA, 30 bp, Homo sapiens; identical to SEQ ID NO: 32760
  misc_feature 1..30: note = chr9:135118020-135118050
  misc_feature 1..30: note = hyper
  source 1..30: mol_type = genomic DNA

SEQ ID NO: 53461 - DNA, 47 bp, Homo sapiens; identical to SEQ ID NO: 32761
  misc_feature 1..47: note = chr9:135285476-135285523
  misc_feature 1..47: note = hyper
  source 1..47: mol_type = genomic DNA

SEQ ID NO: 53462 - DNA, 134 bp, Homo sapiens; identical to SEQ ID NO: 32762
  misc_feature 1..134: note = chr9:135285731-135285865
  misc_feature 1..134: note = hyper
  source 1..134: mol_type = genomic DNA

SEQ ID NO: 53463 - DNA, 169 bp, Homo sapiens; identical to SEQ ID NO: 10098
  misc_feature 1..169: note = chr9:135285880-135286049
  misc_feature 1..169: note = hyper
  source 1..169: mol_type = genomic DNA

SEQ ID NO: 53464 - DNA, 41 bp, Homo sapiens; identical to SEQ ID NO: 32764
  misc_feature 1..41: note = chr9:135286274-135286315
  misc_feature 1..41: note = hyper
  source 1..41: mol_type = genomic DNA

SEQ ID NO: 53465 - DNA, 30 bp, Homo sapiens; identical to SEQ ID NO: 32765
  misc_feature 1..30: note = chr9:135287745-135287775
  misc_feature 1..30: note = hyper
  source 1..30: mol_type = genomic DNA

SEQ ID NO: 53466 - DNA, 253 bp, Homo sapiens; identical to SEQ ID NO: 32766
  misc_feature 1..253: note = chr9:135454991-135455244
  misc_feature 1..253: note = hyper
  source 1..253: mol_type = genomic DNA

SEQ ID NO: 53467 - DNA, 120 bp, Homo sapiens
  misc_feature 1..120: note = chr9:135455287-135455407
  misc_feature 1..120: note = hyper
  source 1..120: mol_type = genomic DNA
cgctttcgctgggtccgggatccaaatcccaacccaagagccaaaggccagaaaaggccctggcgttgccagctgcttgtcgccctggggaggggcggctccggacccgcccggggcaga

SEQ ID NO: 53468 - DNA, 411 bp, Homo sapiens; identical to SEQ ID NO: 20463
  misc_feature 1..411: note = chr9:135455585-135455996
  misc_feature 1..411: note = hyper
  source 1..411: mol_type = genomic DNA

SEQ ID NO: 53469 - DNA, 126 bp, Homo sapiens; identical to SEQ ID NO: 32768
  misc_feature 1..126: note = chr9:135456079-135456205
  misc_feature 1..126: note = hyper
  source 1..126: mol_type = genomic DNA

SEQ ID NO: 53470 - DNA, 140 bp, Homo sapiens; identical to SEQ ID NO: 32769
  misc_feature 1..140: note = chr9:135456234-135456374
  misc_feature 1..140: note = hyper
  source 1..140: mol_type = genomic DNA

SEQ ID NO: 53471 - DNA, 137 bp, Homo sapiens
  misc_feature 1..137: note = chr9:135456760-135456897
  misc_feature 1..137: note = hyper
  source 1..137: mol_type = genomic DNA
ggctttccccactcccgccaggcccacagggtcccaagaggccagagagacaggactgcaaattgtcctacatgggaaacaccgagagcccaacagaaatgccgcaaacaacataacttgaattttcttccccacac

SEQ ID NO: 53472 - DNA, 738 bp, Homo sapiens; identical to SEQ ID NO: 32771
  misc_feature 1..738: note = chr9:135456959-135457697
  misc_feature 1..738: note = hyper
  source 1..738: mol_type = genomic DNA

SEQ ID NO: 53473 - DNA, 102 bp, Homo sapiens; identical to SEQ ID NO: 32772
  misc_feature 1..102: note = chr9:135457946-135458048
  misc_feature 1..102: note = hyper
  source 1..102: mol_type = genomic DNA

SEQ ID NO: 53474 - DNA, 32 bp, Homo sapiens; identical to SEQ ID NO: 32773
  misc_feature 1..32: note = chr9:135458408-135458440
  misc_feature 1..32: note = hyper
  source 1..32: mol_type = genomic DNA

SEQ ID NO: 53475 - DNA, 21 bp, Homo sapiens
  misc_feature 1..21: note = chr9:135458456-135458477
  misc_feature 1..21: note = hyper
  source 1..21: mol_type = genomic DNA
cgtcacctcctcctttctgat

SEQ ID NO: 53476 - DNA, 50 bp, Homo sapiens
  misc_feature 1..50: note = chr9:135458597-135458647
  misc_feature 1..50: note = hyper
  source 1..50: mol_type = genomic DNA
agacaagctggacaaaagtggcagcaacgcctcatcggactctgagtata

SEQ ID NO: 53477 - DNA, 27 bp, Homo sapiens
  misc_feature 1..27: note = chr9:135460176-135460203
  misc_feature 1..27: note = hyper
  source 1..27: mol_type = genomic DNA
ttgctcctcccccggggggcctgctta

SEQ ID NO: 53478 - DNA, 30 bp, Homo sapiens; identical to SEQ ID NO: 32776
  misc_feature 1..30: note = chr9:135461292-135461322
  misc_feature 1..30: note = hyper
  source 1..30: mol_type = genomic DNA

SEQ ID NO: 53479 - DNA, 275 bp, Homo sapiens
  misc_feature 1..275: note = chr9:135461773-135462048
  misc_feature 1..275: note = hyper
  source 1..275: mol_type = genomic DNA
aggagggtgagcattgagcttgttcgattaagtgttttctgtgcagtcaaagccgaacgaaagtgtctgggataaagaaactacctgtgccaggtctatccttcgacctcaggagctgggcccccggtgtaattctgtcccgactgtggggtgtaaacacacgatgccacgcaggtgtagcaggagccatcgttagcgggcaatgtaatgacaacggaacgcagacctgggcaatgcgcgctgcgcccaaggggcaagcgagtggcagggtcgct

SEQ ID NO: 53480 - DNA, 175 bp, Homo sapiens; identical to SEQ ID NO: 32779
  misc_feature 1..175: note = chr9:135464001-135464176
  misc_feature 1..175: note = hyper
  source 1..175: mol_type = genomic DNA

SEQ ID NO: 53481 - DNA, 48 bp, Homo sapiens
  misc_feature 1..48: note = chr9:135464750-135464798
  misc_feature 1..48: note = hyper
  source 1..48: mol_type = genomic DNA
gcgctctacctgtaccgcggccccagcgcgccgccgcctgctctccag

SEQ ID NO: 53482 - DNA, 21 bp, Homo sapiens
  misc_feature 1..21: note = chr9:135464918-135464939
  misc_feature 1..21: note = hyper
  source 1..21: mol_type = genomic DNA
cggctccggggcctcctcccg

SEQ ID NO: 53483 - DNA, 717 bp, Homo sapiens
  misc_feature 1..717: note = chr9:135465231-135465948
  misc_feature 1..717: note = hyper
  source 1..717: mol_type = genomic DNA
ccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccgga

SEQ ID NO: 53484 - DNA, 212 bp, Homo sapiens
  misc_feature 1..212: note = chr9:135466132-135466344
  misc_feature 1..212: note = hyper
  source 1..212: mol_type = genomic DNA
cgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctctt

SEQ ID NO: 53485 - DNA, 280 bp, Homo sapiens; identical to SEQ ID NO: 32783
  misc_feature 1..280: note = chr9:135645863-135646143
  misc_feature 1..280: note = hyper
  source 1..280: mol_type = genomic DNA

SEQ ID NO: 53486 - DNA, 456 bp, Homo sapiens; identical to SEQ ID NO: 32784
  misc_feature 1..456: note = chr9:136038991-136039447
  misc_feature 1..456: note = hyper
  source 1..456: mol_type = genomic DNA

SEQ ID NO: 53487 - DNA, 55 bp, Homo sapiens; identical to SEQ ID NO: 32785
  misc_feature 1..55: note = chr9:136400112-136400167
  misc_feature 1..55: note = hyper
  source 1..55: mol_type = genomic DNA

SEQ ID NO: 53488 - DNA, 131 bp, Homo sapiens; identical to SEQ ID NO: 32786
  misc_feature 1..131: note = chr9:136474260-136474391
  misc_feature 1..131: note = hyper
  source 1..131: mol_type = genomic DNA

SEQ ID NO: 53489 - DNA, 59 bp, Homo sapiens
  misc_feature 1..59: note = chr9:136474431-136474490
  misc_feature 1..59: note = hyper
  source 1..59: mol_type = genomic DNA
cgcgactccggacgccccggctggctccctgcgagctgcacgcgcggctccagcctggt

SEQ ID NO: 53490 - DNA, 30 bp, Homo sapiens; identical to SEQ ID NO: 32788
  misc_feature 1..30: note = chr9:136603602-136603632
  misc_feature 1..30: note = hyper
  source 1..30: mol_type = genomic DNA

SEQ ID NO: 53491 - DNA, 30 bp, Homo sapiens; identical to SEQ ID NO: 32789
  misc_feature 1..30: note = chr9:136658309-136658339
  misc_feature 1..30: note = hyper
  source 1..30: mol_type = genomic DNA

SEQ ID NO: 53492 - DNA, 90 bp, Homo sapiens; identical to SEQ ID NO: 32790
  misc_feature 1..90: note = chr9:136931060-136931150
  misc_feature 1..90: note = hyper
  source 1..90: mol_type = genomic DNA

SEQ ID NO: 53493 - DNA, 39 bp, Homo sapiens; identical to SEQ ID NO: 32791
  misc_feature 1..39: note = chr9:137295661-137295700
  misc_feature 1..39: note = hyper
  source 1..39: mol_type = genomic DNA

SEQ ID NO: 53494 - DNA, 30 bp, Homo sapiens; identical to SEQ ID NO: 32793
  misc_feature 1..30: note = chr9:137533003-137533033
  misc_feature 1..30: note = hyper
  source 1..30: mol_type = genomic DNA

SEQ ID NO: 53495 - DNA, 42 bp, Homo sapiens; identical to SEQ ID NO: 32794
  misc_feature 1..42: note = chr9:137533555-137533597
  misc_feature 1..42: note = hyper
  source 1..42: mol_type = genomic DNA

SEQ ID NO: 53496 - DNA, 148 bp, Homo sapiens; identical to SEQ ID NO: 32795
  misc_feature 1..148: note = chr9:137533819-137533967
  misc_feature 1..148: note = hyper
  source 1..148: mol_type = genomic DNA

SEQ ID NO: 53497 - DNA, 320 bp, Homo sapiens
  misc_feature 1..320: note = chr9:137534238-137534558
  misc_feature 1..320: note = hyper
  source 1..320: mol_type = genomic DNA
ccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagtta

SEQ ID NO: 53498 - DNA, 170 bp, Homo sapiens; identical to SEQ ID NO: 32797
  misc_feature 1..170: note = chr9:137967194-137967364
  misc_feature 1..170: note = hyper
  source 1..170: mol_type = genomic DNA

SEQ ID NO: 53499 - DNA, 179 bp, Homo sapiens; identical to SEQ ID NO: 32798
  misc_feature 1..179: note = chr9:137967472-137967651
  misc_feature 1..179: note = hyper
  source 1..179: mol_type = genomic DNA

SEQ ID NO: 53500 - DNA, 243 bp, Homo sapiens; identical to SEQ ID NO: 32799
  misc_feature 1..243: note = chr9:137967688-137967931
  misc_feature 1..243: note = hyper
  source 1..243: mol_type = genomic DNA

SEQ ID NO: 53501 - DNA, 180 bp, Homo sapiens; identical to SEQ ID NO: 32800
  misc_feature 1..180: note = chr9:137979493-137979673
  misc_feature 1..180: note = hyper
  source 1..180: mol_type = genomic DNA

SEQ ID NO: 53502 - DNA, 133 bp, Homo sapiens
  misc_feature 1..133: note = chr9:137980011-137980144
  misc_feature 1..133: note = hyper
  source 1..133: mol_type = genomic DNA
cgcggctcctcctcctcctcctcctccccctcctcggtccggagccccgggctgggcgggcgccgcgcgggacccgagtcgcccagggaggcggcggggagcagggcgggcaagggcaggcgtcgcgggccgg

SEQ ID NO: 53503 - DNA, 42 bp, Homo sapiens
  misc_feature 1..42: note = chr9:137980216-137980258
  misc_feature 1..42: note = hyper
  source 1..42: mol_type = genomic DNA
cggcgtttccttcgtctgggcccctcgccgcggggccggggg

SEQ ID NO: 53504 - DNA, 592 bp, Homo sapiens
  misc_feature 1..592: note = chr9:137980288-137980880
  misc_feature 1..592: note = hyper
  source 1..592: mol_type = genomic DNA
ctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaa

SEQ ID NO: 53505 - DNA, 62 bp, Homo sapiens
  misc_feature 1..62: note = chr9:137980910-137980972
  misc_feature 1..62: note = hyper
  source 1..62: mol_type = genomic DNA
ctctctctttttgctgccaggggtttagtgccctgcgaagagggctccgtggtgtggctccc

SEQ ID NO: 53506 - DNA, 95 bp, Homo sapiens; identical to SEQ ID NO: 3486
  misc_feature 1..95: note = chr9:138606154-138606249
  misc_feature 1..95: note = hyper
  source 1..95: mol_type = genomic DNA

SEQ ID NO: 53507 - DNA, 72 bp, Homo sapiens; identical to SEQ ID NO: 32804
  misc_feature 1..72: note = chr9:138606523-138606595
  misc_feature 1..72: note = hyper
  source 1..72: mol_type = genomic DNA

SEQ ID NO: 53508 - DNA, 30 bp, Homo sapiens; identical to SEQ ID NO: 32805
  misc_feature 1..30: note = chr9:138607023-138607053
  misc_feature 1..30: note = hyper
  source 1..30: mol_type = genomic DNA

SEQ ID NO: 53509 - DNA, 30 bp, Homo sapiens; identical to SEQ ID NO: 32806
  misc_feature 1..30: note = chr9:138628067-138628097
  misc_feature 1..30: note = hyper
  source 1..30: mol_type = genomic DNA

SEQ ID NO: 53510 - DNA, 404 bp, Homo sapiens; identical to SEQ ID NO: 32807
  misc_feature 1..404: note = chr9:138628339-138628743
  misc_feature 1..404: note = hyper
  source 1..404: mol_type = genomic DNA

SEQ ID NO: 53511 - DNA, 69 bp, Homo sapiens; identical to SEQ ID NO: 32808
  misc_feature 1..69: note = chr9:139024452-139024521
  misc_feature 1..69: note = hyper
  source 1..69: mol_type = genomic DNA

SEQ ID NO: 53512 - DNA, 122 bp, Homo sapiens
  misc_feature 1..122: note = chr9:139024782-139024904
  misc_feature 1..122: note = hyper
  source 1..122: mol_type = genomic DNA
cctgttcgtggggtccctggggtgcaggggtggaggacataggagtgtgggggtcgtgggcagacccaggcgggacgctgtgccagtgccgccccgaaggcccagtgcgcagggtcccccgc

SEQ ID NO: 53513 - DNA, 54 bp, Homo sapiens; identical to SEQ ID NO: 10123
  misc_feature 1..54: note = chr9:139025663-139025717
  misc_feature 1..54: note = hyper
  source 1..54: mol_type = genomic DNA

SEQ ID NO: 53514 - DNA, 594 bp, Homo sapiens
  misc_feature 1..594: note = chr9:139084634-139085228
  misc_feature 1..594: note = hyper
  source 1..594: mol_type = genomic DNA
gggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctga

SEQ ID NO: 53515 - DNA, 211 bp, Homo sapiens; identical to SEQ ID NO: 32812
  misc_feature 1..211: note = chr9:139085372-139085583
  misc_feature 1..211: note = hyper
  source 1..211: mol_type = genomic DNA

SEQ ID NO: 53516 - DNA, 36 bp, Homo sapiens; identical to SEQ ID NO: 32813
  misc_feature 1..36: note = chr9:139085792-139085828
  misc_feature 1..36: note = hyper
  source 1..36: mol_type = genomic DNA

SEQ ID NO: 53517 - DNA, 174 bp, Homo sapiens; identical to SEQ ID NO: 32814
  misc_feature 1..174: note = chr9:139085985-139086159
  misc_feature 1..174: note = hyper
  source 1..174: mol_type = genomic DNA

SEQ ID NO: 53518 - DNA, 336 bp, Homo sapiens; identical to SEQ ID NO: 32815
  misc_feature 1..336: note = chr9:139089123-139089459
  misc_feature 1..336: note = hyper
  source 1..336: mol_type = genomic DNA

SEQ ID NO: 53519 - DNA, 95 bp, Homo sapiens
  misc_feature 1..95: note = chr9:139090405-139090500
  misc_feature 1..95: note = hyper
  source 1..95: mol_type = genomic DNA
tgggaaattcagatccgcgggctccctgggacccctgcgaccccgccgacgcgcgctcgtccccccccgagctccgcgatccctccgcctaccgg

SEQ ID NO: 53520 - DNA, 156 bp, Homo sapiens; identical to SEQ ID NO: 10130
  misc_feature 1..156: note = chr9:139090586-139090742
  misc_feature 1..156: note = hyper
  source 1..156: mol_type = genomic DNA

SEQ ID NO: 53521 - DNA, 156 bp, Homo sapiens; identical to SEQ ID NO: 20486
  misc_feature 1..156: note = chr9:139091369-139091525
  misc_feature 1..156: note = hyper
  source 1..156: mol_type = genomic DNA

SEQ ID NO: 53522 - DNA, 33 bp, Homo sapiens; identical to SEQ ID NO: 20487
  misc_feature 1..33: note = chr9:139093890-139093923
  misc_feature 1..33: note = hyper
  source 1..33: mol_type = genomic DNA

SEQ ID NO: 53523 - DNA, 178 bp, Homo sapiens; identical to SEQ ID NO: 32820
  misc_feature 1..178: note = chr9:139094021-139094199
  misc_feature 1..178: note = hyper
  source 1..178: mol_type = genomic DNA

SEQ ID NO: 53524 - DNA, 70 bp, Homo sapiens
  misc_feature 1..70: note = chr9:139094635-139094705
  misc_feature 1..70: note = hyper
  source 1..70: mol_type = genomic DNA
aaatacaggctgaggcgcccaggcgcggacgttccggggtcctcgcgcccactcccgcccagatcctcta

SEQ ID NO: 53525 - DNA, 117 bp, Homo sapiens; identical to SEQ ID NO: 32822
  misc_feature 1..117: note = chr9:139095014-139095131
  misc_feature 1..117: note = hyper
  source 1..117: mol_type = genomic DNA

SEQ ID NO: 53526 - DNA, 175 bp, Homo sapiens
  misc_feature 1..175: note = chr9:139095165-139095340
  misc_feature 1..175: note = hyper
  source 1..175: mol_type = genomic DNA
cgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaag

SEQ ID NO: 53527 - DNA, 66 bp, Homo sapiens
  misc_feature 1..66: note = chr9:139096584-139096650
  misc_feature 1..66: note = hyper
  source 1..66: mol_type = genomic DNA
actcttgcaggccagcgtcaggccctccccgccaccctgggatctggaaactcactctctgcagtt

SEQ ID NO: 53528 - DNA, 109 bp, Homo sapiens
  misc_feature 1..109: note = chr9:139097006-139097115
  misc_feature 1..109: note = hyper
  source 1..109: mol_type = genomic DNA
cgcccgctgcccgccccgcccgcgcgcccgcccacctcccggggcccctctcgtcgccccggtccccacccccgcctctgccccgtgtcgggcgcgcctccctccctgg

SEQ ID NO: 53529 - DNA, 373 bp, Homo sapiens; identical to SEQ ID NO: 32825
  misc_feature 1..373: note = chr9:139606331-139606704
  misc_feature 1..373: note = hyper
  source 1..373: mol_type = genomic DNA

SEQ ID NO: 53530 - DNA, 131 bp, Homo sapiens; identical to SEQ ID NO: 32826
  misc_feature 1..131: note = chr9:139607156-139607287
  misc_feature 1..131: note = hyper
  source 1..131: mol_type = genomic DNA

SEQ ID NO: 53531 - DNA, 80 bp, Homo sapiens; identical to SEQ ID NO: 32827
  misc_feature 1..80: note = chr9:139739053-139739133
  misc_feature 1..80: note = hyper
  source 1..80: mol_type = genomic DNA

SEQ ID NO: 53532 - DNA, 54 bp, Homo sapiens; identical to SEQ ID NO: 32828
  misc_feature 1..54: note = chr9:139739447-139739501
  misc_feature 1..54: note = hyper
  source 1..54: mol_type = genomic DNA

SEQ ID NO: 53533 - DNA, 83 bp, Homo sapiens; identical to SEQ ID NO: 32829
  misc_feature 1..83: note = chr9:139872708-139872791
  misc_feature 1..83: note = hyper
  source 1..83: mol_type = genomic DNA

SEQ ID NO: 53534 - DNA, 36 bp, Homo sapiens; identical to SEQ ID NO: 32830
  misc_feature 1..36: note = chr9:139879955-139879991
  misc_feature 1..36: note = hyper
  source 1..36: mol_type = genomic DNA

SEQ ID NO: 53535 - DNA, 95 bp, Homo sapiens; identical to SEQ ID NO: 32831
  misc_feature 1..95: note = chr9:139943364-139943459
  misc_feature 1..95: note = hyper
  source 1..95: mol_type = genomic DNA

SEQ ID NO: 53536 - DNA, 141 bp, Homo sapiens; identical to SEQ ID NO: 32832
  misc_feature 1..141: note = chr9:139948048-139948189
  misc_feature 1..141: note = hyper
  source 1..141: mol_type = genomic DNA

SEQ ID NO: 53537 - DNA, 69 bp, Homo sapiens; identical to SEQ ID NO: 32833
  misc_feature 1..69: note = chr9:139971509-139971578
  misc_feature 1..69: note = hyper
  source 1..69: mol_type = genomic DNA

SEQ ID NO: 53538 - DNA, 145 bp, Homo sapiens; identical to SEQ ID NO: 32834
  misc_feature 1..145: note = chr9:140024626-140024771
  misc_feature 1..145: note = hyper
  source 1..145: mol_type = genomic DNA

SEQ ID NO: 53539 - DNA, 56 bp, Homo sapiens
  misc_feature 1..56: note = chr9:140024786-140024842
  misc_feature 1..56: note = hyper
  source 1..56: mol_type = genomic DNA
cgagcgagggggccaagcggccggctggacccacagtccccgcgccataggcgggt

SEQ ID NO: 53540 - DNA, 67 bp, Homo sapiens
  misc_feature 1..67: note = chr9:140025023-140025090
  misc_feature 1..67: note = hyper
  source 1..67: mol_type = genomic DNA
tttcttctggccaggctgccccctgccccttgggcgattctgctgcgtcccacggtcctggctgtgg

SEQ ID NO: 53541 - skipped

SEQ ID NO: 53542 - DNA, 147 bp, Homo sapiens; identical to SEQ ID NO: 20495
  misc_feature 1..147: note = chr9:140033762-140033909
  misc_feature 1..147: note = hyper
  source 1..147: mol_type = genomic DNA

SEQ ID NO: 53543 - DNA, 83 bp, Homo sapiens
  misc_feature 1..83: note = chr9:140034079-140034162
  misc_feature 1..83: note = hyper
  source 1..83: mol_type = genomic DNA
caggccaacaagcggcacggctcctggaagattcagctcaatgccacctccgtcacgcacaagcccaacgccatccagatggc

SEQ ID NO: 53544 - DNA, 13 bp, Homo sapiens
  misc_feature 1..13: note = chr9:140050956-140050969
  misc_feature 1..13: note = hyper
  source 1..13: mol_type = genomic DNA
tcctgggttctgg

SEQ ID NO: 53545 - DNA, 137 bp, Homo sapiens; identical to SEQ ID NO: 20498
  misc_feature 1..137: note = chr9:140051354-140051491
  misc_feature 1..137: note = hyper
  source 1..137: mol_type = genomic DNA

SEQ ID NO: 53546 - DNA, 78 bp, Homo sapiens
  misc_feature 1..78: note = chr9:140773301-140773379
  misc_feature 1..78: note = hyper
  source 1..78: mol_type = genomic DNA
aggccccgcctcgcggccgcccctagggatgggggcagggagtgagggagaccaggccgcttccgccaggagaggggc

SEQ ID NO: 53547 - DNA, 33 bp, Homo sapiens; identical to SEQ ID NO: 32846
  misc_feature 1..33: note = chr9:141044732-141044765
  misc_feature 1..33: note = hyper
  source 1..33: mol_type = genomic DNA

SEQ ID NO: 53548 - DNA, 30 bp, Homo sapiens; identical to SEQ ID NO: 32847
  misc_feature 1..30: note = chr10:735019-735049
  misc_feature 1..30: note = hyper
  source 1..30: mol_type = genomic DNA

SEQ ID NO: 53549 - DNA, 30 bp, Homo sapiens; identical to SEQ ID NO: 32848
  misc_feature 1..30: note = chr10:830880-830910
  misc_feature 1..30: note = hyper
  source 1..30: mol_type = genomic DNA

SEQ ID NO: 53550 - DNA, 40 bp, Homo sapiens; identical to SEQ ID NO: 10147
  misc_feature 1..40: note = chr10:1778568-1778608
  misc_feature 1..40: note = hyper
  source 1..40: mol_type = genomic DNA

SEQ ID NO: 53551 - DNA, 257 bp, Homo sapiens; identical to SEQ ID NO: 32850
  misc_feature 1..257: note = chr10:1778826-1779083
  misc_feature 1..257: note = hyper
  source 1..257: mol_type = genomic DNA

SEQ ID NO: 53552 - DNA, 306 bp, Homo sapiens
  misc_feature 1..306: note = chr10:1779111-1779417
  misc_feature 1..306: note = hyper
  source 1..306: mol_type = genomic DNA
cggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgc

SEQ ID NO: 53553 - DNA, 91 bp, Homo sapiens; identical to SEQ ID NO: 20502
  misc_feature 1..91: note = chr10:1779744-1779835
  misc_feature 1..91: note = hyper
  source 1..91: mol_type = genomic DNA

SEQ ID NO: 53554 - DNA, 220 bp, Homo sapiens; identical to SEQ ID NO: 32852
  misc_feature 1..220: note = chr10:1779836-1780056
  misc_feature 1..220: note = hyper
  source 1..220: mol_type = genomic DNA

SEQ ID NO: 53555 - DNA, 94 bp, Homo sapiens; identical to SEQ ID NO: 32853
  misc_feature 1..94: note = chr10:3108959-3109053
  misc_feature 1..94: note = hyper
  source 1..94: mol_type = genomic DNA

SEQ ID NO: 53556 - DNA, 114 bp, Homo sapiens; identical to SEQ ID NO: 32854
  misc_feature 1..114: note = chr10:3109054-3109168
  misc_feature 1..114: note = hyper
  source 1..114: mol_type = genomic DNA

SEQ ID NO: 53557 - DNA, 30 bp, Homo sapiens; identical to SEQ ID NO: 32855
  misc_feature 1..30: note = chr10:4698935-4698965
  misc_feature 1..30: note = hyper
  source 1..30: mol_type = genomic DNA

SEQ ID NO: 53558 - DNA, 837 bp, Homo sapiens; identical to SEQ ID NO: 20505
  misc_feature 1..837: note = chr10:7451390-7452227
  misc_feature 1..837: note = hyper
  source 1..837: mol_type = genomic DNA

SEQ ID NO: 53559 - DNA, 241 bp, Homo sapiens
  misc_feature 1..241: note = chr10:7452777-7453018
  misc_feature 1..241: note = hyper
  source 1..241: mol_type = genomic DNA
cggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgc

SEQ ID NO: 53560 - DNA, 235 bp, Homo sapiens
  misc_feature 1..235: note = chr10:7453078-7453313
  misc_feature 1..235: note = hyper
  source 1..235: mol_type = genomic DNA
tgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatct

SEQ ID NO: 53561 - DNA, 70 bp, Homo sapiens
  misc_feature 1..70: note = chr10:7453930-7454000
  misc_feature 1..70: note = hyper
  source 1..70: mol_type = genomic DNA
gcggaaaagccggtgacgccctggtagcaagaccaagagcttccgaagaacgctgcgcccttaactaggg

SEQ ID NO: 53562 - DNA, 158 bp, Homo sapiens; identical to SEQ ID NO: 32860
  misc_feature 1..158: note = chr10:7454448-7454606
  misc_feature 1..158: note = hyper
  source 1..158: mol_type = genomic DNA

SEQ ID NO: 53563 - DNA, 319 bp, Homo sapiens
  misc_feature 1..319: note = chr10:7708471-7708790
  misc_feature 1..319: note = hyper
  source 1..319: mol_type = genomic DNA
ctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctc

SEQ ID NO: 53564 - DNA, 124 bp, Homo sapiens; identical to SEQ ID NO: 3501
  misc_feature 1..124: note = chr10:8076053-8076177
  misc_feature 1..124: note = hyper
  source 1..124: mol_type = genomic DNA

SEQ ID NO: 53565 - DNA, 317 bp, Homo sapiens
  misc_feature 1..317: note = chr10:8076487-8076804
  misc_feature 1..317: note = hyper
  source 1..317: mol_type = genomic DNA
gaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggca

SEQ ID NO: 53566 - DNA, 25 bp, Homo sapiens
  misc_feature 1..25: note = chr10:8078218-8078243
  misc_feature 1..25: note = hyper
  source 1..25: mol_type = genomic DNA
actttgcacacgtgacatgggggtc

SEQ ID NO: 53567 - DNA, 30 bp, Homo sapiens; identical to SEQ ID NO: 32867
  misc_feature 1..30: note = chr10:8079721-8079751
  misc_feature 1..30: note = hyper
  source 1..30: mol_type = genomic DNA

SEQ ID NO: 53568 - DNA, 257 bp, Homo sapiens
  misc_feature 1..257: note = chr10:8085721-8085978
  misc_feature 1..257: note = hyper
  source 1..257: mol_type = genomic DNA
ggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgc

SEQ ID NO: 53569 - DNA, 30 bp, Homo sapiens; identical to SEQ ID NO: 32869
  misc_feature 1..30: note = chr10:8086710-8086740
  misc_feature 1..30: note = hyper
  source 1..30: mol_type = genomic DNA

SEQ ID NO: 53570 - DNA, 130 bp, Homo sapiens; identical to SEQ ID NO: 32870
  misc_feature 1..130: note = chr10:8087215-8087345
  misc_feature 1..130: note = hyper
  source 1..130: mol_type = genomic DNA

SEQ ID NO: 53571 - DNA, 264 bp, Homo sapiens; identical to SEQ ID NO: 32871
  misc_feature 1..264: note = chr10:8090494-8090758
  misc_feature 1..264: note = hyper
  source 1..264: mol_type = genomic DNA

SEQ ID NO: 53572 - DNA, 30 bp, Homo sapiens; identical to SEQ ID NO: 32872
  misc_feature 1..30: note = chr10:8091376-8091406
  misc_feature 1..30: note = hyper
  source 1..30: mol_type = genomic DNA

SEQ ID NO: 53573 - DNA, 37 bp, Homo sapiens; identical to SEQ ID NO: 20515
  misc_feature 1..37: note = chr10:8091858-8091895
  misc_feature 1..37: note = hyper
  source 1..37: mol_type = genomic DNA

SEQ ID NO: 53574 - DNA, 89 bp, Homo sapiens; identical to SEQ ID NO: 32874
  misc_feature 1..89: note = chr10:8092446-8092535
  misc_feature 1..89: note = hyper
  source 1..89: mol_type = genomic DNA

SEQ ID NO: 53575 - skipped

SEQ ID NO: 53576 - DNA, 20 bp, Homo sapiens
  misc_feature 1..20: note = chr10:8093718-8093738
  misc_feature 1..20: note = hyper
  source 1..20: mol_type = genomic DNA
tttccctcccccgcccgcca

SEQ ID NO: 53577 - skipped

SEQ ID NO: 53578 - DNA, 261 bp, Homo sapiens; identical to SEQ ID NO: 32879
  misc_feature 1..261: note = chr10:8095198-8095459
  misc_feature 1..261: note = hyper
  source 1..261: mol_type = genomic DNA

SEQ ID NO: 53579 - DNA, 111 bp, Homo sapiens; identical to SEQ ID NO: 20519
  misc_feature 1..111: note = chr10:8095492-8095603
  misc_feature 1..111: note = hyper
  source 1..111: mol_type = genomic DNA

SEQ ID NO: 53580 - skipped

SEQ ID NO: 53581 - DNA, 350 bp, Homo sapiens
  misc_feature 1..350: note = chr10:8096190-8096540
  misc_feature 1..350: note = hyper
  source 1..350: mol_type = genomic DNA
cctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgca

SEQ ID NO: 53582 - DNA, 88 bp, Homo sapiens; identical to SEQ ID NO: 32882
  misc_feature 1..88: note = chr10:8096747-8096835
  misc_feature 1..88: note = hyper
  source 1..88: mol_type = genomic DNA

SEQ ID NO: 53583 - DNA, 277 bp, Homo sapiens
  misc_feature 1..277: note = chr10:8097197-8097474
  misc_feature 1..277: note = hyper
  source 1..277: mol_type = genomic DNA
ccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagcc

SEQ ID NO: 53584 - DNA, 375 bp, Homo sapiens; identical to SEQ ID NO: 32884
  misc_feature 1..375: note = chr10:8374353-8374728
  misc_feature 1..375: note = hyper
  source 1..375: mol_type = genomic DNA

SEQ ID NO: 53585 - DNA, 195 bp, Homo sapiens; identical to SEQ ID NO: 32885
  misc_feature 1..195: note = chr10:11059469-11059664
  misc_feature 1..195: note = hyper
  source 1..195: mol_type = genomic DNA

SEQ ID NO: 53586 - DNA, 96 bp, Homo sapiens
  misc_feature 1..96: note = chr10:11060062-11060158
  misc_feature 1..96: note = hyper
  source 1..96: mol_type = genomic DNA
ccttcaagctggatttcctcccggacatgatggtcgagggccgcctgctcgttcctgacagaatgtgagtggcgccgcgtcccgaggccgggcgag

SEQ ID NO: 53587 - DNA, 121 bp, Homo sapiens; identical to SEQ ID NO: 10180
  misc_feature 1..121: note = chr10:11060314-11060435
  misc_feature 1..121: note = hyper
  source 1..121: mol_type = genomic DNA

SEQ ID NO: 53588 - DNA, 117 bp, Homo sapiens; identical to SEQ ID NO: 32888
  misc_feature 1..117: note = chr10:11060512-11060629
  misc_feature 1..117: note = hyper
  source 1..117: mol_type = genomic DNA

SEQ ID NO: 53589 - DNA, 37 bp, Homo sapiens; identical to SEQ ID NO: 32890
  misc_feature 1..37: note = chr10:11784349-11784386
  misc_feature 1..37: note = hyper
  source 1..37: mol_type = genomic DNA

SEQ ID NO: 53590 - DNA, 211 bp, Homo sapiens
  misc_feature 1..211: note = chr10:13043175-13043386
  misc_feature 1..211: note = hyper
  source 1..211: mol_type = genomic DNA
cggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggca

SEQ ID NO: 53591 - DNA, 109 bp, Homo sapiens; identical to SEQ ID NO: 20525
  misc_feature 1..109: note = chr10:13043425-13043534
  misc_feature 1..109: note = hyper
  source 1..109: mol_type = genomic DNA

SEQ ID NO: 53592 - DNA, 43 bp, Homo sapiens; identical to SEQ ID NO: 32892
  misc_feature 1..43: note = chr10:13043744-13043787
  misc_feature 1..43: note = hyper
  source 1..43: mol_type = genomic DNA

SEQ ID NO: 53593 - DNA, 130 bp, Homo sapiens
  misc_feature 1..130: note = chr10:13934183-13934313
  misc_feature 1..130: note = hyper
  source 1..130: mol_type = genomic DNA
gggggacccctggctcccccacaaaacccacccaaagccaccgctcgaggccctctcctaccctgagagcccggagacagcagctcccttggctgaaggcacagctcttacccctcgatctagtccaatt

SEQ ID NO: 53594 - DNA, 165 bp, Homo sapiens; identical to SEQ ID NO: 32898
  misc_feature 1..165: note = chr10:14215748-14215913
  misc_feature 1..165: note = hyper
  source 1..165: mol_type = genomic DNA

SEQ ID NO: 53595 - DNA, 106 bp, Homo sapiens; identical to SEQ ID NO: 32899
  misc_feature 1..106: note = chr10:14216190-14216296
  misc_feature 1..106: note = hyper
  source 1..106: mol_type = genomic DNA

SEQ ID NO: 53596 - DNA, 329 bp, Homo sapiens
  misc_feature 1..329: note = chr10:15760963-15761292
  misc_feature 1..329: note = hyper
  source 1..329: mol_type = genomic DNA
ctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttct

SEQ ID NO: 53597 - DNA, 183 bp, Homo sapiens; identical to SEQ ID NO: 20529
  misc_feature 1..183: note = chr10:15761671-15761854
  misc_feature 1..183: note = hyper
  source 1..183: mol_type = genomic DNA

SEQ ID NO: 53598 - DNA, 259 bp, Homo sapiens; identical to SEQ ID NO: 32901
  misc_feature 1..259: note = chr10:15761855-15762114
  misc_feature 1..259: note = hyper
  source 1..259: mol_type = genomic DNA

SEQ ID NO: 53599 - DNA, 42 bp, Homo sapiens; identical to SEQ ID NO: 20531
  misc_feature 1..42: note = chr10:16563909-16563951
  misc_feature 1..42: note = hyper
  source 1..42: mol_type = genomic DNA

SEQ ID NO: 53600 - DNA, 325 bp, Homo sapiens
  misc_feature 1..325: note = chr10:17270666-17270991
  misc_feature 1..325: note = hyper
  source 1..325: mol_type = genomic DNA
tccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccc

SEQ ID NO: 53601 - DNA, 289 bp, Homo sapiens
  misc_feature 1..289: note = chr10:17271625-17271914
  misc_feature 1..289: note = hyper
  source 1..289: mol_type = genomic DNA
cgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaa

SEQ ID NO: 53602 - DNA, 102 bp, Homo sapiens; identical to SEQ ID NO: 10197
  misc_feature 1..102: note = chr10:17495534-17495636
  misc_feature 1..102: note = hyper
  source 1..102: mol_type = genomic DNA

SEQ ID NO: 53603 - DNA, 94 bp, Homo sapiens; identical to SEQ ID NO: 32911
  misc_feature 1..94: note = chr10:17496002-17496096
  misc_feature 1..94: note = hyper
  source 1..94: mol_type = genomic DNA

SEQ ID NO: 53604 - DNA, 110 bp, Homo sapiens; identical to SEQ ID NO: 20534
  misc_feature 1..110: note = chr10:17496734-17496844
  misc_feature 1..110: note = hyper
  source 1..110: mol_type = genomic DNA

SEQ ID NO: 53605 - DNA, 111 bp, Homo sapiens
  misc_feature 1..111: note = chr10:18429517-18429628
  misc_feature 1..111: note = hyper
  source 1..111: mol_type = genomic DNA
ggggcgctgcggggcgctgcgccgagaacggccgggcctgagccctgggcggcccccagagccgatcagagcgcggggaggcgggggcgaggaggaggggacccgccgccg

SEQ ID NO: 53606 - DNA, 79 bp, Homo sapiens
  misc_feature 1..79: note = chr10:18429774-18429853
  misc_feature 1..79: note = hyper
  source 1..79: mol_type = genomic DNA
ccgccgcacaggtagcgagagcgcggcgccttctccttcctttgtgagccgccgggcagggcaccgacctcgggttctc

SEQ ID NO: 53607 - skipped

SEQ ID NO: 53608 - DNA, 64 bp, Homo sapiens; identical to SEQ ID NO: 32916
  misc_feature 1..64: note = chr10:18430183-18430247
  misc_feature 1..64: note = hyper
  source 1..64: mol_type = genomic DNA

SEQ ID NO: 53609 - DNA, 188 bp, Homo sapiens; identical to SEQ ID NO: 32917
  misc_feature 1..188: note = chr10:20105422-20105610
  misc_feature 1..188: note = hyper
  source 1..188: mol_type = genomic DNA

SEQ ID NO: 53610 - DNA, 66 bp, Homo sapiens; identical to SEQ ID NO: 32918
  misc_feature 1..66: note = chr10:20106628-20106694
  misc_feature 1..66: note = hyper
  source 1..66: mol_type = genomic DNA

SEQ ID NO: 53611 - DNA, 63 bp, Homo sapiens; identical to SEQ ID NO: 32919
  misc_feature 1..63: note = chr10:21783695-21783758
  misc_feature 1..63: note = hyper
  source 1..63: mol_type = genomic DNA

SEQ ID NO: 53612 - DNA, 45 bp, Homo sapiens; identical to SEQ ID NO: 32920
  misc_feature 1..45: note = chr10:21789093-21789138
  misc_feature 1..45: note = hyper
  source 1..45: mol_type = genomic DNA

SEQ ID NO: 53613 - DNA, 123 bp, Homo sapiens
  misc_feature 1..123: note = chr10:21805094-21805217
  misc_feature 1..123: note = hyper
  source 1..123: mol_type = genomic DNA
tctcagataccctatcgttccttatctcagcgaaacaactccccaggctggccgggcagtacaccggagatgctttgggggcccagctctgcagattccactccgccggcgactccgctttga

SEQ ID NO: 53614 - DNA, 60 bp, Homo sapiens
  misc_feature 1..60: note = chr10:21805277-21805337
  misc_feature 1..60: note = hyper
  source 1..60: mol_type = genomic DNA
cggcggcggaggccagatggtacaagaagttggcctgcgcctgcacgctgggaggcttgc

SEQ ID NO: 53615 - DNA, 117 bp, Homo sapiens; identical to SEQ ID NO: 32922
  misc_feature 1..117: note = chr10:22518011-22518128
  misc_feature 1..117: note = hyper
  source 1..117: mol_type = genomic DNA

SEQ ID NO: 53616 - DNA, 37 bp, Homo sapiens; identical to SEQ ID NO: 32923
  misc_feature 1..37: note = chr10:22518491-22518528
  misc_feature 1..37: note = hyper
  source 1..37: mol_type = genomic DNA

SEQ ID NO: 53617 - DNA, 98 bp, Homo sapiens; identical to SEQ ID NO: 32924
  misc_feature 1..98: note = chr10:22540740-22540838
  misc_feature 1..98: note = hyper
  source 1..98: mol_type = genomic DNA

SEQ ID NO: 53618 - DNA, 576 bp, Homo sapiens
  misc_feature 1..576: note = chr10:22541062-22541638
  misc_feature 1..576: note = hyper
  source 1..576: mol_type = genomic DNA
aggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcg

SEQ ID NO: 53619 - DNA, 29 bp, Homo sapiens
  misc_feature 1..29: note = chr10:22542567-22542596
  misc_feature 1..29: note = hyper
  source 1..29: mol_type = genomic DNA
ggccccgggataatcggatcctcccagac

SEQ ID NO: 53620 - DNA, 125 bp, Homo sapiens; identical to SEQ ID NO: 20544
  misc_feature 1..125: note = chr10:22625978-22626103
  misc_feature 1..125: note = hyper
  source 1..125: mol_type = genomic DNA

SEQ ID NO: 53621 - DNA, 77 bp, Homo sapiens; identical to SEQ ID NO: 20545
  misc_feature 1..77: note = chr10:22634578-22634655
  misc_feature 1..77: note = hyper
  source 1..77: mol_type = genomic DNA

SEQ ID NO: 53622 - DNA, 76 bp, Homo sapiens
  misc_feature 1..76: note = chr10:22764573-22764649
  misc_feature 1..76: note = hyper
  source 1..76: mol_type = genomic DNA
tgcgtaaataatactcgattaccatgccacctacatctttttgttaaaaatgcctttatgaaggctataatcctta

SEQ ID NO: 53623 - DNA, 30 bp, Homo sapiens; identical to SEQ ID NO: 32937
  misc_feature 1..30: note = chr10:23001954-23001984
  misc_feature 1..30: note = hyper
  source 1..30: mol_type = genomic DNA

SEQ ID NO: 53624 - DNA, 18 bp, Homo sapiens
  misc_feature 1..18: note = chr10:23216825-23216843
  misc_feature 1..18: note = hyper
  source 1..18: mol_type = genomic DNA
ctggattcaggtaatcgc

SEQ ID NO: 53625 - DNA, 21 bp, Homo sapiens
  misc_feature 1..21: note = chr10:23216844-23216865
  misc_feature 1..21: note = hyper
  source 1..21: mol_type = genomic DNA
gacgcacttggctcctcccgc

SEQ ID NO: 53626 - DNA, 185 bp, Homo sapiens; identical to SEQ ID NO: 20547
  misc_feature 1..185: note = chr10:23216945-23217130
  misc_feature 1..185: note = hyper
  source 1..185: mol_type = genomic DNA

SEQ ID NO: 53627 - DNA, 66 bp, Homo sapiens
  misc_feature 1..66: note = chr10:23461156-23461222
  misc_feature 1..66: note = hyper
  source 1..66: mol_type = genomic DNA
cgatccgcagttcttcgcccctccctctgtcccaattatctagaaacaaaaagagtagaaaatcga

SEQ ID NO: 53628 - DNA, 39 bp, Homo sapiens
  misc_feature 1..39: note = chr10:23462020-23462059
  misc_feature 1..39: note = hyper
  source 1..39: mol_type = genomic DNA
ccggaatccctgagtcgactcaccccctctccttttttt

SEQ ID NO: 53629 - DNA, 164 bp, Homo sapiens
  misc_feature 1..164: note = chr10:23462910-23463074
  misc_feature 1..164: note = hyper
  source 1..164: mol_type = genomic DNA
catggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaagg

SEQ ID NO: 53630 - DNA, 18 bp, Homo sapiens
  misc_feature 1..18: note = chr10:23481303-23481321
  misc_feature 1..18: note = hyper
  source 1..18: mol_type = genomic DNA
gggcactccagggaggcc

SEQ ID NO: 53631 - DNA, 271 bp, Homo sapiens; identical to SEQ ID NO: 20550
  misc_feature 1..271: note = chr10:23481515-23481786
  misc_feature 1..271: note = hyper
  source 1..271: mol_type = genomic DNA

SEQ ID NO: 53632 - DNA, 149 bp, Homo sapiens; identical to SEQ ID NO: 20551
  misc_feature 1..149: note = chr10:23481787-23481936
  misc_feature 1..149: note = hyper
  source 1..149: mol_type = genomic DNA

SEQ ID NO: 53633 - DNA, 17 bp, Homo sapiens
  misc_feature 1..17: note = chr10:23482445-23482462
  misc_feature 1..17: note = hyper
  source 1..17: mol_type = genomic DNA
cgcgtccccgccagact

SEQ ID NO: 53634 - DNA, 51 bp, Homo sapiens; identical to SEQ ID NO: 20553
  misc_feature 1..51: note = chr10:23483777-23483828
  misc_feature 1..51: note = hyper
  source 1..51: mol_type = genomic DNA

SEQ ID NO: 53635 - DNA, 23 bp, Homo sapiens
  misc_feature 1..23: note = chr10:23486241-23486264
  misc_feature 1..23: note = hyper
  source 1..23: mol_type = genomic DNA
gaactcctgtgaaatcggctgag

SEQ ID NO: 53636 - DNA, 86 bp, Homo sapiens
  misc_feature 1..86: note = chr10:23486328-23486414
  misc_feature 1..86: note = hyper
  source 1..86: mol_type = genomic DNA
aagcctcttaaatccataaactcatcccatttccattaatgggcctttgcggtggcaccgagtaccagctgcgaggttgaacaaac

SEQ ID NO: 53637 - DNA, 177 bp, Homo sapiens; identical to SEQ ID NO: 20555
  misc_feature 1..177: note = chr10:23487978-23488155
  misc_feature 1..177: note = hyper
  source 1..177: mol_type = genomic DNA

SEQ ID NO: 53638 - DNA, 11 bp, Homo sapiens
  misc_feature 1..11: note = chr10:23488382-23488393
  misc_feature 1..11: note = hyper
  source 1..11: mol_type = genomic DNA
tcttcggagga

SEQ ID NO: 53639 - DNA, 251 bp, Homo sapiens; identical to SEQ ID NO: 20556
  misc_feature 1..251: note = chr10:23489158-23489409
  misc_feature 1..251: note = hyper
  source 1..251: mol_type = genomic DNA

SEQ ID NO: 53640 - DNA, 616 bp, Homo sapiens
  misc_feature 1..616: note = chr10:23489439-23490055
  misc_feature 1..616: note = hyper
  source 1..616: mol_type = genomic DNA
tgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 53641 - DNA, 47 bp, Homo sapiens; identical to SEQ ID NO: 32957
  misc_feature 1..47: note = chr10:23491161-23491208
  misc_feature 1..47: note = hyper
  source 1..47: mol_type = genomic DNA

SEQ ID NO: 53642 - DNA, 123 bp, Homo sapiens; identical to SEQ ID NO: 32958
  misc_feature 1..123: note = chr10:23633374-23633497
  misc_feature 1..123: note = hyper
  source 1..123: mol_type = genomic DNA

SEQ ID NO: 53643 - DNA, 54 bp, Homo sapiens
  misc_feature 1..54: note = chr10:23982384-23982438
  misc_feature 1..54: note = hyper
  source 1..54: mol_type = genomic DNA
ctcgcagttaaaaaccgttgccactcgacggtggcaaaattgctggctgcactg

SEQ ID NO: 53644 - DNA, 374 bp, Homo sapiens; identical to SEQ ID NO: 20560
  misc_feature 1..374: note = chr10:23982820-23983194
  misc_feature 1..374: note = hyper
  source 1..374: mol_type = genomic DNA

SEQ ID NO: 53645 - DNA, 33 bp, Homo sapiens; identical to SEQ ID NO: 20561
  misc_feature 1..33: note = chr10:23983247-23983280
  misc_feature 1..33: note = hyper
  source 1..33: mol_type = genomic DNA

SEQ ID NO: 53646 - DNA, 107 bp, Homo sapiens; identical to SEQ ID NO: 20562
  misc_feature 1..107: note = chr10:23983700-23983807
  misc_feature 1..107: note = hyper
  source 1..107: mol_type = genomic DNA

SEQ ID NO: 53647 - DNA, 40 bp, Homo sapiens
  misc_feature 1..40: note = chr10:23984047-23984087
  misc_feature 1..40: note = hyper
  source 1..40: mol_type = genomic DNA
cgcatttcgcagctgcgctggtgtggggcatgagagcgag

SEQ ID NO: 53648 - DNA, 549 bp, Homo sapiens
  misc_feature 1..549: note = chr10:23984226-23984775
  misc_feature 1..549: note = hyper
  source 1..549: mol_type = genomic DNA
tctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 53649 - DNA, 82 bp, Homo sapiens; identical to SEQ ID NO: 20564
  misc_feature 1..82: note = chr10:23984841-23984923
  misc_feature 1..82: note = hyper
  source 1..82: mol_type = genomic DNA

SEQ ID NO: 53650 - DNA, 42 bp, Homo sapiens; identical to SEQ ID NO: 32963
  misc_feature 1..42: note = chr10:25241916-25241958
  misc_feature 1..42: note = hyper
  source 1..42: mol_type = genomic DNA

SEQ ID NO: 53651 - DNA, 60 bp, Homo sapiens; identical to SEQ ID NO: 32964
  misc_feature 1..60: note = chr10:25463833-25463893
  misc_feature 1..60: note = hyper
  source 1..60: mol_type = genomic DNA

SEQ ID NO: 53652 - DNA, 99 bp, Homo sapiens
  misc_feature 1..99: note = chr10:25464520-25464619
  misc_feature 1..99: note = hyper
  source 1..99: mol_type = genomic DNA
tcggctccctggagccgctccaccgatggcaccatcttggcgcagaaactcgccgaggaggtgcccatggacgtggcctcttacctctacaccggggac

SEQ ID NO: 53653 - DNA, 147 bp, Homo sapiens; identical to SEQ ID NO: 3542
  misc_feature 1..147: note = chr10:25465203-25465350
  misc_feature 1..147: note = hyper
  source 1..147: mol_type = genomic DNA

SEQ ID NO: 53654 - DNA, 70 bp, Homo sapiens; identical to SEQ ID NO: 20566
  misc_feature 1..70: note = chr10:25465351-25465421
  misc_feature 1..70: note = hyper
  source 1..70: mol_type = genomic DNA

SEQ ID NO: 53655 - DNA, 38 bp, Homo sapiens; identical to SEQ ID NO: 20567
  misc_feature 1..38: note = chr10:25465517-25465555
  misc_feature 1..38: note = hyper
  source 1..38: mol_type = genomic DNA

SEQ ID NO: 53656 - DNA, 153 bp, Homo sapiens
  misc_feature 1..153: note = chr10:26055841-26055994
  misc_feature 1..153: note = hyper
  source 1..153: mol_type = genomic DNA
cctatctgcgcgctgtcaatcatcccccacctgtggatcgcgcagcccagccaaaaaattaattgcttagaaatataaaatcggtggactcagatcggaaaggattaggagaaaaaaggttaagcgaggggaagaagccgtgctgtgccagag

SEQ ID NO: 53657 - DNA, 431 bp, Homo sapiens
  misc_feature 1..431: note = chr10:26223600-26224031
  misc_feature 1..431: note = hyper
  source 1..431: mol_type = genomic DNA
gccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttc

SEQ ID NO: 53658 - DNA, 27 bp, Homo sapiens
  misc_feature 1..27: note = chr10:26500592-26500619
  misc_feature 1..27: note = hyper
  source 1..27: mol_type = genomic DNA
cctgttgagaattatcgcagatacgtt

SEQ ID NO: 53659 - DNA, 136 bp, Homo sapiens; identical to SEQ ID NO: 32973
  misc_feature 1..136: note = chr10:26501026-26501162
  misc_feature 1..136: note = hyper
  source 1..136: mol_type = genomic DNA

SEQ ID NO: 53660 - DNA, 39 bp, Homo sapiens; identical to SEQ ID NO: 10249
  misc_feature 1..39: note = chr10:26501446-26501485
  misc_feature 1..39: note = hyper
  source 1..39: mol_type = genomic DNA

SEQ ID NO: 53661 - DNA, 383 bp, Homo sapiens
  misc_feature 1..383: note = chr10:26503731-26504114
  misc_feature 1..383: note = hyper
  source 1..383: mol_type = genomic DNA
tggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgaca

SEQ ID NO: 53662 - DNA, 301 bp, Homo sapiens; identical to SEQ ID NO: 20574
  misc_feature 1..301: note = chr10:26504190-26504491
  misc_feature 1..301: note = hyper
  source 1..301: mol_type = genomic DNA

SEQ ID NO: 53663 - skipped

SEQ ID NO: 53664 - DNA, 344 bp, Homo sapiens
  misc_feature 1..344: note = chr10:26505713-26506057
  misc_feature 1..344: note = hyper
  source 1..344: mol_type = genomic DNA
cgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagcccccca

SEQ ID NO: 53665 - DNA, 190 bp, Homo sapiens
  misc_feature 1..190: note = chr10:26506163-26506353
  misc_feature 1..190: note = hyper
  source 1..190: mol_type = genomic DNA
aaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggccc

SEQ ID NO: 53666 - DNA, 19 bp, Homo sapiens
  misc_feature 1..19: note = chr10:26506354-26506373
  misc_feature 1..19: note = hyper
  source 1..19: mol_type = genomic DNA
ggccgccagcctcccgctt

SEQ ID NO: 53667 - DNA, 47 bp, Homo sapiens
  misc_feature 1..47: note = chr10:26507400-26507447
  misc_feature 1..47: note = hyper
  source 1..47: mol_type = genomic DNA
tgcacttacacaccgtctcccaaatgtacgcgcgcacacacacatgc

SEQ ID NO: 53668 - DNA, 30 bp, Homo sapiens; identical to SEQ ID NO: 32983
  misc_feature 1..30: note = chr10:26680701-26680731
  misc_feature 1..30: note = hyper
  source 1..30: mol_type = genomic DNA

SEQ ID NO: 53669 - DNA, 139 bp, Homo sapiens
  misc_feature 1..139: note = chr10:26680960-26681099
  misc_feature 1..139: note = hyper
  source 1..139: mol_type = genomic DNA
gggcagactgtacccgggcaacggctccccgcagctccggctttttgcctgaagccccctgcaggcaaattccgcgtcgcgcgggcccgcgggcgcgctgcagtctccgagccccaggaagcagagacccaggtaggca

SEQ ID NO: 53670 - skipped

SEQ ID NO: 53671 - DNA, 22 bp, Homo sapiens
  misc_feature 1..22: note = chr10:26727076-26727098
  misc_feature 1..22: note = hyper
  source 1..22: mol_type = genomic DNA
tcctccacccccacccgagaga

SEQ ID NO: 53672 - DNA, 236 bp, Homo sapiens
  misc_feature 1..236: note = chr10:26727368-26727604
  misc_feature 1..236: note = hyper
  source 1..236: mol_type = genomic DNA
ggcgcgcgcggcacaggtagggggaggcgcaacgtttcccagaattaaaataaaataaaataaaataaaataaaaatcccttcaaggtggttgtgtagtaggggtgggatgggggagagaaaatcaggcgcagactcgatgagttggagaaagcagcccctaactcggagtcctttacgcatatgtttgtctgtcccactgtctctaaccaggggccttccttgcacctcggagca

SEQ ID NO: 53673 - DNA, 183 bp, Homo sapiens; identical to SEQ ID NO: 891
  misc_feature 1..183: note = chr10:26727867-26728050
  misc_feature 1..183: note = hyper
  source 1..183: mol_type = genomic DNA

SEQ ID NO: 53674 - DNA, 377 bp, Homo sapiens
  misc_feature 1..377: note = chr10:27547569-27547946
  misc_feature 1..377: note = hyper
  source 1..377: mol_type = genomic DNA
caacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtc

SEQ ID NO: 53675 - DNA, 157 bp, Homo sapiens
  misc_feature 1..157: note = chr10:28030925-28031082
  misc_feature 1..157: note = hyper
  source 1..157: mol_type = genomic DNA
aataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggt

SEQ ID NO: 53676 - DNA, 324 bp, Homo sapiens; identical to SEQ ID NO: 32990
  misc_feature 1..324: note = chr10:28031314-28031638
  misc_feature 1..324: note = hyper
  source 1..324: mol_type = genomic DNA

SEQ ID NO: 53677 - DNA, 881 bp, Homo sapiens; identical to SEQ ID NO: 32991
  misc_feature 1..881: note = chr10:28031863-28032744
  misc_feature 1..881: note = hyper
  source 1..881: mol_type = genomic DNA

SEQ ID NO: 53678 - DNA, 14 bp, Homo sapiens
  misc_feature 1..14: note = chr10:28032952-28032966
  misc_feature 1..14: note = hyper
  source 1..14: mol_type = genomic DNA
gatttgggggattt

SEQ ID NO: 53679 - DNA, 390 bp, Homo sapiens
  misc_feature 1..390: note = chr10:28033020-28033410
  misc_feature 1..390: note = hyper
  source 1..390: mol_type = genomic DNA
ccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccc

SEQ ID NO: 53680 - DNA, 159 bp, Homo sapiens
  misc_feature 1..159: note = chr10:28033481-28033640
  misc_feature 1..159: note = hyper
  source 1..159: mol_type = genomic DNA
ccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcat

SEQ ID NO: 53681 - DNA, 70 bp, Homo sapiens
  misc_feature 1..70: note = chr10:28033700-28033770
  misc_feature 1..70: note = hyper
  source 1..70: mol_type = genomic DNA
cgccaacgcccccgccccgcccttcggccaccgcagcagaggccacgcgtgacatttaggaccacgcgtg

SEQ ID NO: 53682 - DNA, 178 bp, Homo sapiens
  misc_feature 1..178: note = chr10:28034341-28034519
  misc_feature 1..178: note = hyper
  source 1..178: mol_type = genomic DNA
cacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccaga

SEQ ID NO: 53683 - DNA, 315 bp, Homo sapiens
  misc_feature 1..315: note = chr10:28035300-28035615
  misc_feature 1..315: note = hyper
  source 1..315: mol_type = genomic DNA
cccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatacttt

SEQ ID NO: 53684 - skipped

SEQ ID NO: 53685 - DNA, 136 bp, Homo sapiens; identical to SEQ ID NO: 20581
  misc_feature 1..136: note = chr10:28288070-28288206
  misc_feature 1..136: note = hyper
  source 1..136: mol_type = genomic DNA

SEQ ID NO: 53686 - DNA, 537 bp, Homo sapiens; identical to SEQ ID NO: 32998
  misc_feature 1..537: note = chr10:28957458-28957995
  misc_feature 1..537: note = hyper
  source 1..537: mol_type = genomic DNA

SEQ ID NO: 53687 - DNA, 43 bp, Homo sapiens
  misc_feature 1..43: note = chr10:28958043-28958086
  misc_feature 1..43: note = hyper
  source 1..43: mol_type = genomic DNA
cgatctttttggatgttctccctgcctaaaacggatgctaata

SEQ ID NO: 53688 - DNA, 141 bp, Homo sapiens; identical to SEQ ID NO: 33000
  misc_feature 1..141: note = chr10:28965689-28965830
  misc_feature 1..141: note = hyper
  source 1..141: mol_type = genomic DNA

SEQ ID NO: 53689 - skipped

SEQ ID NO: 53690 - DNA, 118 bp, Homo sapiens; identical to SEQ ID NO: 33002
  misc_feature 1..118: note = chr10:29011504-29011622
  misc_feature 1..118: note = hyper
  source 1..118: mol_type = genomic DNA

SEQ ID NO: 53691 - DNA, 67 bp, Homo sapiens
  misc_feature 1..67: note = chr10:30026090-30026157
  misc_feature 1..67: note = hyper
  source 1..67: mol_type = genomic DNA
cctgagaggcccctttgagtctccagaccttccagggataaataaaatctggcgacctgtgccaacg

SEQ ID NO: 53692 - DNA, 259 bp, Homo sapiens; identical to SEQ ID NO: 33004
  misc_feature 1..259: note = chr10:30348156-30348415
  misc_feature 1..259: note = hyper
  source 1..259: mol_type = genomic DNA

SEQ ID NO: 53693 - DNA, 30 bp, Homo sapiens; identical to SEQ ID NO: 33005
  misc_feature 1..30: note = chr10:31073324-31073354
  misc_feature 1..30: note = hyper
  source 1..30: mol_type = genomic DNA

SEQ ID NO: 53694 - DNA, 32 bp, Homo sapiens; identical to SEQ ID NO: 33006
  misc_feature 1..32: note = chr10:31074146-31074178
  misc_feature 1..32: note = hyper
  source 1..32: mol_type = genomic DNA

SEQ ID NO: 53695 - DNA, 48 bp, Homo sapiens; identical to SEQ ID NO: 33007
  misc_feature 1..48: note = chr10:31422926-31422974
  misc_feature 1..48: note = hyper
  source 1..48: mol_type = genomic DNA

SEQ ID NO: 53696 - DNA, 335 bp, Homo sapiens; identical to SEQ ID NO: 33008
  misc_feature 1..335: note = chr10:31608744-31609079
  misc_feature 1..335: note = hyper
  source 1..335: mol_type = genomic DNA

SEQ ID NO: 53697 - DNA, 45 bp, Homo sapiens; identical to SEQ ID NO: 33009
  misc_feature 1..45: note = chr10:31609288-31609333
  misc_feature 1..45: note = hyper
  source 1..45: mol_type = genomic DNA

SEQ ID NO: 53698 - DNA, 397 bp, Homo sapiens; identical to SEQ ID NO: 33010
  misc_feature 1..397: note = chr10:31609668-31610065
  misc_feature 1..397: note = hyper
  source 1..397: mol_type = genomic DNA

SEQ ID NO: 53699 - DNA, 47 bp, Homo sapiens; identical to SEQ ID NO: 33011
  misc_feature 1..47: note = chr10:33622724-33622771
  misc_feature 1..47: note = hyper
  source 1..47: mol_type = genomic DNA

SEQ ID NO: 53700 - DNA, 74 bp, Homo sapiens; identical to SEQ ID NO: 33012
  misc_feature 1..74: note = chr10:33623014-33623088
  misc_feature 1..74: note = hyper
  source 1..74: mol_type = genomic DNA

SEQ ID NO: 53701 - DNA, 59 bp, Homo sapiens
  misc_feature 1..59: note = chr10:33624107-33624166
  misc_feature 1..59: note = hyper
  source 1..59: mol_type = genomic DNA
ctggccagcccacctcgcgtgctcgctctgcacccctagagggagagctgggcagctcc

SEQ ID NO: 53702 - DNA, 114 bp, Homo sapiens
  misc_feature 1..114: note = chr10:33624230-33624344
  misc_feature 1..114: note = hyper
  source 1..114: mol_type = genomic DNA
acttcaaatcccggggcccgcgccctcggcggcgaggaacgcagggtcaccccctgccactcctcatcgcgccatcctgagacctgtggcggggagcagcggggcacccctgga

SEQ ID NO: 53703 - DNA, 98 bp, Homo sapiens; identical to SEQ ID NO: 33014
  misc_feature 1..98: note = chr10:33625772-33625870
  misc_feature 1..98: note = hyper
  source 1..98: mol_type = genomic DNA

SEQ ID NO: 53704 - DNA, 158 bp, Homo sapiens; identical to SEQ ID NO: 33015
  misc_feature 1..158: note = chr10:35105055-35105213
  misc_feature 1..158: note = hyper
  source 1..158: mol_type = genomic DNA

SEQ ID NO: 53705 - DNA, 153 bp, Homo sapiens
  misc_feature 1..153: note = chr10:35929528-35929681
  misc_feature 1..153: note = hyper
  source 1..153: mol_type = genomic DNA
tgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggag

SEQ ID NO: 53706 - DNA, 335 bp, Homo sapiens; identical to SEQ ID NO: 33017
  misc_feature 1..335: note = chr10:35930004-35930339
  misc_feature 1..335: note = hyper
  source 1..335: mol_type = genomic DNA

SEQ ID NO: 53707 - DNA, 43 bp, Homo sapiens; identical to SEQ ID NO: 33018
  misc_feature 1..43: note = chr10:35931819-35931862
  misc_feature 1..43: note = hyper
  source 1..43: mol_type = genomic DNA

SEQ ID NO: 53708 - DNA, 197 bp, Homo sapiens; identical to SEQ ID NO: 33019
  misc_feature 1..197: note = chr10:43248578-43248775
  misc_feature 1..197: note = hyper
  source 1..197: mol_type = genomic DNA

SEQ ID NO: 53709 - DNA, 30 bp, Homo sapiens; identical to SEQ ID NO: 33020
  misc_feature 1..30: note = chr10:43249043-43249073
  misc_feature 1..30: note = hyper
  source 1..30: mol_type = genomic DNA

SEQ ID NO: 53710 - DNA, 526 bp, Homo sapiens
  misc_feature 1..526: note = chr10:43249483-43250009
  misc_feature 1..526: note = hyper
  source 1..526: mol_type = genomic DNA
ttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcaga

SEQ ID NO: 53711 - DNA, 80 bp, Homo sapiens; identical to SEQ ID NO: 20590
  misc_feature 1..80: note = chr10:43250039-43250119
  misc_feature 1..80: note = hyper
  source 1..80: mol_type = genomic DNA

SEQ ID NO: 53712 - DNA, 270 bp, Homo sapiens
  misc_feature 1..270: note = chr10:43250136-43250406
  misc_feature 1..270: note = hyper
  source 1..270: mol_type = genomic DNA
cggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtccc

SEQ ID NO: 53713 - DNA, 23 bp, Homo sapiens
  misc_feature 1..23: note = chr10:43250886-43250909
  misc_feature 1..23: note = hyper
  source 1..23: mol_type = genomic DNA
ggggcccccggtttatgccaaac

SEQ ID NO: 53714 - DNA, 32 bp, Homo sapiens; identical to SEQ ID NO: 33024
  misc_feature 1..32: note = chr10:43332719-43332751
  misc_feature 1..32: note = hyper
  source 1..32: mol_type = genomic DNA

SEQ ID NO: 53715 - DNA, 38 bp, Homo sapiens; identical to SEQ ID NO: 33025
  misc_feature 1..38: note = chr10:43361563-43361601
  misc_feature 1..38: note = hyper
  source 1..38: mol_type = genomic DNA

SEQ ID NO: 53716 - DNA, 102 bp, Homo sapiens; identical to SEQ ID NO: 33026
  misc_feature 1..102: note = chr10:43362008-43362110
  misc_feature 1..102: note = hyper
  source 1..102: mol_type = genomic DNA

SEQ ID NO: 53717 - DNA, 78 bp, Homo sapiens; identical to SEQ ID NO: 10283
  misc_feature 1..78: note = chr10:43393565-43393643
  misc_feature 1..78: note = hyper
  source 1..78: mol_type = genomic DNA

SEQ ID NO: 53718 - DNA, 24 bp, Homo sapiens
  misc_feature 1..24: note = chr10:43428400-43428424
  misc_feature 1..24: note = hyper
  source 1..24: mol_type = genomic DNA
ccagccctgtgctcccgcgccccc

SEQ ID NO: 53719 - DNA, 23 bp, Homo sapiens
  misc_feature 1..23: note = chr10:43428954-43428977
  misc_feature 1..23: note = hyper
  source 1..23: mol_type = genomic DNA
gggctatggagaccacgctcctc

SEQ ID NO: 53720 - DNA, 97 bp, Homo sapiens
  misc_feature 1..97: note = chr10:43429100-43429197
  misc_feature 1..97: note = hyper
  source 1..97: mol_type = genomic DNA
tctgaatggagtgatgcgcctggacttttgttcggaaatcccgcgtggagggcggcctagcggggagaggctggaaacaggcgaggaggagcagggc

SEQ ID NO: 53721 - DNA, 161 bp, Homo sapiens
  misc_feature 1..161: note = chr10:43429215-43429376
  misc_feature 1..161: note = hyper
  source 1..161: mol_type = genomic DNA
cgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagc

SEQ ID NO: 53722 - DNA, 27 bp, Homo sapiens
  misc_feature 1..27: note = chr10:43429411-43429438
  misc_feature 1..27: note = hyper
  source 1..27: mol_type = genomic DNA
ccccgacagctgcgcaagtctattcct

SEQ ID NO: 53723 - DNA, 229 bp, Homo sapiens; identical to SEQ ID NO: 33032
  misc_feature 1..229: note = chr10:43571989-43572218
  misc_feature 1..229: note = hyper
  source 1..229: mol_type = genomic DNA

SEQ ID NO: 53724 - DNA, 190 bp, Homo sapiens
  misc_feature 1..190: note = chr10:43572495-43572685
  misc_feature 1..190: note = hyper
  source 1..190: mol_type = genomic DNA
agccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccg

SEQ ID NO: 53725 - DNA, 45 bp, Homo sapiens
  misc_feature 1..45: note = chr10:43572734-43572779
  misc_feature 1..45: note = hyper
  source 1..45: mol_type = genomic DNA
ggctgcgtctgctgttgctgctgctgctgccgctgctaggcaaag

SEQ ID NO: 53726 - DNA, 30 bp, Homo sapiens; identical to SEQ ID NO: 33036
  misc_feature 1..30: note = chr10:43698279-43698309
  misc_feature 1..30: note = hyper
  source 1..30: mol_type = genomic DNA

SEQ ID NO: 53727 - DNA, 626 bp, Homo sapiens; identical to SEQ ID NO: 33037
  misc_feature 1..626: note = chr10:43724462-43725088
  misc_feature 1..626: note = hyper
  source 1..626: mol_type = genomic DNA

SEQ ID NO: 53728 - DNA, 30 bp, Homo sapiens; identical to SEQ ID NO: 33038
  misc_feature 1..30: note = chr10:43725334-43725364
  misc_feature 1..30: note = hyper
  source 1..30: mol_type = genomic DNA

SEQ ID NO: 53729 - DNA, 30 bp, Homo sapiens; identical to SEQ ID NO: 33039
  misc_feature 1..30: note = chr10:43762699-43762729
  misc_feature 1..30: note = hyper
  source 1..30: mol_type = genomic DNA

SEQ ID NO: 53730 - DNA, 30 bp, Homo sapiens; identical to SEQ ID NO: 33040
  misc_feature 1..30: note = chr10:43818377-43818407
  misc_feature 1..30: note = hyper
  source 1..30: mol_type = genomic DNA

SEQ ID NO: 53731 - DNA, 220 bp, Homo sapiens; identical to SEQ ID NO: 33041
  misc_feature 1..220: note = chr10:43857606-43857826
  misc_feature 1..220: note = hyper
  source 1..220: mol_type = genomic DNA

SEQ ID NO: 53732 - DNA, 33 bp, Homo sapiens; identical to SEQ ID NO: 33042
  misc_feature 1..33: note = chr10:43892849-43892882
  misc_feature 1..33: note = hyper
  source 1..33: mol_type = genomic DNA

SEQ ID NO: 53733 - DNA, 703 bp, Homo sapiens; identical to SEQ ID NO: 33043
  misc_feature 1..703: note = chr10:44185340-44186043
  misc_feature 1..703: note = hyper
  source 1..703: mol_type = genomic DNA

SEQ ID NO: 53734 - DNA, 30 bp, Homo sapiens; identical to SEQ ID NO: 33044
  misc_feature 1..30: note = chr10:44788550-44788580
  misc_feature 1..30: note = hyper
  source 1..30: mol_type = genomic DNA

SEQ ID NO: 53735 - DNA, 223 bp, Homo sapiens; identical to SEQ ID NO: 33045
  misc_feature 1..223: note = chr10:44806396-44806619
  misc_feature 1..223: note = hyper
  source 1..223: mol_type = genomic DNA

SEQ ID NO: 53736 - DNA, 216 bp, Homo sapiens; identical to SEQ ID NO: 33046
  misc_feature 1..216: note = chr10:44879180-44879396
  misc_feature 1..216: note = hyper
  source 1..216: mol_type = genomic DNA

SEQ ID NO: 53737 - DNA, 93 bp, Homo sapiens
  misc_feature 1..93: note = chr10:44879851-44879944
  misc_feature 1..93: note = hyper
  source 1..93: mol_type = genomic DNA
ggagaggatcggcttcgcagggagcggaggctgcgcggctgcatcggacctcacagcctcaagtcgcggcatgaggcgaactttgcaaagcgc

SEQ ID NO: 53738 - DNA, 227 bp, Homo sapiens
  misc_feature 1..227: note = chr10:44880228-44880455
  misc_feature 1..227: note = hyper
  source 1..227: mol_type = genomic DNA
ttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatgg

SEQ ID NO: 53739 - DNA, 26 bp, Homo sapiens
  misc_feature 1..26: note = chr10:44880519-44880545
  misc_feature 1..26: note = hyper
  source 1..26: mol_type = genomic DNA
cggctgacggagagtgaaagtgcggc

SEQ ID NO: 53740 - DNA, 99 bp, Homo sapiens; identical to SEQ ID NO: 33049
  misc_feature 1..99: note = chr10:44880546-44880645
  misc_feature 1..99: note = hyper
  source 1..99: mol_type = genomic DNA

SEQ ID NO: 53741 - DNA, 196 bp, Homo sapiens
  misc_feature 1..196: note = chr10:44880673-44880869
  misc_feature 1..196: note = hyper
  source 1..196: mol_type = genomic DNA
cggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagag

SEQ ID NO: 53742 - DNA, 115 bp, Homo sapiens
  misc_feature 1..115: note = chr10:44880915-44881030
  misc_feature 1..115: note = hyper
  source 1..115: mol_type = genomic DNA
gacggggcctttcgatggcgggaactgaatgagaaccaatgaaaagcaaacaagttagtcccgggcggagggcctgctggcggtggcggcccaaggcagccgagggggtcctgct

SEQ ID NO: 53743 - DNA, 52 bp, Homo sapiens; identical to SEQ ID NO: 20604
  misc_feature 1..52: note = chr10:49731749-49731801
  misc_feature 1..52: note = hyper
  source 1..52: mol_type = genomic DNA

SEQ ID NO: 53744 - DNA, 58 bp, Homo sapiens
  misc_feature 1..58: note = chr10:49732002-49732060
  misc_feature 1..58: note = hyper
  source 1..58: mol_type = genomic DNA
cggccctggacaccccgtggcgagtccccgaggcggggctggcagcctctggcggcgg

SEQ ID NO: 53745 - DNA, 57 bp, Homo sapiens
  misc_feature 1..57: note = chr10:49732498-49732555
  misc_feature 1..57: note = hyper
  source 1..57: mol_type = genomic DNA
cccaggagccgccagggggcgccacggagccggggctgcctccgcctccctgggagc

SEQ ID NO: 53746 - DNA, 429 bp, Homo sapiens
  misc_feature 1..429: note = chr10:50323258-50323687
  misc_feature 1..429: note = hyper
  source 1..429: mol_type = genomic DNA
gctcacgggaggcgtcctctgaaccttggggaggcgccgctgcgcccgccagaccctcggcgagcccaccggagcgcgctggcgacagtgacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcac

SEQ ID NO: 53747 - DNA, 228 bp, Homo sapiens; identical to SEQ ID NO: 33056
  misc_feature 1..228: note = chr10:50603003-50603231
  misc_feature 1..228: note = hyper
  source 1..228: mol_type = genomic DNA

SEQ ID NO: 53748 - DNA, 130 bp, Homo sapiens
  misc_feature 1..130: note = chr10:50603837-50603967
  misc_feature 1..130: note = hyper
  source 1..130: mol_type = genomic DNA
cagaagccctgcacccgggccaccgcagccaggtccggctagcgcgcaaggccatctgcgagctgcagctcaggccaggaaggcagccgagccccaaggcccggcgctcggggcccggcgagtgggtcag

SEQ ID NO: 53749 - DNA, 11 bp, Homo sapiens
  misc_feature 1..11: note = chr10:50604159-50604170
  misc_feature 1..11: note = hyper
  source 1..11: mol_type = genomic DNA
tttataatctc

SEQ ID NO: 53750 - DNA, 76 bp, Homo sapiens
  misc_feature 1..76: note = chr10:50604532-50604608
  misc_feature 1..76: note = hyper
  source 1..76: mol_type = genomic DNA
gggactctttgcacacggcttccctttccaaacgatcgtacaaaaggaaagtttgattttgttctcagcaaggggt

SEQ ID NO: 53751 - DNA, 196 bp, Homo sapiens
  misc_feature 1..196: note = chr10:50604645-50604841
  misc_feature 1..196: note = hyper
  source 1..196: mol_type = genomic DNA
gcggtgggaccctttgcaattacttttaaaatgcatccgaggcagacactcaacggagagagaccgcccttctctctgcctgggtgaaaattaaactctaaagtaccgggctgaaattttcaagtcaggggcgcgggattggatcaaatcacataaactgcaaaaaaagcaagtctaatggcgcataattggttct

SEQ ID NO: 53752 - DNA, 373 bp, Homo sapiens; identical to SEQ ID NO: 20610
  misc_feature 1..373: note = chr10:50605654-50606027
  misc_feature 1..373: note = hyper
  source 1..373: mol_type = genomic DNA

SEQ ID NO: 53753 - DNA, 329 bp, Homo sapiens
  misc_feature 1..329: note = chr10:50606433-50606762
  misc_feature 1..329: note = hyper
  source 1..329: mol_type = genomic DNA
gctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcaccaaactttgatgacgccagccccctttttttccgaatgtctcgacacccgggagaaggtgactaataggtgttcgctacggtccccctccccc

SEQ ID NO: 53754 - DNA, 30 bp, Homo sapiens; identical to SEQ ID NO: 33060
  misc_feature 1..30: note = chr10:50815067-50815097
  misc_feature 1..30: note = hyper
  source 1..30: mol_type = genomic DNA

SEQ ID NO: 53755 - DNA, 522 bp, Homo sapiens
  misc_feature 1..522: note = chr10:50817132-50817654
  misc_feature 1..522: note = hyper
  source 1..522: mol_type = genomic DNA
atccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggc

SEQ ID NO: 53756 - DNA, 230 bp, Homo sapiens; identical to SEQ ID NO: 20613
  misc_feature 1..230: note = chr10:50818152-50818382
  misc_feature 1..230: note = hyper
  source 1..230: mol_type = genomic DNA

SEQ ID NO: 53757 - DNA, 200 bp, Homo sapiens
  misc_feature 1..200: note = chr10:50818432-50818632
  misc_feature 1..200: note = hyper
  source 1..200: mol_type = genomic DNA
cctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccggga

SEQ ID NO: 53758 - DNA, 178 bp, Homo sapiens; identical to SEQ ID NO: 33065
  misc_feature 1..178: note = chr10:50819747-50819925
  misc_feature 1..178: note = hyper
  source 1..178: mol_type = genomic DNA

SEQ ID NO: 53759 - DNA, 127 bp, Homo sapiens; identical to SEQ ID NO: 33066
  misc_feature 1..127: note = chr10:50821077-50821204
  misc_feature 1..127: note = hyper
  source 1..127: mol_type = genomic DNA

SEQ ID NO: 53760 - DNA, 52 bp, Homo sapiens; identical to SEQ ID NO: 10308
  misc_feature 1..52: note = chr10:50822142-50822194
  misc_feature 1..52: note = hyper
  source 1..52: mol_type = genomic DNA

SEQ ID NO: 53761 - DNA, 67 bp, Homo sapiens; identical to SEQ ID NO: 33069
  misc_feature 1..67: note = chr10:50822825-50822892
  misc_feature 1..67: note = hyper
  source 1..67: mol_type = genomic DNA

SEQ ID NO: 53762 - DNA, 160 bp, Homo sapiens; identical to SEQ ID NO: 33070
  misc_feature 1..160: note = chr10:50887456-50887616
  misc_feature 1..160: note = hyper
  source 1..160: mol_type = genomic DNA

SEQ ID NO: 53763 - DNA, 38 bp, Homo sapiens
  misc_feature 1..38: note = chr10:50887617-50887655
  misc_feature 1..38: note = hyper
  source 1..38: mol_type = genomic DNA
ggaggatcccctagcgccaccccggccccgcccggcgc

SEQ ID NO: 53764 - DNA, 20 bp, Homo sapiens
  misc_feature 1..20: note = chr10:50887816-50887836
  misc_feature 1..20: note = hyper
  source 1..20: mol_type = genomic DNA
ccttccgcctgcagggcctg

SEQ ID NO: 53765 - DNA, 516 bp, Homo sapiens; identical to SEQ ID NO: 33073
  misc_feature 1..516: note = chr10:50969896-50970412
  misc_feature 1..516: note = hyper
  source 1..516: mol_type = genomic DNA

SEQ ID NO: 53766 - DNA, 30 bp, Homo sapiens; identical to SEQ ID NO: 33074
  misc_feature 1..30: note = chr10:50976382-50976412
  misc_feature 1..30: note = hyper
  source 1..30: mol_type = genomic DNA

SEQ ID NO: 53767 - DNA, 88 bp, Homo sapiens; identical to SEQ ID NO: 10312
  misc_feature 1..88: note = chr10:52177735-52177823
  misc_feature 1..88: note = hyper
  source 1..88: mol_type = genomic DNA

SEQ ID NO: 53768 - DNA, 135 bp, Homo sapiens; identical to SEQ ID NO: 33077
  misc_feature 1..135: note = chr10:52178170-52178305
  misc_feature 1..135: note = hyper
  source 1..135: mol_type = genomic DNA

SEQ ID NO: 53769 - DNA, 160 bp, Homo sapiens; identical to SEQ ID NO: 33078
  misc_feature 1..160: note = chr10:52750888-52751048
  misc_feature 1..160: note = hyper
  source 1..160: mol_type = genomic DNA

SEQ ID NO: 53770 - DNA, 179 bp, Homo sapiens; identical to SEQ ID NO: 33079
  misc_feature 1..179: note = chr10:52751383-52751562
  misc_feature 1..179: note = hyper
  source 1..179: mol_type = genomic DNA

SEQ ID NO: 53771 - DNA, 41 bp, Homo sapiens; identical to SEQ ID NO: 33080
  misc_feature 1..41: note = chr10:52751795-52751836
  misc_feature 1..41: note = hyper
  source 1..41: mol_type = genomic DNA

SEQ ID NO: 53772 - DNA, 88 bp, Homo sapiens; identical to SEQ ID NO: 10315
  misc_feature 1..88: note = chr10:52833568-52833656
  misc_feature 1..88: note = hyper
  source 1..88: mol_type = genomic DNA

SEQ ID NO: 53773 - DNA, 113 bp, Homo sapiens; identical to SEQ ID NO: 33082
  misc_feature 1..113: note = chr10:52833864-52833977
  misc_feature 1..113: note = hyper
  source 1..113: mol_type = genomic DNA

SEQ ID NO: 53774 - DNA, 395 bp, Homo sapiens; identical to SEQ ID NO: 33083
  misc_feature 1..395: note = chr10:52834361-52834756
  misc_feature 1..395: note = hyper
  source 1..395: mol_type = genomic DNA

SEQ ID NO: 53775 - DNA, 305 bp, Homo sapiens
  misc_feature 1..305: note = chr10:54068221-54068526
  misc_feature 1..305: note = hyper
  source 1..305: mol_type = genomic DNA
gcctttcccctcacccgcctctaattaagtcagaaaggccctgtatttatttgcccatgaactgacacagcaaaccaacagcagccattgtagtgtgaatggatttgcgaccaggcaaggggcttcagccgggattacccgccccgcagccggatgaatgtgctgagcacaaagtctgctcaaagccgagcaaacggactatttgtgaaaatgccatcctggctcaagtctgattaagaccgggggtccccaggccgtttgatcttcgctcatcaaagagagtctttaaacaagcttcattttac

SEQ ID NO: 53776 - DNA, 78 bp, Homo sapiens
  misc_feature 1..78: note = chr10:54072904-54072982
  misc_feature 1..78: note = hyper
  source 1..78: mol_type = genomic DNA
caccaatttcaatgacgtcaaattcactttctaattcactttcagctcttcttctcctcaaggttgtttcttttctcc

SEQ ID NO: 53777 - DNA, 245 bp, Homo sapiens
  misc_feature 1..245: note = chr10:54073020-54073265
  misc_feature 1..245: note = hyper
  source 1..245: mol_type = genomic DNA
ttgggagcaaaccctgcattcggaagcgttgcgatgtgatatactaatgaggaagtcaggcgctaagccctaagggtttcttatttctccacattagcccaccactgagaagggagaaccggggaaaggcgactgacctggcacgttggaccctgtccgctttggtcccggccactttgatctcacgcgtctgcctaatcaagttcatctaccgccgcgattgccctgattcaaagaacaacatt

SEQ ID NO: 53778 - DNA, 361 bp, Homo sapiens
  misc_feature 1..361: note = chr10:54073295-54073656
  misc_feature 1..361: note = hyper
  source 1..361: mol_type = genomic DNA
ctcttccctccacccctgatctaatttctaaacgccagtctctcgcctccctctctaaacttcccatcaaaagagaattagctcttcttccttcttaccctcgtttgatgtgcaaatttccttctctttgcacatttttctcgcagtggcggggggaggtgggggaggagggcaactgaaggacctcaaagccggggatctaactcagatctgcaaactgcgactctaaagggttaatgagcaacttgcacccgccacctggccctctcagaggcgtcttgctagagccattgaattacagaccggtttgtatttaatactgaatatgacttgtgtgcacagtcagcgagtattggcataa

SEQ ID NO: 53779 - DNA, 36 bp, Homo sapiens
  misc_feature 1..36: note = chr10:54074789-54074825
  misc_feature 1..36: note = hyper
  source 1..36: mol_type = genomic DNA
ccgaaaacgctgcatgcgtcacgctatgtgctgccc

SEQ ID NO: 53780 - skipped

SEQ ID NO: 53781 - DNA, 529 bp, Homo sapiens
  misc_feature 1..529: note = chr10:57387796-57388325
  misc_feature 1..529: note = hyper
  source 1..529: mol_type = genomic DNA
ggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggatt

SEQ ID NO: 53782 - DNA, 46 bp, Homo sapiens; identical to SEQ ID NO: 10322
  misc_feature 1..46: note = chr10:57389890-57389936
  misc_feature 1..46: note = hyper
  source 1..46: mol_type = genomic DNA

SEQ ID NO: 53783 - DNA, 39 bp, Homo sapiens
  misc_feature 1..39: note = chr10:57390637-57390676
  misc_feature 1..39: note = hyper
  source 1..39: mol_type = genomic DNA
gcgcccacccacacatccagtctccgggaacaaaactct

SEQ ID NO: 53784 - DNA, 145 bp, Homo sapiens
  misc_feature 1..145: note = chr10:57391215-57391360
  misc_feature 1..145: note = hyper
  source 1..145: mol_type = genomic DNA
ccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcac

SEQ ID NO: 53785 - DNA, 109 bp, Homo sapiens; identical to SEQ ID NO: 33091
  misc_feature 1..109: note = chr10:60272038-60272147
  misc_feature 1..109: note = hyper
  source 1..109: mol_type = genomic DNA

SEQ ID NO: 53786 - DNA, 272 bp, Homo sapiens; identical to SEQ ID NO: 33092
  misc_feature 1..272: note = chr10:60272562-60272834
  misc_feature 1..272: note = hyper
  source 1..272: mol_type = genomic DNA

SEQ ID NO: 53787 - DNA, 235 bp, Homo sapiens
  misc_feature 1..235: note = chr10:60272895-60273130
  misc_feature 1..235: note = hyper
  source 1..235: mol_type = genomic DNA
cgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgag

SEQ ID NO: 53788 - DNA, 146 bp, Homo sapiens
  misc_feature 1..146: note = chr10:60936378-60936524
  misc_feature 1..146: note = hyper
  source 1..146: mol_type = genomic DNA
gcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccac

SEQ ID NO: 53789 - DNA, 32 bp, Homo sapiens
  misc_feature 1..32: note = chr10:60937041-60937073
  misc_feature 1..32: note = hyper
  source 1..32: mol_type = genomic DNA
gcagtccggatttcctgggtctctgggcactg

SEQ ID NO: 53790 - DNA, 36 bp, Homo sapiens; identical to SEQ ID NO: 33096
  misc_feature 1..36: note = chr10:61122490-61122526
  misc_feature 1..36: note = hyper
  source 1..36: mol_type = genomic DNA

SEQ ID NO: 53791 - DNA, 82 bp, Homo sapiens; identical to SEQ ID NO: 33097
  misc_feature 1..82: note = chr10:61469912-61469994
  misc_feature 1..82: note = hyper
  source 1..82: mol_type = genomic DNA

SEQ ID NO: 53792 - DNA, 30 bp, Homo sapiens; identical to SEQ ID NO: 33098
  misc_feature 1..30: note = chr10:62702560-62702590
  misc_feature 1..30: note = hyper
  source 1..30: mol_type = genomic DNA

SEQ ID NO: 53793 - DNA, 297 bp, Homo sapiens
  misc_feature 1..297: note = chr10:63212027-63212324
  misc_feature 1..297: note = hyper
  source 1..297: mol_type = genomic DNA
gcaagataggcaggccgttagccaagccccaaagccagcaaacccagacacctgaagctggcgctgtgctagagaacgcgcgacgcgcgcggctggagggaagggaagcggatgaaaccacagacgtgcagcgagggtcttctcgtcttaggagggtggccagtgtgctcagctcttgcgaaggtcgctgatgcccagcgaaggacattcccacatgtgcacgcacgcagagtaacccgcgcacactcacacaccccagtttcagaaggcacactacatggcaacctccttgtccca

SEQ ID NO: 53794 - DNA, 189 bp, Homo sapiens
  misc_feature 1..189: note = chr10:63212701-63212890
  misc_feature 1..189: note = hyper
  source 1..189: mol_type = genomic DNA
gagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccct

SEQ ID NO: 53795 - DNA, 92 bp, Homo sapiens; identical to SEQ ID NO: 10332
  misc_feature 1..92: note = chr10:63213120-63213212
  misc_feature 1..92: note = hyper
  source 1..92: mol_type = genomic DNA

SEQ ID NO: 53796 - DNA, 520 bp, Homo sapiens; identical to SEQ ID NO: 33101
  misc_feature 1..520: note = chr10:64133867-64134387
  misc_feature 1..520: note = hyper
  source 1..520: mol_type = genomic DNA

SEQ ID NO: 53797 - DNA, 478 bp, Homo sapiens; identical to SEQ ID NO: 33102
  misc_feature 1..478: note = chr10:64574590-64575068
  misc_feature 1..478: note = hyper
  source 1..478: mol_type = genomic DNA

SEQ ID NO: 53798 - DNA, 399 bp, Homo sapiens; identical to SEQ ID NO: 20636
  misc_feature 1..399: note = chr10:64575127-64575526
  misc_feature 1..399: note = hyper
  source 1..399: mol_type = genomic DNA

SEQ ID NO: 53799 - DNA, 174 bp, Homo sapiens
  misc_feature 1..174: note = chr10:64575638-64575812
  misc_feature 1..174: note = hyper
  source 1..174: mol_type = genomic DNA
tctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggaga

SEQ ID NO: 53800 - DNA, 89 bp, Homo sapiens; identical to SEQ ID NO: 20638
  misc_feature 1..89: note = chr10:64578540-64578629
  misc_feature 1..89: note = hyper
  source 1..89: mol_type = genomic DNA

SEQ ID NO: 53801 - DNA, 15 bp, Homo sapiens
  misc_feature 1..15: note = chr10:64578651-64578666
  misc_feature 1..15: note = hyper
  source 1..15: mol_type = genomic DNA
cgagggggagctcct

SEQ ID NO: 53802 - DNA, 287 bp, Homo sapiens; identical to SEQ ID NO: 33106
  misc_feature 1..287: note = chr10:70320197-70320484
  misc_feature 1..287: note = hyper
  source 1..287: mol_type = genomic DNA

SEQ ID NO: 53803 - DNA, 71 bp, Homo sapiens; identical to SEQ ID NO: 33107
  misc_feature 1..71: note = chr10:70320857-70320928
  misc_feature 1..71: note = hyper
  source 1..71: mol_type = genomic DNA

SEQ ID NO: 53804 - DNA, 42 bp, Homo sapiens; identical to SEQ ID NO: 33108
  misc_feature 1..42: note = chr10:71267763-71267805
  misc_feature 1..42: note = hyper
  source 1..42: mol_type = genomic DNA

SEQ ID NO: 53805 - skipped

SEQ ID NO: 53806 - DNA, 181 bp, Homo sapiens
  misc_feature 1..181: note = chr10:71328821-71329002
  misc_feature 1..181: note = hyper
  source 1..181: mol_type = genomic DNA
gggggtggggtgggatgggggcagggcaccataaatctacctgcttgtgtgccagcgcggcttgactggaaggaggagcaagattcatgtgcggtttttctggaagccagtcttgggctcagacaaaagcagaagaaggggggagagccattcgacgagagggtctttcctgcccgggttt

SEQ ID NO: 53807 - skipped

SEQ ID NO: 53808 - DNA, 141 bp, Homo sapiens
  misc_feature 1..141: note = chr10:71329118-71329259
  misc_feature 1..141: note = hyper
  source 1..141: mol_type = genomic DNA
cccaggactcaaaacgccgcaagaagtggaaggcggggacggtggtgcagagctagttggacaggccacccctagaaatgtttccgagcccttcttgctcaggggttctttggaaagaggcatggacgaggtttcccactc

SEQ ID NO: 53809 - DNA, 30 bp, Homo sapiens; identical to SEQ ID NO: 33112
  misc_feature 1..30: note = chr10:71329503-71329533
  misc_feature 1..30: note = hyper
  source 1..30: mol_type = genomic DNA

SEQ ID NO: 53810 - DNA, 299 bp, Homo sapiens; identical to SEQ ID NO: 33113
  misc_feature 1..299: note = chr10:71331434-71331733
  misc_feature 1..299: note = hyper
  source 1..299: mol_type = genomic DNA

SEQ ID NO: 53811 - DNA, 101 bp, Homo sapiens
  misc_feature 1..101: note = chr10:71331951-71332052
  misc_feature 1..101: note = hyper
  source 1..101: mol_type = genomic DNA
tgcgttggcgcggctcggagggccggggaatgaacccagcctgccgcccccgtggaggcctgggccggccaggggtcagccagggagaagcagaaggaaca

SEQ ID NO: 53812 - DNA, 63 bp, Homo sapiens
  misc_feature 1..63: note = chr10:71333018-71333081
  misc_feature 1..63: note = hyper
  source 1..63: mol_type = genomic DNA
gctcagcgggcttctggtcgccaagttcagctgagctgcaggcgcccccgcctgggagttgcc

SEQ ID NO: 53813 - DNA, 22 bp, Homo sapiens
  misc_feature 1..22: note = chr10:71334335-71334357
  misc_feature 1..22: note = hyper
  source 1..22: mol_type = genomic DNA
cccaaggcgctgggaagcagag

SEQ ID NO: 53814 - DNA, 103 bp, Homo sapiens; identical to SEQ ID NO: 33117
  misc_feature 1..103: note = chr10:71334853-71334956
  misc_feature 1..103: note = hyper
  source 1..103: mol_type = genomic DNA

SEQ ID NO: 53815 - DNA, 30 bp, Homo sapiens; identical to SEQ ID NO: 33118
  misc_feature 1..30: note = chr10:71337383-71337413
  misc_feature 1..30: note = hyper
  source 1..30: mol_type = genomic DNA

SEQ ID NO: 53816 - DNA, 103 bp, Homo sapiens; identical to SEQ ID NO: 33119
  misc_feature 1..103: note = chr10:71338223-71338326
  misc_feature 1..103: note = hyper
  source 1..103: mol_type = genomic DNA

SEQ ID NO: 53817 - DNA, 37 bp, Homo sapiens; identical to SEQ ID NO: 33120
  misc_feature 1..37: note = chr10:71562106-71562143
  misc_feature 1..37: note = hyper
  source 1..37: mol_type = genomic DNA

SEQ ID NO: 53818 - DNA, 84 bp, Homo sapiens; identical to SEQ ID NO: 33121
  misc_feature 1..84: note = chr10:71562530-71562614
  misc_feature 1..84: note = hyper
  source 1..84: mol_type = genomic DNA

SEQ ID NO: 53819 - DNA, 95 bp, Homo sapiens; identical to SEQ ID NO: 33122
  misc_feature 1..95: note = chr10:71813377-71813472
  misc_feature 1..95: note = hyper
  source 1..95: mol_type = genomic DNA

SEQ ID NO: 53820 - DNA, 92 bp, Homo sapiens; identical to SEQ ID NO: 33123
  misc_feature 1..92: note = chr10:71813702-71813794
  misc_feature 1..92: note = hyper
  source 1..92: mol_type = genomic DNA

SEQ ID NO: 53821 - DNA, 56 bp, Homo sapiens
  misc_feature 1..56: note = chr10:72015339-72015395
  misc_feature 1..56: note = hyper
  source 1..56: mol_type = genomic DNA
cgagaagagcacagtggtgtagaccctgcgcatgcccttctcgggccaggcctccc

SEQ ID NO: 53822 - DNA, 15 bp, Homo sapiens
  misc_feature 1..15: note = chr10:72200050-72200065
  misc_feature 1..15: note = hyper
  source 1..15: mol_type = genomic DNA
gccccctcccatccc

SEQ ID NO: 53823 - DNA, 216 bp, Homo sapiens; identical to SEQ ID NO: 20649
  misc_feature 1..216: note = chr10:72200138-72200354
  misc_feature 1..216: note = hyper
  source 1..216: mol_type = genomic DNA

SEQ ID NO: 53824 - DNA, 218 bp, Homo sapiens
  misc_feature 1..218: note = chr10:72201285-72201503
  misc_feature 1..218: note = hyper
  source 1..218: mol_type = genomic DNA
gctcagcatgtacgccagaggggatggcgacgagggctgcccccgcgtacgcaggagcgcagtggccaccgtcgcagcacccgcctggagtagggcccaccaggcgtgcagaaggaagggcaggcagtgggcgtgcatggtgggctggccaggcctgaaagcagcacctccagcccttatatcctgggcctcagcagccgccccgcccccacctttcc

SEQ ID NO: 53825 - DNA, 44 bp, Homo sapiens; identical to SEQ ID NO: 33129
  misc_feature 1..44: note = chr10:72218318-72218362
  misc_feature 1..44: note = hyper
  source 1..44: mol_type = genomic DNA

SEQ ID NO: 53826 - DNA, 183 bp, Homo sapiens; identical to SEQ ID NO: 33130
  misc_feature 1..183: note = chr10:72238634-72238817
  misc_feature 1..183: note = hyper
  source 1..183: mol_type = genomic DNA

SEQ ID NO: 53827 - DNA, 158 bp, Homo sapiens; identical to SEQ ID NO: 33131
  misc_feature 1..158: note = chr10:72431955-72432113
  misc_feature 1..158: note = hyper
  source 1..158: mol_type = genomic DNA

SEQ ID NO: 53828 - DNA, 106 bp, Homo sapiens; identical to SEQ ID NO: 33132
  misc_feature 1..106: note = chr10:72432524-72432630
  misc_feature 1..106: note = hyper
  source 1..106: mol_type = genomic DNA

SEQ ID NO: 53829 - DNA, 43 bp, Homo sapiens; identical to SEQ ID NO: 33133
  misc_feature 1..43: note = chr10:72432660-72432703
  misc_feature 1..43: note = hyper
  source 1..43: mol_type = genomic DNA

SEQ ID NO: 53830 - DNA, 73 bp, Homo sapiens; identical to SEQ ID NO: 33134
  misc_feature 1..73: note = chr10:72973309-72973382
  misc_feature 1..73: note = hyper
  source 1..73: mol_type = genomic DNA

SEQ ID NO: 53831 - DNA, 204 bp, Homo sapiens; identical to SEQ ID NO: 33135
  misc_feature 1..204: note = chr10:73156664-73156868
  misc_feature 1..204: note = hyper
  source 1..204: mol_type = genomic DNA

SEQ ID NO: 53832 - DNA, 369 bp, Homo sapiens; identical to SEQ ID NO: 33136
  misc_feature 1..369: note = chr10:73156912-73157281
  misc_feature 1..369: note = hyper
  source 1..369: mol_type = genomic DNA

SEQ ID NO: 53833 - DNA, 359 bp, Homo sapiens
  misc_feature 1..359: note = chr10:73157508-73157867
  misc_feature 1..359: note = hyper
  source 1..359: mol_type = genomic DNA
ggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggac

SEQ ID NO: 53834 - DNA, 30 bp, Homo sapiens; identical to SEQ ID NO: 33138
  misc_feature 1..30: note = chr10:73723732-73723762
  misc_feature 1..30: note = hyper
  source 1..30: mol_type = genomic DNA

SEQ ID NO: 53835 - DNA, 282 bp, Homo sapiens; identical to SEQ ID NO: 33139
  misc_feature 1..282: note = chr10:73724117-73724399
  misc_feature 1..282: note = hyper
  source 1..282: mol_type = genomic DNA

SEQ ID NO: 53836 - DNA, 104 bp, Homo sapiens; identical to SEQ ID NO: 33140
  misc_feature 1..104: note = chr10:73847688-73847792
  misc_feature 1..104: note = hyper
  source 1..104: mol_type = genomic DNA

SEQ ID NO: 53837 - DNA, 14 bp, Homo sapiens
  misc_feature 1..14: note = chr10:73848208-73848222
  misc_feature 1..14: note = hyper
  source 1..14: mol_type = genomic DNA
ggtgactggcggag

SEQ ID NO: 53838 - DNA, 15 bp, Homo sapiens
  misc_feature 1..15: note = chr10:75407398-75407413
  misc_feature 1..15: note = hyper
  source 1..15: mol_type = genomic DNA
cagattctgcacccc

SEQ ID NO: 53839 - DNA, 93 bp, Homo sapiens; identical to SEQ ID NO: 20658
  misc_feature 1..93: note = chr10:75407477-75407570
  misc_feature 1..93: note = hyper
  source 1..93: mol_type = genomic DNA

SEQ ID NO: 53840 - DNA, 33 bp, Homo sapiens; identical to SEQ ID NO: 33144
  misc_feature 1..33: note = chr10:76803629-76803662
  misc_feature 1..33: note = hyper
  source 1..33: mol_type = genomic DNA

SEQ ID NO: 53841 - DNA, 47 bp, Homo sapiens; identical to SEQ ID NO: 33145
  misc_feature 1..47: note = chr10:77161345-77161392
  misc_feature 1..47: note = hyper
  source 1..47: mol_type = genomic DNA

SEQ ID NO: 53842 - DNA, 543 bp, Homo sapiens; identical to SEQ ID NO: 33146
  misc_feature 1..543: note = chr10:77162787-77163330
  misc_feature 1..543: note = hyper
  source 1..543: mol_type = genomic DNA

SEQ ID NO: 53843 - DNA, 37 bp, Homo sapiens; identical to SEQ ID NO: 33147
  misc_feature 1..37: note = chr10:77163662-77163699
  misc_feature 1..37: note = hyper
  source 1..37: mol_type = genomic DNA

SEQ ID NO: 53844 - DNA, 39 bp, Homo sapiens
  misc_feature 1..39: note = chr10:77191185-77191224
  misc_feature 1..39: note = hyper
  source 1..39: mol_type = genomic DNA
cgggggagggaggggcgcgggcagtcggggtcaggccgc

SEQ ID NO: 53845 - DNA, 337 bp, Homo sapiens
  misc_feature 1..337: note = chr10:77191368-77191705
  misc_feature 1..337: note = hyper
  source 1..337: mol_type = genomic DNA
cagctgactgcccagtgcggaactgtgcgcccgccgcgctcccctgccgcgctccccgctgctgccgccgcgcccccgcgctccgtcccgcgcgcccgcagcgtcctggccgccatggccgggctcgtggtgcgtggaactcaagtaagtcccggccagccccgcctccgcccggggcgcagtccgcgtggggagggacagcggggcacagaggctccccagggcctagacacccctgtccccgcctcagggggctgcgtctgcagggggtgagcttcaggtgctcaggctcgccctagtggggctaggacagacctcgtttcgggcctggcacacc

SEQ ID NO: 53846 - DNA, 235 bp, Homo sapiens; identical to SEQ ID NO: 20660
  misc_feature 1..235: note = chr10:79396686-79396921
  misc_feature 1..235: note = hyper
  source 1..235: mol_type = genomic DNA

SEQ ID NO: 53847 - DNA, 176 bp, Homo sapiens
  misc_feature 1..176: note = chr10:79397089-79397265
  misc_feature 1..176: note = hyper
  source 1..176: mol_type = genomic DNA
atgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaaga

SEQ ID NO: 53848 - DNA, 1238 bp, Homo sapiens; identical to SEQ ID NO: 33150
  misc_feature 1..1238: note = chr10:79397385-79398623
  misc_feature 1..1238: note = hyper
  source 1..1238: mol_type = genomic DNA

SEQ ID NO: 53849 - DNA, 146 bp, Homo sapiens; identical to SEQ ID NO: 33151
  misc_feature 1..146: note = chr10:79470925-79471071
  misc_feature 1..146: note = hyper
  source 1..146: mol_type = genomic DNA

SEQ ID NO: 53850 - DNA, 75 bp, Homo sapiens; identical to SEQ ID NO: 33152
  misc_feature 1..75: note = chr10:80909909-80909984
  misc_feature 1..75: note = hyper
  source 1..75: mol_type = genomic DNA

SEQ ID NO: 53851 - DNA, 269 bp, Homo sapiens; identical to SEQ ID NO: 20664
  misc_feature 1..269: note = chr10:81664598-81664867
  misc_feature 1..269: note = hyper
  source 1..269: mol_type = genomic DNA

SEQ ID NO: 53852 - DNA, 174 bp, Homo sapiens
  misc_feature 1..174: note = chr10:81664899-81665073
  misc_feature 1..174: note = hyper
  source 1..174: mol_type = genomic DNA
cggctcatctttgctccccaggagcagcatatttcgcatctgccagaggtgtgcccgggggtcgttgggagagggacggggtgaatccctgcagagagccgggacggggagggaaggtgtcggggagacgtggtttcctggcgacgtggtcccggcaggcgacttagacctgag

SEQ ID NO: 53853 - DNA, 223 bp, Homo sapiens; identical to SEQ ID NO: 33154
  misc_feature 1..223: note = chr10:81741708-81741931
  misc_feature 1..223: note = hyper
  source 1..223: mol_type = genomic DNA

SEQ ID NO: 53854 - DNA, 346 bp, Homo sapiens; identical to SEQ ID NO: 33155
  misc_feature 1..346: note = chr10:81892268-81892614
  misc_feature 1..346: note = hyper
  source 1..346: mol_type = genomic DNA

SEQ ID NO: 53855 - DNA, 413 bp, Homo sapiens
  misc_feature 1..413: note = chr10:82116661-82117074
  misc_feature 1..413: note = hyper
  source 1..413: mol_type = genomic DNA
gcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgag

SEQ ID NO: 53856 - DNA, 311 bp, Homo sapiens; identical to SEQ ID NO: 33157
  misc_feature 1..311: note = chr10:83633848-83634159
  misc_feature 1..311: note = hyper
  source 1..311: mol_type = genomic DNA

SEQ ID NO: 53857 - DNA, 282 bp, Homo sapiens; identical to SEQ ID NO: 10367
  misc_feature 1..282: note = chr10:83634933-83635215
  misc_feature 1..282: note = hyper
  source 1..282: mol_type = genomic DNA

SEQ ID NO: 53858 - DNA, 15 bp, Homo sapiens
  misc_feature 1..15: note = chr10:83635484-83635499
  misc_feature 1..15: note = hyper
  source 1..15: mol_type = genomic DNA
ctaccacttccacca

SEQ ID NO: 53859 - DNA, 34 bp, Homo sapiens
  misc_feature 1..34: note = chr10:83635545-83635579
  misc_feature 1..34: note = hyper
  source 1..34: mol_type = genomic DNA
gcccaaccggattagcactcgcctgaccaccatc

SEQ ID NO: 53860 - DNA, 30 bp, Homo sapiens; identical to SEQ ID NO: 33161
  misc_feature 1..30: note = chr10:83635788-83635818
  misc_feature 1..30: note = hyper
  source 1..30: mol_type = genomic DNA

SEQ ID NO: 53861 - DNA, 59 bp, Homo sapiens; identical to SEQ ID NO: 10370
  misc_feature 1..59: note = chr10:83636287-83636346
  misc_feature 1..59: note = hyper
  source 1..59: mol_type = genomic DNA

SEQ ID NO: 53862 - DNA, 136 bp, Homo sapiens
  misc_feature 1..136: note = chr10:85954289-85954425
  misc_feature 1..136: note = hyper
  source 1..136: mol_type = genomic DNA
gccgctaattggtctcgtcaggcggccggcaggagcagatccgagccgtgtcatcctcttagcgccctcacgccacccgccgctcccgccccgtgccccctcccgccgcggctgcagtcgccgctacccccattgt

SEQ ID NO: 53863 - DNA, 616 bp, Homo sapiens
  misc_feature 1..616: note = chr10:85954457-85955073
  misc_feature 1..616: note = hyper
  source 1..616: mol_type = genomic DNA
ctccgtgcccctgcgcccggtctcggcggcggcaggcgacactccgcgccggcggagacatgaggcgctgccggtgggccgccctggccctggggctgctgcgcctctgcttgggtgagtggccgctgggccgcgctggccgcgtggatggcgagggagatgggcgctggcgtcacccaggtggccagagggacatggtcctggaccacttccagagtgggactcgggctggtggacgggagcggagaagtccttccatcttcctggcccattcggtagtggggagtggggtagcggagtagtggggagctccggggcgcttctccagagctggcatcctagggccccagggtttggcgcccggacccccgctgctctccgcttgctgggaaccagagctgtaggcttggtggcagctccgatgctgcgtggggcaggagatagtgccctgactcgcggcttgaccttggctgggctggggcactgcccctctccgagcgcgggtgcaatctgcccattgatgaaggaggggttggattgctacctgggttctaagcgcccacatgctacgtgtccctgacaagcccgagcccaccgggggcggagtgggggtcag

SEQ ID NO: 53864 - DNA, 80 bp, Homo sapiens; identical to SEQ ID NO: 33164
  misc_feature 1..80: note = chr10:88124485-88124565
  misc_feature 1..80: note = hyper
  source 1..80: mol_type = genomic DNA

SEQ ID NO: 53865 - DNA, 30 bp, Homo sapiens; identical to SEQ ID NO: 33165
  misc_feature 1..30: note = chr10:88125245-88125275
  misc_feature 1..30: note = hyper
  source 1..30: mol_type = genomic DNA

SEQ ID NO: 53866 - DNA, 640 bp, Homo sapiens; identical to SEQ ID NO: 33166
  misc_feature 1..640: note = chr10:88125592-88126232
  misc_feature 1..640: note = hyper
  source 1..640: mol_type = genomic DNA

SEQ ID NO: 53867 - DNA, 149 bp, Homo sapiens; identical to SEQ ID NO: 33167
  misc_feature 1..149: note = chr10:88126704-88126853
  misc_feature 1..149: note = hyper
  source 1..149: mol_type = genomic DNA

SEQ ID NO: 53868 - DNA, 279 bp, Homo sapiens; identical to SEQ ID NO: 10374
  misc_feature 1..279: note = chr10:88126854-88127133
  misc_feature 1..279: note = hyper
  source 1..279: mol_type = genomic DNA

SEQ ID NO: 53869 - DNA, 50 bp, Homo sapiens; identical to SEQ ID NO: 33169
  misc_feature 1..50: note = chr10:88127346-88127396
  misc_feature 1..50: note = hyper
  source 1..50: mol_type = genomic DNA

SEQ ID NO: 53870 - DNA, 63 bp, Homo sapiens
  misc_feature 1..63: note = chr10:88149300-88149363
  misc_feature 1..63: note = hyper
  source 1..63: mol_type = genomic DNA
ggcgtctctgaccaccgagcctgcgaagacctagctgattacgaccaggaaacaggaggggac

SEQ ID NO: 53871 - DNA, 17 bp, Homo sapiens
  misc_feature 1..17: note = chr10:88149601-88149618
  misc_feature 1..17: note = hyper
  source 1..17: mol_type = genomic DNA
ggcgcacctgggtgctg

SEQ ID NO: 53872 - DNA, 147 bp, Homo sapiens; identical to SEQ ID NO: 33171
  misc_feature 1..147: note = chr10:88391908-88392055
  misc_feature 1..147: note = hyper
  source 1..147: mol_type = genomic DNA

SEQ ID NO: 53873 - DNA, 33 bp, Homo sapiens; identical to SEQ ID NO: 33172
  misc_feature 1..33: note = chr10:90342630-90342663
  misc_feature 1..33: note = hyper
  source 1..33: mol_type = genomic DNA

SEQ ID NO: 53874 - DNA, 50 bp, Homo sapiens; identical to SEQ ID NO: 33173
  misc_feature 1..50: note = chr10:90343138-90343188
  misc_feature 1..50: note = hyper
  source 1..50: mol_type = genomic DNA

SEQ ID NO: 53875 - DNA, 187 bp, Homo sapiens
  misc_feature 1..187: note = chr10:90966521-90966708
  misc_feature 1..187: note = hyper
  source 1..187: mol_type = genomic DNA
gacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcgggagcttcgtggggc

SEQ ID NO: 53876 - DNA, 461 bp, Homo sapiens
  misc_feature 1..461: note = chr10:90966865-90967326
  misc_feature 1..461: note = hyper
  source 1..461: mol_type = genomic DNA
acaggatatccaggaccacgaagggcaggcaaaagcccacgtatgtggtgatggagaagatgaccgggaagaagggcgactgtaggagggcctcccagctcctcaggtggtcccagaggggctgcaggaacagctgcccggagctgcaaaggacctgggggtcggagcagttgtggcagctcattgcgaggctgtgcaaggcagctgaggctgctgctcgagtcccatcgacttttcacaggactcacggccccgccccgagtgatgtcagctgcctttccatccctttcccggcgatgcgaagcttgaataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacg

SEQ ID NO: 53877 - DNA, 47 bp, Homo sapiens
  misc_feature 1..47: note = chr10:90967624-90967671
  misc_feature 1..47: note = hyper
  source 1..47: mol_type = genomic DNA
ctttgcacagggaaccgctggtccccgaacgccggcggtgaccgtca

SEQ ID NO: 53878 - DNA, 116 bp, Homo sapiens; identical to SEQ ID NO: 20683
  misc_feature 1..116: note = chr10:90968040-90968156
  misc_feature 1..116: note = hyper
  source 1..116: mol_type = genomic DNA

SEQ ID NO: 53879 - DNA, 279 bp, Homo sapiens
  misc_feature 1..279: note = chr10:91295067-91295346
  misc_feature 1..279: note = hyper
  source 1..279: mol_type = genomic DNA
gtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagc

SEQ ID NO: 53880 - DNA, 145 bp, Homo sapiens; identical to SEQ ID NO: 10383
  misc_feature 1..145: note = chr10:91295347-91295492
  misc_feature 1..145: note = hyper
  source 1..145: mol_type = genomic DNA

SEQ ID NO: 53881 - DNA, 154 bp, Homo sapiens; identical to SEQ ID NO: 20686
  misc_feature 1..154: note = chr10:91295725-91295879
  misc_feature 1..154: note = hyper
  source 1..154: mol_type = genomic DNA

SEQ ID NO: 53882 - skipped

SEQ ID NO: 53883 - DNA, 120 bp, Homo sapiens
  misc_feature 1..120: note = chr10:92617122-92617242
  misc_feature 1..120: note = hyper
  source 1..120: mol_type = genomic DNA
caccaggcagttgcccgcgatcgtcagcagcgtgatgagcgtcaggatggagccgatcacaactttctcgactctgccgtagttgatctgttccccacagccggaggcattgtccggggg

SEQ ID NO: 53884 - DNA, 227 bp, Homo sapiens
  misc_feature 1..227: note = chr10:92617308-92617535
  misc_feature 1..227: note = hyper
  source 1..227: mol_type = genomic DNA
gaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagcca

SEQ ID NO: 53885 - DNA, 179 bp, Homo sapiens
  misc_feature 1..179: note = chr10:93647037-93647216
  misc_feature 1..179: note = hyper
  source 1..179: mol_type = genomic DNA
gtaacaccccagggccgcgtgaatagcggggaaggtaacgtgactgcggagctcagggccggcccgggaggggcgcgggcctggccagtgggaaggtcggacgccgaggggcgaaatcaccccaccggcatcagaccaccgcctccattcagcggaggaatgtgggcgggcagaggacg

SEQ ID NO: 53886 - DNA, 262 bp, Homo sapiens; identical to SEQ ID NO: 20690
  misc_feature 1..262: note = chr10:93647300-93647562
  misc_feature 1..262: note = hyper
  source 1..262: mol_type = genomic DNA

SEQ ID NO: 53887 - skipped

SEQ ID NO: 53888 - DNA, 443 bp, Homo sapiens; identical to SEQ ID NO: 33183
  misc_feature 1..443: note = chr10:94180324-94180767
  misc_feature 1..443: note = hyper
  source 1..443: mol_type = genomic DNA

SEQ ID NO: 53889 - DNA, 126 bp, Homo sapiens; identical to SEQ ID NO: 33184
  misc_feature 1..126: note = chr10:94449138-94449264
  misc_feature 1..126: note = hyper
  source 1..126: mol_type = genomic DNA

SEQ ID NO: 53890 - DNA, 252 bp, Homo sapiens; identical to SEQ ID NO: 33185
  misc_feature 1..252: note = chr10:94449910-94450162
  misc_feature 1..252: note = hyper
  source 1..252: mol_type = genomic DNA

SEQ ID NO: 53891 - DNA, 298 bp, Homo sapiens
  misc_feature 1..298: note = chr10:94450377-94450675
  misc_feature 1..298: note = hyper
  source 1..298: mol_type = genomic DNA
ggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagaca

SEQ ID NO: 53892 - DNA, 30 bp, Homo sapiens; identical to SEQ ID NO: 10390
  misc_feature 1..30: note = chr10:94822377-94822407
  misc_feature 1..30: note = hyper
  source 1..30: mol_type = genomic DNA

SEQ ID NO: 53893 - DNA, 22 bp, Homo sapiens
  misc_feature 1..22: note = chr10:94828103-94828125
  misc_feature 1..22: note = hyper
  source 1..22: mol_type = genomic DNA
gtgatgtatagcatccgggaca

SEQ ID NO: 53894 - DNA, 237 bp, Homo sapiens
  misc_feature 1..237: note = chr10:94828498-94828735
  misc_feature 1..237: note = hyper
  source 1..237: mol_type = genomic DNA
gcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggaggga

SEQ ID NO: 53895 - DNA, 66 bp, Homo sapiens; identical to SEQ ID NO: 20695
  misc_feature 1..66: note = chr10:94828828-94828894
  misc_feature 1..66: note = hyper
  source 1..66: mol_type = genomic DNA

SEQ ID NO: 53896 - DNA, 320 bp, Homo sapiens; identical to SEQ ID NO: 33191
  misc_feature 1..320: note = chr10:94831610-94831930
  misc_feature 1..320: note = hyper
  source 1..320: mol_type = genomic DNA

SEQ ID NO: 53897 - DNA, 38 bp, Homo sapiens; identical to SEQ ID NO: 33192
  misc_feature 1..38: note = chr10:94831980-94832018
  misc_feature 1..38: note = hyper
  source 1..38: mol_type = genomic DNA

SEQ ID NO: 53898 - DNA, 166 bp, Homo sapiens; identical to SEQ ID NO: 33193
  misc_feature 1..166: note = chr10:94833026-94833192
  misc_feature 1..166: note = hyper
  source 1..166: mol_type = genomic DNA

SEQ ID NO: 53899 - DNA, 69 bp, Homo sapiens; identical to SEQ ID NO: 33194
  misc_feature 1..69: note = chr10:94833580-94833649
  misc_feature 1..69: note = hyper
  source 1..69: mol_type = genomic DNA

SEQ ID NO: 53900 - DNA, 380 bp, Homo sapiens; identical to SEQ ID NO: 20698
  misc_feature 1..380: note = chr10:94834033-94834413
  misc_feature 1..380: note = hyper
  source 1..380: mol_type = genomic DNA

SEQ ID NO: 53901 - DNA, 81 bp, Homo sapiens; identical to SEQ ID NO: 33196
  misc_feature 1..81: note = chr10:95326983-95327064
  misc_feature 1..81: note = hyper
  source 1..81: mol_type = genomic DNA

SEQ ID NO: 53902 - DNA, 193 bp, Homo sapiens; identical to SEQ ID NO: 33197
  misc_feature 1..193: note = chr10:95361207-95361400
  misc_feature 1..193: note = hyper
  source 1..193: mol_type = genomic DNA

SEQ ID NO: 53903 - DNA, 137 bp, Homo sapiens; identical to SEQ ID NO: 33198
  misc_feature 1..137: note = chr10:95753607-95753744
  misc_feature 1..137: note = hyper
  source 1..137: mol_type = genomic DNA

SEQ ID NO: 53904 - DNA, 30 bp, Homo sapiens; identical to SEQ ID NO: 33199
  misc_feature 1..30: note = chr10:98944811-98944841
  misc_feature 1..30: note = hyper
  source 1..30: mol_type = genomic DNA

SEQ ID NO: 53905 - DNA, 33 bp, Homo sapiens; identical to SEQ ID NO: 33200
  misc_feature 1..33: note = chr10:98945047-98945080
  misc_feature 1..33: note = hyper
  source 1..33: mol_type = genomic DNA

SEQ ID NO: 53906 - DNA, 267 bp, Homo sapiens; identical to SEQ ID NO: 33201
  misc_feature 1..267: note = chr10:98945472-98945739
  misc_feature 1..267: note = hyper
  source 1..267: mol_type = genomic DNA

SEQ ID NO: 53907 - DNA, 268 bp, Homo sapiens; identical to SEQ ID NO: 33202
  misc_feature 1..268: note = chr10:98945799-98946067
  misc_feature 1..268: note = hyper
  source 1..268: mol_type = genomic DNA

SEQ ID NO: 53908 - DNA, 92 bp, Homo sapiens; identical to SEQ ID NO: 33203
  misc_feature 1..92: note = chr10:98946094-98946186
  misc_feature 1..92: note = hyper
  source 1..92: mol_type = genomic DNA

SEQ ID NO: 53909 - DNA, 24 bp, Homo sapiens
  misc_feature 1..24: note = chr10:99080838-99080862
  misc_feature 1..24: note = hyper
  source 1..24: mol_type = genomic DNA
gcacgcactgggttgcgggacaga

SEQ ID NO: 53910 - DNA, 71 bp, Homo sapiens; identical to SEQ ID NO: 20703
  misc_feature 1..71: note = chr10:99531148-99531219
  misc_feature 1..71: note = hyper
  source 1..71: mol_type = genomic DNA

SEQ ID NO: 53911 - DNA, 98 bp, Homo sapiens; identical to SEQ ID NO: 10402
  misc_feature 1..98: note = chr10:99531512-99531610
  misc_feature 1..98: note = hyper
  source 1..98: mol_type = genomic DNA

SEQ ID NO: 53912 - DNA, 50 bp, Homo sapiens; identical to SEQ ID NO: 33208
  misc_feature 1..50: note = chr10:99531829-99531879
  misc_feature 1..50: note = hyper
  source 1..50: mol_type = genomic DNA

SEQ ID NO: 53913 - DNA, 142 bp, Homo sapiens; identical to SEQ ID NO: 33209
  misc_feature 1..142: note = chr10:99531880-99532022
  misc_feature 1..142: note = hyper
  source 1..142: mol_type = genomic DNA

SEQ ID NO: 53914 - DNA, 70 bp, Homo sapiens
  misc_feature 1..70: note = chr10:99789105-99789175
  misc_feature 1..70: note = hyper
  source 1..70: mol_type = genomic DNA
ttccacttggcttcacgtggaaagtcctgcacccatcccagaagacacctcaagtgcaactcaagaatgt

SEQ ID NO: 53915 - DNA, 15 bp, Homo sapiens
  misc_feature 1..15: note = chr10:99789282-99789297
  misc_feature 1..15: note = hyper
  source 1..15: mol_type = genomic DNA
cggcagcagcagcaa

SEQ ID NO: 53916 - DNA, 218 bp, Homo sapiens; identical to SEQ ID NO: 33211
  misc_feature 1..218: note = chr10:99789739-99789957
  misc_feature 1..218: note = hyper
  source 1..218: mol_type = genomic DNA

SEQ ID NO: 53917 - DNA, 22 bp, Homo sapiens
  misc_feature 1..22: note = chr10:99790318-99790340
  misc_feature 1..22: note = hyper
  source 1..22: mol_type = genomic DNA
agccccggtcccgggctggcct

SEQ ID NO: 53918 - DNA, 153 bp, Homo sapiens; identical to SEQ ID NO: 20710
  misc_feature 1..153: note = chr10:99790437-99790590
  misc_feature 1..153: note = hyper
  source 1..153: mol_type = genomic DNA

SEQ ID NO: 53919 - DNA, 96 bp, Homo sapiens; identical to SEQ ID NO: 20711
  misc_feature 1..96: note = chr10:99790664-99790760
  misc_feature 1..96: note = hyper
  source 1..96: mol_type = genomic DNA

SEQ ID NO: 53920 - DNA, 30 bp, Homo sapiens; identical to SEQ ID NO: 20712
  misc_feature 1..30: note = chr10:99790917-99790947
  misc_feature 1..30: note = hyper
  source 1..30: mol_type = genomic DNA

SEQ ID NO: 53921 - DNA, 16 bp, Homo sapiens
  misc_feature 1..16: note = chr10:99791161-99791177
  misc_feature 1..16: note = hyper
  source 1..16: mol_type = genomic DNA
ccgtccccaccagcag

SEQ ID NO: 53922 - DNA, 204 bp, Homo sapiens
  misc_feature 1..204: note = chr10:100992443-100992647
  misc_feature 1..204: note = hyper
  source 1..204: mol_type = genomic DNA
tcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccggg

SEQ ID NO: 53923 - DNA, 47 bp, Homo sapiens; identical to SEQ ID NO: 33217
  misc_feature 1..47: note = chr10:100992681-100992728
  misc_feature 1..47: note = hyper
  source 1..47: mol_type = genomic DNA

SEQ ID NO: 53924 - DNA, 50 bp, Homo sapiens; identical to SEQ ID NO: 20715
  misc_feature 1..50: note = chr10:100993487-100993537
  misc_feature 1..50: note = hyper
  source 1..50: mol_type = genomic DNA

SEQ ID NO: 53925 - DNA, 679 bp, Homo sapiens
  misc_feature 1..679: note = chr10:100994016-100994695
  misc_feature 1..679: note = hyper
  source 1..679: mol_type = genomic DNA
cacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaat

SEQ ID NO: 53926 - DNA, 320 bp, Homo sapiens
  misc_feature 1..320: note = chr10:100995726-100996046
  misc_feature 1..320: note = hyper
  source 1..320: mol_type = genomic DNA
gctcgctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggta

SEQ ID NO: 53927 - DNA, 234 bp, Homo sapiens
  misc_feature 1..234: note = chr10:100996224-100996458
  misc_feature 1..234: note = hyper
  source 1..234: mol_type = genomic DNA
tctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaaggg

SEQ ID NO: 53928 - DNA, 30 bp, Homo sapiens; identical to SEQ ID NO: 33221
  misc_feature 1..30: note = chr10:100996680-100996710
  misc_feature 1..30: note = hyper
  source 1..30: mol_type = genomic DNA

SEQ ID NO: 53929 - DNA, 67 bp, Homo sapiens
  misc_feature 1..67: note = chr10:101088928-101088995
  misc_feature 1..67: note = hyper
  source 1..67: mol_type = genomic DNA
ccgctacgcacagtgcggtgatgcctggccacctccagcctccagcggggacctcctgcccaggtgg

SEQ ID NO: 53930 - DNA, 73 bp, Homo sapiens
  misc_feature 1..73: note = chr10:101089835-101089908
  misc_feature 1..73: note = hyper
  source 1..73: mol_type = genomic DNA
tgctgctagccttgtcggccctgttcagcggcctgcgcctgagcctgctgtcgctggacccggtggagttacg

SEQ ID NO: 53931 - skipped

SEQ ID NO: 53932 - DNA, 11 bp, Homo sapiens
  misc_feature 1..11: note = chr10:101280193-101280204
  misc_feature 1..11: note = hyper
  source 1..11: mol_type = genomic DNA
cacataaatca

SEQ ID NO: 53933 - DNA, 253 bp, Homo sapiens; identical to SEQ ID NO: 10421
  misc_feature 1..253: note = chr10:101283181-101283434
  misc_feature 1..253: note = hyper
  source 1..253: mol_type = genomic DNA

SEQ ID NO: 53934 - DNA, 27 bp, Homo sapiens
  misc_feature 1..27: note = chr10:101291230-101291257
  misc_feature 1..27: note = hyper
  source 1..27: mol_type = genomic DNA
cgccatcctgaccgccaaaaaatgctt

SEQ ID NO: 53935 - DNA, 89 bp, Homo sapiens
  misc_feature 1..89: note = chr10:101293067-101293156
  misc_feature 1..89: note = hyper
  source 1..89: mol_type = genomic DNA
ggaggacgaggaagacgagggcgagaaattgtcctatttgaactcactagccgcagcagacggccacggggattcagggctgtgtcccc

SEQ ID NO: 53936 - DNA, 111 bp, Homo sapiens; identical to SEQ ID NO: 20722
  misc_feature 1..111: note = chr10:101293343-101293454
  misc_feature 1..111: note = hyper
  source 1..111: mol_type = genomic DNA

SEQ ID NO: 53937 - DNA, 261 bp, Homo sapiens; identical to SEQ ID NO: 33232
  misc_feature 1..261: note = chr10:101293671-101293932
  misc_feature 1..261: note = hyper
  source 1..261: mol_type = genomic DNA

SEQ ID NO: 53938 - DNA, 133 bp, Homo sapiens
  misc_feature 1..133: note = chr10:101294623-101294756
  misc_feature 1..133: note = hyper
  source 1..133: mol_type = genomic DNA
ccagccatttactaccgcacgctctgcgcagccaccaaaaagggtcacggtgctccaggacaggagccgcggtgcggccgggaacagctaaggacgctgttgtttgcttcttccgcagaaagctgccagctga

SEQ ID NO: 53939 - skipped

SEQ ID NO: 53940 - DNA, 125 bp, Homo sapiens; identical to SEQ ID NO: 33236
  misc_feature 1..125: note = chr10:101300247-101300372
  misc_feature 1..125: note = hyper
  source 1..125: mol_type = genomic DNA

SEQ ID NO: 53941 - DNA, 14 bp, Homo sapiens
  misc_feature 1..14: note = chr10:101875138-101875152
  misc_feature 1..14: note = hyper
  source 1..14: mol_type = genomic DNA
gatatctgttgatt

SEQ ID NO: 53942 - DNA, 11 bp, Homo sapiens
  misc_feature 1..11: note = chr10:102322219-102322230
  misc_feature 1..11: note = hyper
  source 1..11: mol_type = genomic DNA
agagcctgggg

SEQ ID NO: 53943 - DNA, 31 bp, Homo sapiens
  misc_feature 1..31: note = chr10:102322260-102322291
  misc_feature 1..31: note = hyper
  source 1..31: mol_type = genomic DNA
tggccgcagcccagctcggctctgtctcgag

SEQ ID NO: 53944 - DNA, 30 bp, Homo sapiens; identical to SEQ ID NO: 10430
  misc_feature 1..30: note = chr10:102414410-102414440
  misc_feature 1..30: note = hyper
  source 1..30: mol_type = genomic DNA

SEQ ID NO: 53945 - DNA, 230 bp, Homo sapiens; identical to SEQ ID NO: 33240
  misc_feature 1..230: note = chr10:102414708-102414938
  misc_feature 1..230: note = hyper
  source 1..230: mol_type = genomic DNA

SEQ ID NO: 53946 - DNA, 15 bp, Homo sapiens
  misc_feature 1..15: note = chr10:102415092-102415107
  misc_feature 1..15: note = hyper
  source 1..15: mol_type = genomic DNA
cgcactgcagcgcgg

SEQ ID NO: 53947 - DNA, 30 bp, Homo sapiens; identical to SEQ ID NO: 33242
  misc_feature 1..30: note = chr10:102415618-102415648
  misc_feature 1..30: note = hyper
  source 1..30: mol_type = genomic DNA

SEQ ID NO: 53948 - DNA, 135 bp, Homo sapiens; identical to SEQ ID NO: 33243
  misc_feature 1..135: note = chr10:102419132-102419267
  misc_feature 1..135: note = hyper
  source 1..135: mol_type = genomic DNA

SEQ ID NO: 53949 - DNA, 166 bp, Homo sapiens; identical to SEQ ID NO: 20725
  misc_feature 1..166: note = chr10:102419681-102419847
  misc_feature 1..166: note = hyper
  source 1..166: mol_type = genomic DNA

SEQ ID NO: 53950 - DNA, 17 bp, Homo sapiens
  misc_feature 1..17: note = chr10:102430682-102430699
  misc_feature 1..17: note = hyper
  source 1..17: mol_type = genomic DNA
tactcctgacaggatcg

SEQ ID NO: 53951 - DNA, 209 bp, Homo sapiens
  misc_feature 1..209: note = chr10:102430761-102430970
  misc_feature 1..209: note = hyper
  source 1..209: mol_type = genomic DNA
tccaaaggctccgcggccattacgggaaagttagtgtgaaacatgttaaattatccccaaagtggagggagcgggggaggcggcgggggagcgggcgcccgagagagccacgagacccgccgcctccgccggggccgggtgactgcgccgtgcccgacacgccgacgtccaccagggggcggccgcgtgcggcccgagcctcggtctgc

SEQ ID NO: 53952 - DNA, 184 bp, Homo sapiens; identical to SEQ ID NO: 33246
  misc_feature 1..184: note = chr10:102470093-102470277
  misc_feature 1..184: note = hyper
  source 1..184: mol_type = genomic DNA

SEQ ID NO: 53953 - DNA, 69 bp, Homo sapiens; identical to SEQ ID NO: 33247
  misc_feature 1..69: note = chr10:102470339-102470408
  misc_feature 1..69: note = hyper
  source 1..69: mol_type = genomic DNA

SEQ ID NO: 53954 - DNA, 305 bp, Homo sapiens; identical to SEQ ID NO: 33248
  misc_feature 1..305: note = chr10:102473411-102473716
  misc_feature 1..305: note = hyper
  source 1..305: mol_type = genomic DNA

SEQ ID NO: 53955 - DNA, 97 bp, Homo sapiens; identical to SEQ ID NO: 20731
  misc_feature 1..97: note = chr10:102473759-102473856
  misc_feature 1..97: note = hyper
  source 1..97: mol_type = genomic DNA

SEQ ID NO: 53956 - DNA, 77 bp, Homo sapiens; identical to SEQ ID NO: 20732
  misc_feature 1..77: note = chr10:102473932-102474009
  misc_feature 1..77: note = hyper
  source 1..77: mol_type = genomic DNA

SEQ ID NO: 53957 - DNA, 146 bp, Homo sapiens; identical to SEQ ID NO: 33250
  misc_feature 1..146: note = chr10:102475263-102475409
  misc_feature 1..146: note = hyper
  source 1..146: mol_type = genomic DNA

SEQ ID NO: 53958 - DNA, 23 bp, Homo sapiens
  misc_feature 1..23: note = chr10:102475555-102475578
  misc_feature 1..23: note = hyper
  source 1..23: mol_type = genomic DNA
ggagcgagaggcagcggagccgc

SEQ ID NO: 53959 - DNA, 366 bp, Homo sapiens; identical to SEQ ID NO: 33252
  misc_feature 1..366: note = chr10:102475579-102475945
  misc_feature 1..366: note = hyper
  source 1..366: mol_type = genomic DNA

SEQ ID NO: 53960 - DNA, 46 bp, Homo sapiens; identical to SEQ ID NO: 33253
  misc_feature 1..46: note = chr10:102483750-102483796
  misc_feature 1..46: note = hyper
  source 1..46: mol_type = genomic DNA

SEQ ID NO: 53961 - DNA, 123 bp, Homo sapiens
  misc_feature 1..123: note = chr10:102483870-102483993
  misc_feature 1..123: note = hyper
  source 1..123: mol_type = genomic DNA
ggagttggagacgatgataaatatgataatttgtataaaatctgaatgggtcttgttttcagggagaatgccttggatgatgaatgggcccggctttcagatagatggctgataaaaagtgta

SEQ ID NO: 53962 - DNA, 30 bp, Homo sapiens; identical to SEQ ID NO: 33257
  misc_feature 1..30: note = chr10:102489083-102489113
  misc_feature 1..30: note = hyper
  source 1..30: mol_type = genomic DNA

SEQ ID NO: 53963 - DNA, 336 bp, Homo sapiens; identical to SEQ ID NO: 33258
  misc_feature 1..336: note = chr10:102489328-102489664
  misc_feature 1..336: note = hyper
  source 1..336: mol_type = genomic DNA

SEQ ID NO: 53964 - DNA, 164 bp, Homo sapiens; identical to SEQ ID NO: 33259
  misc_feature 1..164: note = chr10:102489700-102489864
  misc_feature 1..164: note = hyper
  source 1..164: mol_type = genomic DNA

SEQ ID NO: 53965 - DNA, 40 bp, Homo sapiens; identical to SEQ ID NO: 33260
  misc_feature 1..40: note = chr10:102495101-102495141
  misc_feature 1..40: note = hyper
  source 1..40: mol_type = genomic DNA

SEQ ID NO: 53966 - DNA, 67 bp, Homo sapiens; identical to SEQ ID NO: 33261
  misc_feature 1..67: note = chr10:102495142-102495209
  misc_feature 1..67: note = hyper
  source 1..67: mol_type = genomic DNA

SEQ ID NO: 53967 - DNA, 71 bp, Homo sapiens
  misc_feature 1..71: note = chr10:102495437-102495508
  misc_feature 1..71: note = hyper
  source 1..71: mol_type = genomic DNA
aggacgcggcggccgcggggagcctagcatggaagagcgcgcgggtccggcaggtaagagcggcagagacc

SEQ ID NO: 53968 - DNA, 23 bp, Homo sapiens
  misc_feature 1..23: note = chr10:102497153-102497176
  misc_feature 1..23: note = hyper
  source 1..23: mol_type = genomic DNA
acgggttagggcggccgcttacc

SEQ ID NO: 53969 - DNA, 21 bp, Homo sapiens
  misc_feature 1..21: note = chr10:102497252-102497273
  misc_feature 1..21: note = hyper
  source 1..21: mol_type = genomic DNA
cgggtgcgggtctcgtgttcc

SEQ ID NO: 53970 - DNA, 101 bp, Homo sapiens
  misc_feature 1..101: note = chr10:102497708-102497809
  misc_feature 1..101: note = hyper
  source 1..101: mol_type = genomic DNA
ggggattgaatcagcaactagggcaattgtggtcttcagctatcgctgcctatacccccagaacttacaaaaataagccgtttattcgatgccctcccttt

SEQ ID NO: 53971 - DNA, 104 bp, Homo sapiens
  misc_feature 1..104: note = chr10:102498176-102498280
  misc_feature 1..104: note = hyper
  source 1..104: mol_type = genomic DNA
ctcccatctcagccccgcctggaacacagctgtctgcctatactaccttcgccaccccctggcactttttacacaccctcacaacactcaagcacactcctacg

SEQ ID NO: 53972 - DNA, 33 bp, Homo sapiens; identical to SEQ ID NO: 33267
  misc_feature 1..33: note = chr10:102498739-102498772
  misc_feature 1..33: note = hyper
  source 1..33: mol_type = genomic DNA

SEQ ID NO: 53973 - DNA, 332 bp, Homo sapiens; identical to SEQ ID NO: 33268
  misc_feature 1..332: note = chr10:102498832-102499164
  misc_feature 1..332: note = hyper
  source 1..332: mol_type = genomic DNA

SEQ ID NO: 53974 - DNA, 39 bp, Homo sapiens; identical to SEQ ID NO: 33269
  misc_feature 1..39: note = chr10:102499518-102499557
  misc_feature 1..39: note = hyper
  source 1..39: mol_type = genomic DNA

SEQ ID NO: 53975 - DNA, 112 bp, Homo sapiens; identical to SEQ ID NO: 20745
  misc_feature 1..112: note = chr10:102501247-102501359
  misc_feature 1..112: note = hyper
  source 1..112: mol_type = genomic DNA

SEQ ID NO: 53976 - DNA, 32 bp, Homo sapiens
  misc_feature 1..32: note = chr10:102501389-102501421
  misc_feature 1..32: note = hyper
  source 1..32: mol_type = genomic DNA
tggtcggctctggagttcggttgtcagaagaa

SEQ ID NO: 53977 - DNA, 743 bp, Homo sapiens; identical to SEQ ID NO: 33271
  misc_feature 1..743: note = chr10:102501726-102502469
  misc_feature 1..743: note = hyper
  source 1..743: mol_type = genomic DNA

SEQ ID NO: 53978 - DNA, 142 bp, Homo sapiens; identical to SEQ ID NO: 33272
  misc_feature 1..142: note = chr10:102503828-102503970
  misc_feature 1..142: note = hyper
  source 1..142: mol_type = genomic DNA

SEQ ID NO: 53979 - DNA, 216 bp, Homo sapiens; identical to SEQ ID NO: 10455
  misc_feature 1..216: note = chr10:102504302-102504518
  misc_feature 1..216: note = hyper
  source 1..216: mol_type = genomic DNA

SEQ ID NO: 53980 - DNA, 93 bp, Homo sapiens; identical to SEQ ID NO: 33274
  misc_feature 1..93: note = chr10:102505756-102505849
  misc_feature 1..93: note = hyper
  source 1..93: mol_type = genomic DNA

SEQ ID NO: 53981 - DNA, 43 bp, Homo sapiens; identical to SEQ ID NO: 33275
  misc_feature 1..43: note = chr10:102505873-102505916
  misc_feature 1..43: note = hyper
  source 1..43: mol_type = genomic DNA

SEQ ID NO: 53982 - DNA, 114 bp, Homo sapiens
  misc_feature 1..114: note = chr10:102507395-102507509
  misc_feature 1..114: note = hyper
  source 1..114: mol_type = genomic DNA
taatcatatatttagcgttgcgggggttggggggggcgtttaaaaatacttctgggataaaatatatttttctaagtaatttccaagcgcaggaaagccgcgccgagggcatca

SEQ ID NO: 53983 - DNA, 184 bp, Homo sapiens; identical to SEQ ID NO: 33277
  misc_feature 1..184: note = chr10:102507767-102507951
  misc_feature 1..184: note = hyper
  source 1..184: mol_type = genomic DNA

SEQ ID NO: 53984 - DNA, 10 bp, Homo sapiens
  misc_feature 1..10: note = chr10:102508280-102508290
  misc_feature 1..10: note = hyper
  source 1..10: mol_type = genomic DNA
cagtccgggc

SEQ ID NO: 53985 - DNA, 655 bp, Homo sapiens
  misc_feature 1..655: note = chr10:102508341-102508996
  misc_feature 1..655: note = hyper
  source 1..655: mol_type = genomic DNA
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctg

SEQ ID NO: 53986 - DNA, 257 bp, Homo sapiens
  misc_feature 1..257: note = chr10:102509285-102509542
  misc_feature 1..257: note = hyper
  source 1..257: mol_type = genomic DNA
gccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgt

SEQ ID NO: 53987 - DNA, 33 bp, Homo sapiens; identical to SEQ ID NO: 33280
  misc_feature 1..33: note = chr10:102586113-102586146
  misc_feature 1..33: note = hyper
  source 1..33: mol_type = genomic DNA

SEQ ID NO: 53988 - DNA, 39 bp, Homo sapiens; identical to SEQ ID NO: 33281
  misc_feature 1..39: note = chr10:102588299-102588338
  misc_feature 1..39: note = hyper
  source 1..39: mol_type = genomic DNA

SEQ ID NO: 53989 - DNA, 175 bp, Homo sapiens; identical to SEQ ID NO: 20753
  misc_feature 1..175: note = chr10:102589250-102589425
  misc_feature 1..175: note = hyper
  source 1..175: mol_type = genomic DNA

SEQ ID NO: 53990 - DNA, 293 bp, Homo sapiens; identical to SEQ ID NO: 20754
  misc_feature 1..293: note = chr10:102589493-102589786
  misc_feature 1..293: note = hyper
  source 1..293: mol_type = genomic DNA

SEQ ID NO: 53991 - DNA, 237 bp, Homo sapiens; identical to SEQ ID NO: 20755
  misc_feature 1..237: note = chr10:102589915-102590152
  misc_feature 1..237: note = hyper
  source 1..237: mol_type = genomic DNA

SEQ ID NO: 53992 - DNA, 241 bp, Homo sapiens; identical to SEQ ID NO: 20756
  misc_feature 1..241: note = chr10:102891582-102891823
  misc_feature 1..241: note = hyper
  source 1..241: mol_type = genomic DNA

SEQ ID NO: 53993 - DNA, 159 bp, Homo sapiens; identical to SEQ ID NO: 33285
  misc_feature 1..159: note = chr10:102892090-102892249
  misc_feature 1..159: note = hyper
  source 1..159: mol_type = genomic DNA

SEQ ID NO: 53994 - DNA, 41 bp, Homo sapiens; identical to SEQ ID NO: 20757
  misc_feature 1..41: note = chr10:102893583-102893624
  misc_feature 1..41: note = hyper
  source 1..41: mol_type = genomic DNA

SEQ ID NO: 53995 - DNA, 33 bp, Homo sapiens
  misc_feature 1..33: note = chr10:102899140-102899173
  misc_feature 1..33: note = hyper
  source 1..33: mol_type = genomic DNA
ggagggttcagggtccgaagacagcagccagcc

SEQ ID NO: 53996 - DNA, 206 bp, Homo sapiens; identical to SEQ ID NO: 20758
  misc_feature 1..206: note = chr10:102899601-102899807
  misc_feature 1..206: note = hyper
  source 1..206: mol_type = genomic DNA

SEQ ID NO: 53997 - DNA, 107 bp, Homo sapiens
  misc_feature 1..107: note = chr10:102900575-102900682
  misc_feature 1..107: note = hyper
  source 1..107: mol_type = genomic DNA
caggaacccaggcagggatggggtcctagaggccctgtgcagtgcggtgggtggcacacagagaatctggctcaacctgttaactataatagcggctttgtgtggcc

SEQ ID NO: 53998 - DNA, 83 bp, Homo sapiens; identical to SEQ ID NO: 33290
  misc_feature 1..83: note = chr10:102905699-102905782
  misc_feature 1..83: note = hyper
  source 1..83: mol_type = genomic DNA

SEQ ID NO: 53999 - DNA, 191 bp, Homo sapiens; identical to SEQ ID NO: 33291
  misc_feature 1..191: note = chr10:102975143-102975334
  misc_feature 1..191: note = hyper
  source 1..191: mol_type = genomic DNA

SEQ ID NO: 54000 - DNA, 24 bp, Homo sapiens
  misc_feature 1..24: note = chr10:102975595-102975619
  misc_feature 1..24: note = hyper
  source 1..24: mol_type = genomic DNA
cgccgtctgggaactcgagatccg

SEQ ID NO: 54001 - DNA, 46 bp, Homo sapiens
  misc_feature 1..46: note = chr10:102975834-102975880
  misc_feature 1..46: note = hyper
  source 1..46: mol_type = genomic DNA
tgcccggctccggaggtcttagcagcatcctcggaggttgccaaac

SEQ ID NO: 54002 - DNA, 242 bp, Homo sapiens; identical to SEQ ID NO: 33293
  misc_feature 1..242: note = chr10:102976414-102976656
  misc_feature 1..242: note = hyper
  source 1..242: mol_type = genomic DNA

SEQ ID NO: 54003 - DNA, 879 bp, Homo sapiens
  misc_feature 1..879: note = chr10:102977412-102978291
  misc_feature 1..879: note = hyper
  source 1..879: mol_type = genomic DNA
cagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattggggggtgaggagtggtggtgggggcggacaaagggacaacgtggcggtggacgaaccagggccagagagggccgctgtggctcccgctcttcgggccgaagcacccaccacgggttcgttattaacgcgctgggaagtccgcaatccgcccaactttcttctctttaatgagcctagaagaggctgccctgaaggggtttgttcattaaagatgtagctggaggaatattgtctcattaattatctggttttaattacactcctaccctttgaatccagagatgggaaaagttgatttggtggcgccgcccccttgagcttaaagggtcggcctggctagggg

SEQ ID NO: 54004 - DNA, 392 bp, Homo sapiens; identical to SEQ ID NO: 33295
  misc_feature 1..392: note = chr10:102978742-102979134
  misc_feature 1..392: note = hyper
  source 1..392: mol_type = genomic DNA

SEQ ID NO: 54005 - DNA, 770 bp, Homo sapiens; identical to SEQ ID NO: 33296
  misc_feature 1..770: note = chr10:102982287-102983057
  misc_feature 1..770: note = hyper
  source 1..770: mol_type = genomic DNA

SEQ ID NO: 54006 - DNA, 66 bp, Homo sapiens
  misc_feature 1..66: note = chr10:102983087-102983153
  misc_feature 1..66: note = hyper
  source 1..66: mol_type = genomic DNA
cgaacttgggatttgaggctctctcacatcgccggtcccagcggcagcgcctgaggcacagccaag

SEQ ID NO: 54007 - DNA, 177 bp, Homo sapiens
  misc_feature 1..177: note = chr10:102983749-102983926
  misc_feature 1..177: note = hyper
  source 1..177: mol_type = genomic DNA
agctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcg

SEQ ID NO: 54008 - DNA, 15 bp, Homo sapiens
  misc_feature 1..15: note = chr10:102984356-102984371
  misc_feature 1..15: note = hyper
  source 1..15: mol_type = genomic DNA
cggaggtgccagggc

SEQ ID NO: 54009 - DNA, 25 bp, Homo sapiens
  misc_feature 1..25: note = chr10:102984516-102984541
  misc_feature 1..25: note = hyper
  source 1..25: mol_type = genomic DNA
gaggcgcgcgcggggacctaatcca

SEQ ID NO: 54010 - DNA, 625 bp, Homo sapiens
  misc_feature 1..625: note = chr10:102985147-102985772
  misc_feature 1..625: note = hyper
  source 1..625: mol_type = genomic DNA
ccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcagg

SEQ ID NO: 54011 - DNA, 571 bp, Homo sapiens; identical to SEQ ID NO: 20769
  misc_feature 1..571: note = chr10:102985963-102986534
  misc_feature 1..571: note = hyper
  source 1..571: mol_type = genomic DNA

SEQ ID NO: 54012 - DNA, 215 bp, Homo sapiens; identical to SEQ ID NO: 33303
  misc_feature 1..215: note = chr10:102988150-102988365
  misc_feature 1..215: note = hyper
  source 1..215: mol_type = genomic DNA

SEQ ID NO: 54013 - DNA, 141 bp, Homo sapiens; identical to SEQ ID NO: 33304
  misc_feature 1..141: note = chr10:102988734-102988875
  misc_feature 1..141: note = hyper
  source 1..141: mol_type = genomic DNA

SEQ ID NO: 54014 - DNA, 457 bp, Homo sapiens
  misc_feature 1..457: note = chr10:102989172-102989629
  misc_feature 1..457: note = hyper
  source 1..457: mol_type = genomic DNA
tctctccctctccctcgccctctctttcactctctgtctgtccaatgcaggcggctgtaagttgggaagctcattaattagcgggccgggggtaggaggagccggctggaattagcctgcctaatgcgcctgtcagtccgggcgctgcgctgcgttcggcccgagctgtttgtaaattacattagctgctcctttattgcacccgaacctcgggcgactgaaaagccaccgcccccaccccaaactgcgagccgcgctcctggcgcacccgcctcccgccggcctagctgcaatgaccgcaccggcccgaaggtctcggtctctccgacccgggatgtggagcccgaaagagtggtgggaaccccagcccgggagggacgcggccgccgctcgggccaggtaggaccaggagcccgggtgggccccgctgccacccagagtggactttgcggagctg

SEQ ID NO: 54015 - DNA, 638 bp, Homo sapiens
  misc_feature 1..638: note = chr10:102989659-102990297
  misc_feature 1..638: note = hyper
  source 1..638: mol_type = genomic DNA
ccctcttgcccctcaccccactgcctgggcgacgcgcctggggagagggaatctgaagccctcctgcgctggcccgcaggaggtcagagccggctgcgcagccttgggtgggcgacgcgggaagggggtggaggaccccaggggttgggggagggggctagtcggagagctcagccttctccacgcggagaggcggaggagggaattgttggcggctctggacgcctctccccggcctgattccgaagcggccgccctacctcctccggcaatcttgctcactttcctccggcagccgctccccaggctggctggggccaccaacggcctgatgatgggcgtctgaagagtagccaggccaggtgccggggctaacggggccggctccgtgcctccctgctgcgctccgcccgggccccggccggggccccgctgccggccccgcctagcccagcgcccggcttgagtgcatggccaggccgactccagctgttccggatgcggggcgggggcccggcgggagccaggccgcggctggggctttgctctcaggaactcgcagggaggccaggcttccagttaggctggggctaaagaccttagggcccgggatctgtgaatatcgggagaacatgttg

SEQ ID NO: 54016 - DNA, 97 bp, Homo sapiens
  misc_feature 1..97: note = chr10:102996019-102996116
  misc_feature 1..97: note = hyper
  source 1..97: mol_type = genomic DNA
aggtctcactactgtcggggggcgccgggcgcaggccgggcatggggcctgagcttaggccaggtggaaaggtggaaggacctagtggggacagacg

SEQ ID NO: 54017 - DNA, 81 bp, Homo sapiens; identical to SEQ ID NO: 20773
  misc_feature 1..81: note = chr10:102996638-102996719
  misc_feature 1..81: note = hyper
  source 1..81: mol_type = genomic DNA

SEQ ID NO: 54018 - DNA, 251 bp, Homo sapiens; identical to SEQ ID NO: 33308
  misc_feature 1..251: note = chr10:102996977-102997228
  misc_feature 1..251: note = hyper
  source 1..251: mol_type = genomic DNA

SEQ ID NO: 54019 - DNA, 48 bp, Homo sapiens; identical to SEQ ID NO: 20775
  misc_feature 1..48: note = chr10:102997281-102997329
  misc_feature 1..48: note = hyper
  source 1..48: mol_type = genomic DNA

SEQ ID NO: 54020 - DNA, 178 bp, Homo sapiens; identical to SEQ ID NO: 20776
  misc_feature 1..178: note = chr10:102997406-102997584
  misc_feature 1..178: note = hyper
  source 1..178: mol_type = genomic DNA

SEQ ID NO: 54021 - DNA, 298 bp, Homo sapiens
  misc_feature 1..298: note = chr10:102998278-102998576
  misc_feature 1..298: note = hyper
  source 1..298: mol_type = genomic DNA
gcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtg

SEQ ID NO: 54022 - DNA, 31 bp, Homo sapiens; identical to SEQ ID NO: 20778
  misc_feature 1..31: note = chr10:102998828-102998859
  misc_feature 1..31: note = hyper
  source 1..31: mol_type = genomic DNA

SEQ ID NO: 54023 - skipped

SEQ ID NO: 54024 - DNA, 51 bp, Homo sapiens; identical to SEQ ID NO: 20779
  misc_feature 1..51: note = chr10:103043924-103043975
  misc_feature 1..51: note = hyper
  source 1..51: mol_type = genomic DNA

SEQ ID NO: 54025 - DNA, 40 bp, Homo sapiens
  misc_feature 1..40: note = chr10:103044366-103044406
  misc_feature 1..40: note = hyper
  source 1..40: mol_type = genomic DNA
ggccagacagagttggggcgggaggcgggtatacggaaag

SEQ ID NO: 54026 - DNA, 79 bp, Homo sapiens; identical to SEQ ID NO: 33314
  misc_feature 1..79: note = chr10:103051188-103051267
  misc_feature 1..79: note = hyper
  source 1..79: mol_type = genomic DNA

SEQ ID NO: 54027 - DNA, 55 bp, Homo sapiens; identical to SEQ ID NO: 33315
  misc_feature 1..55: note = chr10:103052659-103052714
  misc_feature 1..55: note = hyper
  source 1..55: mol_type = genomic DNA

SEQ ID NO: 54028 - DNA, 80 bp, Homo sapiens; identical to SEQ ID NO: 33316
  misc_feature 1..80: note = chr10:103326534-103326614
  misc_feature 1..80: note = hyper
  source 1..80: mol_type = genomic DNA

SEQ ID NO: 54029 - DNA, 15 bp, Homo sapiens
  misc_feature 1..15: note = chr10:103534562-103534577
  misc_feature 1..15: note = hyper
  source 1..15: mol_type = genomic DNA
cggctgtagagttgg

SEQ ID NO: 54030 - DNA, 600 bp, Homo sapiens; identical to SEQ ID NO: 33318
  misc_feature 1..600: note = chr10:103534896-103535496
  misc_feature 1..600: note = hyper
  source 1..600: mol_type = genomic DNA

SEQ ID NO: 54031 - DNA, 48 bp, Homo sapiens; identical to SEQ ID NO: 33320
  misc_feature 1..48: note = chr10:103535841-103535889
  misc_feature 1..48: note = hyper
  source 1..48: mol_type = genomic DNA

SEQ ID NO: 54032 - DNA, 87 bp, Homo sapiens
  misc_feature 1..87: note = chr10:103536140-103536227
  misc_feature 1..87: note = hyper
  source 1..87: mol_type = genomic DNA
ggcggccggtctgggcgcctccccctatccccggcctgtcccctcgcgcgctccccggtcccggacgcgcggggatgggggcgccta

SEQ ID NO: 54033 - DNA, 87 bp, Homo sapiens
  misc_feature 1..87: note = chr10:103536416-103536503
  misc_feature 1..87: note = hyper
  source 1..87: mol_type = genomic DNA
gaatggctgcgcacccggccctcgcgcagtgcgtgccggtgccacccggaccccgctcccctgtttcggccgcgtgccccgtcctgt

SEQ ID NO: 54034 - DNA, 202 bp, Homo sapiens; identical to SEQ ID NO: 33323
  misc_feature 1..202: note = chr10:103986018-103986220
  misc_feature 1..202: note = hyper
  source 1..202: mol_type = genomic DNA

SEQ ID NO: 54035 - DNA, 172 bp, Homo sapiens; identical to SEQ ID NO: 33324
  misc_feature 1..172: note = chr10:104000813-104000985
  misc_feature 1..172: note = hyper
  source 1..172: mol_type = genomic DNA

SEQ ID NO: 54036 - DNA, 92 bp, Homo sapiens; identical to SEQ ID NO: 33325
  misc_feature 1..92: note = chr10:104001519-104001611
  misc_feature 1..92: note = hyper
  source 1..92: mol_type = genomic DNA

SEQ ID NO: 54037 - DNA, 153 bp, Homo sapiens; identical to SEQ ID NO: 33326
  misc_feature 1..153: note = chr10:104168680-104168833
  misc_feature 1..153: note = hyper
  source 1..153: mol_type = genomic DNA

SEQ ID NO: 54038 - DNA, 49 bp, Homo sapiens
  misc_feature 1..49: note = chr10:104170047-104170096
  misc_feature 1..49: note = hyper
  source 1..49: mol_type = genomic DNA
gctggcgcctgggaacgggacctgctcacagggagccagaaagcagttt

SEQ ID NO: 54039 - DNA, 69 bp, Homo sapiens; identical to SEQ ID NO: 20786
  misc_feature 1..69: note = chr10:104170732-104170801
  misc_feature 1..69: note = hyper
  source 1..69: mol_type = genomic DNA

SEQ ID NO: 54040 - DNA, 78 bp, Homo sapiens; identical to SEQ ID NO: 33330
  misc_feature 1..78: note = chr10:104629270-104629348
  misc_feature 1..78: note = hyper
  source 1..78: mol_type = genomic DNA

SEQ ID NO: 54041 - DNA, 92 bp, Homo sapiens; identical to SEQ ID NO: 20787
  misc_feature 1..92: note = chr10:105036450-105036542
  misc_feature 1..92: note = hyper
  source 1..92: mol_type = genomic DNA

SEQ ID NO: 54042 - DNA, 19 bp, Homo sapiens
  misc_feature 1..19: note = chr10:105036864-105036883
  misc_feature 1..19: note = hyper
  source 1..19: mol_type = genomic DNA
ccttaaaagccgggcgcac

SEQ ID NO: 54043 - DNA, 330 bp, Homo sapiens; identical to SEQ ID NO: 20789
  misc_feature 1..330: note = chr10:105036893-105037223
  misc_feature 1..330: note = hyper
  source 1..330: mol_type = genomic DNA

SEQ ID NO: 54044 - DNA, 86 bp, Homo sapiens; identical to SEQ ID NO: 10504
  misc_feature 1..86: note = chr10:105041683-105041769
  misc_feature 1..86: note = hyper
  source 1..86: mol_type = genomic DNA

SEQ ID NO: 54045 - DNA, 51 bp, Homo sapiens
  misc_feature 1..51: note = chr10:106398593-106398644
  misc_feature 1..51: note = hyper
  source 1..51: mol_type = genomic DNA
tgcacctccccagtgcgcataggacttgggagaccacactcctccgggctg

SEQ ID NO: 54046 - DNA, 275 bp, Homo sapiens
  misc_feature 1..275: note = chr10:106399306-106399581
  misc_feature 1..275: note = hyper
  source 1..275: mol_type = genomic DNA
aactctatctactcccgaaggggaggagcagggctggaggctgtctctctctccctaagcctcctccctcctgcctcctcctttcttaatagctcctcctctagctcctctagtctcagacttttcaacccctagaatcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggat

SEQ ID NO: 54047 - DNA, 178 bp, Homo sapiens
  misc_feature 1..178: note = chr10:106400387-106400565
  misc_feature 1..178: note = hyper
  source 1..178: mol_type = genomic DNA
ccagggagcggcgagcagagtccagggtgcatcccgcgcttggcttccgtgcgcagcctccccgcgcggaggcacctggctccctctcggctctagaacgcgaacagttggcgttgagcacacaactcctcctccttctcccccgagacccctgtaccctccccgcgcgccatctccc

SEQ ID NO: 54048 - DNA, 136 bp, Homo sapiens; identical to SEQ ID NO: 33339
  misc_feature 1..136: note = chr10:106400566-106400702
  misc_feature 1..136: note = hyper
  source 1..136: mol_type = genomic DNA

SEQ ID NO: 54049 - DNA, 215 bp, Homo sapiens; identical to SEQ ID NO: 33340
  misc_feature 1..215: note = chr10:106400703-106400918
  misc_feature 1..215: note = hyper
  source 1..215: mol_type = genomic DNA

SEQ ID NO: 54050 - DNA, 387 bp, Homo sapiens
  misc_feature 1..387: note = chr10:106402325-106402712
  misc_feature 1..387: note = hyper
  source 1..387: mol_type = genomic DNA
agtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggag

SEQ ID NO: 54051 - DNA, 127 bp, Homo sapiens; identical to SEQ ID NO: 33344
  misc_feature 1..127: note = chr10:108923771-108923898
  misc_feature 1..127: note = hyper
  source 1..127: mol_type = genomic DNA

SEQ ID NO: 54052 - DNA, 100 bp, Homo sapiens
  misc_feature 1..100: note = chr10:108923945-108924045
  misc_feature 1..100: note = hyper
  source 1..100: mol_type = genomic DNA
cgctccgctccgtctcctccggccggagcgtgcagcaaccgccatggatgccccagtgccccgagcccgctccagggatagcgctcggtccccgggggcc

SEQ ID NO: 54053 - DNA, 21 bp, Homo sapiens
  misc_feature 1..21: note = chr10:108924345-108924366
  misc_feature 1..21: note = hyper
  source 1..21: mol_type = genomic DNA
cgctggcggctgtggggggcc

SEQ ID NO: 54054 - DNA, 34 bp, Homo sapiens; identical to SEQ ID NO: 33347
  misc_feature 1..34: note = chr10:108924367-108924401
  misc_feature 1..34: note = hyper
  source 1..34: mol_type = genomic DNA

SEQ ID NO: 54055 - DNA, 32 bp, Homo sapiens; identical to SEQ ID NO: 33348
  misc_feature 1..32: note = chr10:108924769-108924801
  misc_feature 1..32: note = hyper
  source 1..32: mol_type = genomic DNA

SEQ ID NO: 54056 - DNA, 27 bp, Homo sapiens
  misc_feature 1..27: note = chr10:109674181-109674208
  misc_feature 1..27: note = hyper
  source 1..27: mol_type = genomic DNA
ttcacactccctccccgcttcgctccc

SEQ ID NO: 54057 - DNA, 29 bp, Homo sapiens
  misc_feature 1..29: note = chr10:109674466-109674495
  misc_feature 1..29: note = hyper
  source 1..29: mol_type = genomic DNA
ggagcagcaggagcccggtctcgcagtgc

SEQ ID NO: 54058 - skipped

SEQ ID NO: 54059 - DNA, 117 bp, Homo sapiens; identical to SEQ ID NO: 33352
  misc_feature 1..117: note = chr10:109674855-109674972
  misc_feature 1..117: note = hyper
  source 1..117: mol_type = genomic DNA

SEQ ID NO: 54060 - DNA, 257 bp, Homo sapiens; identical to SEQ ID NO: 10516
  misc_feature 1..257: note = chr10:110225912-110226169
  misc_feature 1..257: note = hyper
  source 1..257: mol_type = genomic DNA

SEQ ID NO: 54061 - DNA, 175 bp, Homo sapiens; identical to SEQ ID NO: 33354
  misc_feature 1..175: note = chr10:110671709-110671884
  misc_feature 1..175: note = hyper
  source 1..175: mol_type = genomic DNA

SEQ ID NO: 54062 - DNA, 29 bp, Homo sapiens
  misc_feature 1..29: note = chr10:110672245-110672274
  misc_feature 1..29: note = hyper
  source 1..29: mol_type = genomic DNA
ggctgcgcgcggatcgcctgcgccactgt

SEQ ID NO: 54063 - DNA, 51 bp, Homo sapiens; identical to SEQ ID NO: 3638
  misc_feature 1..51: note = chr10:111216345-111216396
  misc_feature 1..51: note = hyper
  source 1..51: mol_type = genomic DNA

SEQ ID NO: 54064 - DNA, 107 bp, Homo sapiens
  misc_feature 1..107: note = chr10:111216682-111216789
  misc_feature 1..107: note = hyper
  source 1..107: mol_type = genomic DNA
caacttttgccatcccgggagccatagcggcagagagggggtcccggacccgaggtggcagcgaggggctctgctttggcagctgtcggggctggagctcaggaccc

SEQ ID NO: 54065 - DNA, 74 bp, Homo sapiens; identical to SEQ ID NO: 33358
  misc_feature 1..74: note = chr10:111217161-111217235
  misc_feature 1..74: note = hyper
  source 1..74: mol_type = genomic DNA

SEQ ID NO: 54066 - DNA, 120 bp, Homo sapiens; identical to SEQ ID NO: 33359
  misc_feature 1..120: note = chr10:112257819-112257939
  misc_feature 1..120: note = hyper
  source 1..120: mol_type = genomic DNA

SEQ ID NO: 54067 - DNA, 30 bp, Homo sapiens; identical to SEQ ID NO: 33360
  misc_feature 1..30: note = chr10:112258378-112258408
  misc_feature 1..30: note = hyper
  source 1..30: mol_type = genomic DNA

SEQ ID NO: 54068 - DNA, 53 bp, Homo sapiens
  misc_feature 1..53: note = chr10:112403098-112403151
  misc_feature 1..53: note = hyper
  source 1..53: mol_type = genomic DNA
gcatattcgcacccacgcgccagggcattaagccgaaccttgcttggtggctc

SEQ ID NO: 54069 - DNA, 618 bp, Homo sapiens
  misc_feature 1..618: note = chr10:112403297-112403915
  misc_feature 1..618: note = hyper
  source 1..618: mol_type = genomic DNA
tcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtgcactgtggcgggtggcgtacgccgcgctccctccccgcttcctgcgcccagggtcggcg

SEQ ID NO: 54070 - DNA, 168 bp, Homo sapiens; identical to SEQ ID NO: 33362
  misc_feature 1..168: note = chr10:112404226-112404394
  misc_feature 1..168: note = hyper
  source 1..168: mol_type = genomic DNA

SEQ ID NO: 54071 - DNA, 253 bp, Homo sapiens; identical to SEQ ID NO: 33363
  misc_feature 1..253: note = chr10:112431872-112432125
  misc_feature 1..253: note = hyper
  source 1..253: mol_type = genomic DNA

SEQ ID NO: 54072 - DNA, 79 bp, Homo sapiens; identical to SEQ ID NO: 33364
  misc_feature 1..79: note = chr10:112432360-112432439
  misc_feature 1..79: note = hyper
  source 1..79: mol_type = genomic DNA

SEQ ID NO: 54073 - DNA, 41 bp, Homo sapiens; identical to SEQ ID NO: 33365
  misc_feature 1..41: note = chr10:112836758-112836799
  misc_feature 1..41: note = hyper
  source 1..41: mol_type = genomic DNA

SEQ ID NO: 54074 - DNA, 61 bp, Homo sapiens; identical to SEQ ID NO: 33366
  misc_feature 1..61: note = chr10:114712100-114712161
  misc_feature 1..61: note = hyper
  source 1..61: mol_type = genomic DNA

SEQ ID NO: 54075 - DNA, 116 bp, Homo sapiens; identical to SEQ ID NO: 33367
  misc_feature 1..116: note = chr10:115804051-115804167
  misc_feature 1..116: note = hyper
  source 1..116: mol_type = genomic DNA

SEQ ID NO: 54076 - skipped

SEQ ID NO: 54077 - DNA, 205 bp, Homo sapiens
  misc_feature 1..205: note = chr10:115804635-115804840
  misc_feature 1..205: note = hyper
  source 1..205: mol_type = genomic DNA
cgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccc

SEQ ID NO: 54078 - DNA, 41 bp, Homo sapiens; identical to SEQ ID NO: 20806
  misc_feature 1..41: note = chr10:115805014-115805055
  misc_feature 1..41: note = hyper
  source 1..41: mol_type = genomic DNA

SEQ ID NO: 54079 - DNA, 36 bp, Homo sapiens; identical to SEQ ID NO: 33370
  misc_feature 1..36: note = chr10:116163376-116163412
  misc_feature 1..36: note = hyper
  source 1..36: mol_type = genomic DNA

SEQ ID NO: 54080 - DNA, 23 bp, Homo sapiens
  misc_feature 1..23: note = chr10:116164341-116164364
  misc_feature 1..23: note = hyper
  source 1..23: mol_type = genomic DNA
ggccgccgcgcccagggtcctcg

SEQ ID NO: 54081 - DNA, 30 bp, Homo sapiens; identical to SEQ ID NO: 33372
  misc_feature 1..30: note = chr10:116164624-116164654
  misc_feature 1..30: note = hyper
  source 1..30: mol_type = genomic DNA

SEQ ID NO: 54082 - DNA, 195 bp, Homo sapiens; identical to SEQ ID NO: 33373
  misc_feature 1..195: note = chr10:116852246-116852441
  misc_feature 1..195: note = hyper
  source 1..195: mol_type = genomic DNA

SEQ ID NO: 54083 - DNA, 95 bp, Homo sapiens; identical to SEQ ID NO: 33374
  misc_feature 1..95: note = chr10:116853397-116853492
  misc_feature 1..95: note = hyper
  source 1..95: mol_type = genomic DNA

SEQ ID NO: 54084 - DNA, 370 bp, Homo sapiens
  misc_feature 1..370: note = chr10:118032547-118032917
  misc_feature 1..370: note = hyper
  source 1..370: mol_type = genomic DNA
aaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgtt

SEQ ID NO: 54085 - DNA, 171 bp, Homo sapiens
  misc_feature 1..171: note = chr10:118033542-118033713
  misc_feature 1..171: note = hyper
  source 1..171: mol_type = genomic DNA
ttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgc

SEQ ID NO: 54086 - DNA, 77 bp, Homo sapiens; identical to SEQ ID NO: 33381
  misc_feature 1..77: note = chr10:118033917-118033994
  misc_feature 1..77: note = hyper
  source 1..77: mol_type = genomic DNA

SEQ ID NO: 54087 - DNA, 67 bp, Homo sapiens
  misc_feature 1..67: note = chr10:118890913-118890980
  misc_feature 1..67: note = hyper
  source 1..67: mol_type = genomic DNA
tgaactgtctgtgggcggctgctgtgatctcagcaaaaagcggagctcaaggctcagggactccgcc

SEQ ID NO: 54088 - DNA, 22 bp, Homo sapiens
  misc_feature 1..22: note = chr10:118893559-118893581
  misc_feature 1..22: note = hyper
  source 1..22: mol_type = genomic DNA
tccgggagtaaggctcgaaggc

SEQ ID NO: 54089 - DNA, 23 bp, Homo sapiens
  misc_feature 1..23: note = chr10:118894477-118894500
  misc_feature 1..23: note = hyper
  source 1..23: mol_type = genomic DNA
ggaatttccggtggagggtgtga

SEQ ID NO: 54090 - DNA, 452 bp, Homo sapiens
  misc_feature 1..452: note = chr10:118896177-118896629
  misc_feature 1..452: note = hyper
  source 1..452: mol_type = genomic DNA
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaag

SEQ ID NO: 54091 - DNA, 30 bp, Homo sapiens; identical to SEQ ID NO: 10543
  misc_feature 1..30: note = chr10:118897545-118897575
  misc_feature 1..30: note = hyper
  source 1..30: mol_type = genomic DNA

SEQ ID NO: 54092 - DNA, 27 bp, Homo sapiens
  misc_feature 1..27: note = chr10:118897820-118897847
  misc_feature 1..27: note = hyper
  source 1..27: mol_type = genomic DNA
ctggtggagctgcggcgaggccgcctc

SEQ ID NO: 54093 - DNA, 65 bp, Homo sapiens
  misc_feature 1..65: note = chr10:118897848-118897913
  misc_feature 1..65: note = hyper
  source 1..65: mol_type = genomic DNA
tcagcacccgcgtcctctgagcacgtccagtgtccccagcctggcgatcaggtagcgaacagcgc

SEQ ID NO: 54094 - DNA, 187 bp, Homo sapiens; identical to SEQ ID NO: 20815
  misc_feature 1..187: note = chr10:118897968-118898155
  misc_feature 1..187: note = hyper
  source 1..187: mol_type = genomic DNA

SEQ ID NO: 54095 - DNA, 174 bp, Homo sapiens; identical to SEQ ID NO: 33397
  misc_feature 1..174: note = chr10:118898864-118899038
  misc_feature 1..174: note = hyper
  source 1..174: mol_type = genomic DNA

SEQ ID NO: 54096 - DNA, 16 bp, Homo sapiens
  misc_feature 1..16: note = chr10:118899302-118899318
  misc_feature 1..16: note = hyper
  source 1..16: mol_type = genomic DNA
ccgcacctcccgcccc

SEQ ID NO: 54097 - DNA, 209 bp, Homo sapiens; identical to SEQ ID NO: 20816
  misc_feature 1..209: note = chr10:118899957-118900166
  misc_feature 1..209: note = hyper
  source 1..209: mol_type = genomic DNA

SEQ ID NO: 54098 - DNA, 513 bp, Homo sapiens
  misc_feature 1..513: note = chr10:118922208-118922721
  misc_feature 1..513: note = hyper
  source 1..513: mol_type = genomic DNA
tctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtccccgtgccccctccgggaggtgggagtcgccgggactctgcgctccgccagcctccgtctgctggccgggtccgggatccgcacccggagaggctgaaccgaggctgaaccgaggcggacgcagccccgggtcggtggctcgcctggccgggtggggtgg

SEQ ID NO: 54099 - DNA, 89 bp, Homo sapiens
  misc_feature 1..89: note = chr10:118923049-118923138
  misc_feature 1..89: note = hyper
  source 1..89: mol_type = genomic DNA
cgacggctggggacgcggagaaccctctccgagctggggtccccgcctgctgggcaacctcacctcaacgtctggcctggcctggggcc

SEQ ID NO: 54100 - DNA, 316 bp, Homo sapiens
  misc_feature 1..316: note = chr10:118923259-118923575
  misc_feature 1..316: note = hyper
  source 1..316: mol_type = genomic DNA
ggacagcccaagctgtcccgcccgctgcgcccgaggagcatccccttggcgctgcaggctgtcgcctcccccagcacctggcggggcgggtgccaggctgggcctctagacggtttcaccgctgcttatcatttctccttcattttgcaggggcaggggagctgcccctcccttcggagaaaggccgcgcctgcacccaaaggtaaccctcgggtgaccccgggagcggggctgtctggccttggtgcgagaccccgggcggggggtcagaggtttctgttgcatcagagaaacacggcagcgtcaaaaagaaaaa

SEQ ID NO: 54101 - DNA, 173 bp, Homo sapiens; identical to SEQ ID NO: 20820
  misc_feature 1..173: note = chr10:118924431-118924604
  misc_feature 1..173: note = hyper
  source 1..173: mol_type = genomic DNA

SEQ ID NO: 54102 - DNA, 1162 bp, Homo sapiens
  misc_feature 1..1162: note = chr10:118924896-118926058
  misc_feature 1..1162: note = hyper
  source 1..1162: mol_type = genomic DNA
agaaggttcagccccccttctcatccctgtactttggggatggctcgtacttggacaggggtgggcctccgccttctccgccttctatcggacctttcttcggatggatttctacgtaaactcggaaggcgatcaaatgcaggcggccaacctccagcgcttttttttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagattttttctcctttcctggctacacgcctaacagagaagctatcccgagggacctcaagaagtccccccaagccgtactcaaaagcctttctccctcctcctcaagcgctcacttccccaaagaggacccggacccctgactgcctgagccaggtccccagcatggtccgcaacccttctcgactccggcatccacctccaggctgacgtctacccgggagggggctggggacccaaggagacttcgactacaggcccaggcgaacggaaggaagaggcttgcgttcagagagacacgtttggagctgggactgttcattctttaaggaacaccagcttccagggcatctttcgttggcaccttggctttccagagaagaaaggaagtgggtatcagggccagcccctcctcgcaccccaggctggagaggtgccgaggtgcttagtcactcagtccaagggcacctgagagatgggggcaaacttggcaggagcttgagcacggaggcgtgatccgcggggg

SEQ ID NO: 54103 - DNA, 80 bp, Homo sapiens
  misc_feature 1..80: note = chr10:118927006-118927086
  misc_feature 1..80: note = hyper
  source 1..80: mol_type = genomic DNA
agagagccaagctctcgcccttcggtttccattcacgctaccctctctgagccgcaattctctctcctgcgttggcactg

SEQ ID NO: 54104 - DNA, 267 bp, Homo sapiens; identical to SEQ ID NO: 20824
  misc_feature 1..267: note = chr10:118927296-118927563
  misc_feature 1..267: note = hyper
  source 1..267: mol_type = genomic DNA

SEQ ID NO: 54105 - DNA, 40 bp, Homo sapiens; identical to SEQ ID NO: 33405
  misc_feature 1..40: note = chr10:118927999-118928039
  misc_feature 1..40: note = hyper
  source 1..40: mol_type = genomic DNA

SEQ ID NO: 54106 - DNA, 160 bp, Homo sapiens; identical to SEQ ID NO: 33406
  misc_feature 1..160: note = chr10:118928364-118928524
  misc_feature 1..160: note = hyper
  source 1..160: mol_type = genomic DNA

SEQ ID NO: 54107 - DNA, 113 bp, Homo sapiens; identical to SEQ ID NO: 10555
  misc_feature 1..113: note = chr10:119000479-119000592
  misc_feature 1..113: note = hyper
  source 1..113: mol_type = genomic DNA

SEQ ID NO: 54108 - DNA, 200 bp, Homo sapiens; identical to SEQ ID NO: 3656
  misc_feature 1..200: note = chr10:119001328-119001528
  misc_feature 1..200: note = hyper
  source 1..200: mol_type = genomic DNA

SEQ ID NO: 54109 - DNA, 386 bp, Homo sapiens
  misc_feature 1..386: note = chr10:119294461-119294847
  misc_feature 1..386: note = hyper
  source 1..386: mol_type = genomic DNA
cttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggac

SEQ ID NO: 54110 - DNA, 596 bp, Homo sapiens
  misc_feature 1..596: note = chr10:119296788-119297384
  misc_feature 1..596: note = hyper
  source 1..596: mol_type = genomic DNA
atctgagagagtcgcaccccgggaccccagctcttcctactccaccccaggcagggcccgcgcaggccgtccaaggcctgttctctgaaccacctgggttgggccgcgaaatatgggacctcaggcatggaattgtggctgcacaggtgatcacggcttcctagtccttcttagagcagaacctgtcccactccagcccacctctgcgcccccttcggaaggaagcctactggagctggaattccagcgtgggtggcgaactctcaagccaagagctggagctgatggaggcaggagggacgcacttccaagccatccgggctcctccgtagccagtgagcctcctttaacccctccactggcctggatgacggcctaggcgagactttggcagtgtggcgcgaccccagcgctcccccgccctcgggctcgggggcgcggtgggtaccgcgcccgcgcccggccctcgccactaggcgccgctgcgctcacgccgatcggggccccgggtcgccgcgcccgcctggcgagaggcctctggggaagacgccagaaagggatttgtcgtaataatttttaaaaaatgtttttagggc

SEQ ID NO: 54111 - DNA, 159 bp, Homo sapiens
  misc_feature 1..159: note = chr10:119297529-119297688
  misc_feature 1..159: note = hyper
  source 1..159: mol_type = genomic DNA
aagggctcgcccttcacgggcgtcggtgcggtccgcggcgagccgcgggagcacagggcgggctcagcattctggttcaacgtgaggaccagaacctcggcgatcagggaccaggacgtggcagagtgcagcgggtagcttcgacggcacaaggccatg

SEQ ID NO: 54112 - DNA, 442 bp, Homo sapiens
  misc_feature 1..442: note = chr10:119300923-119301365
  misc_feature 1..442: note = hyper
  source 1..442: mol_type = genomic DNA
tgatcataattatgccgccgcgcgagccaatggggacgagggaactcggtcctaaaatcatcccaaaaccgaaggcgagctcgaaaatgcggacacggcccgggaccggagatgcgatccgtagtcgttagttgcactgggtttgcacagcaaccaccacccccccaccaaccccgggacaacagatggcataataataataatagaaataataataataaaataatatcatctataataataataacattgaccacactgacaaaaataattacgacggaaccttaatagtacagtagcaccatatcgggctctcccctgaccttggactgccggtcccagatattccagaaggaattgttttggggaaggaggtgagcaccctcccagacagaaaacgctagagaccgtggggcgagagagggagagagttggaagccca

SEQ ID NO: 54113 - DNA, 96 bp, Homo sapiens; identical to SEQ ID NO: 33414
  misc_feature 1..96: note = chr10:119301759-119301855
  misc_feature 1..96: note = hyper
  source 1..96: mol_type = genomic DNA

SEQ ID NO: 54114 - DNA, 32 bp, Homo sapiens; identical to SEQ ID NO: 33415
  misc_feature 1..32: note = chr10:119301915-119301947
  misc_feature 1..32: note = hyper
  source 1..32: mol_type = genomic DNA

SEQ ID NO: 54115 - DNA, 86 bp, Homo sapiens
  misc_feature 1..86: note = chr10:119302876-119302962
  misc_feature 1..86: note = hyper
  source 1..86: mol_type = genomic DNA
cgcggcactcagctacgctaactccagccccataaatccgttcctcaacggcttccactcggccgccgccgccgccgccggtaggg

SEQ ID NO: 54116 - DNA, 409 bp, Homo sapiens; identical to SEQ ID NO: 10566
  misc_feature 1..409: note = chr10:119303312-119303721
  misc_feature 1..409: note = hyper
  source 1..409: mol_type = genomic DNA

SEQ ID NO: 54117 - DNA, 30 bp, Homo sapiens; identical to SEQ ID NO: 33418
  misc_feature 1..30: note = chr10:119304074-119304104
  misc_feature 1..30: note = hyper
  source 1..30: mol_type = genomic DNA

SEQ ID NO: 54118 - DNA, 40 bp, Homo sapiens; identical to SEQ ID NO: 33419
  misc_feature 1..40: note = chr10:119304439-119304479
  misc_feature 1..40: note = hyper
  source 1..40: mol_type = genomic DNA

SEQ ID NO: 54119 - DNA, 40 bp, Homo sapiens; identical to SEQ ID NO: 33420
  misc_feature 1..40: note = chr10:119304501-119304541
  misc_feature 1..40: note = hyper
  source 1..40: mol_type = genomic DNA

SEQ ID NO: 54120 - DNA, 41 bp, Homo sapiens; identical to SEQ ID NO: 33421
  misc_feature 1..41: note = chr10:119304788-119304829
  misc_feature 1..41: note = hyper
  source 1..41: mol_type = genomic DNA

SEQ ID NO: 54121 - DNA, 46 bp, Homo sapiens
  misc_feature 1..46: note = chr10:119304850-119304896
  misc_feature 1..46: note = hyper
  source 1..46: mol_type = genomic DNA
cgcggcgccagggcggctgcggagccggccgaggtcaggagcctgg

SEQ ID NO: 54122 - DNA, 17 bp, Homo sapiens
  misc_feature 1..17: note = chr10:119307052-119307069
  misc_feature 1..17: note = hyper
  source 1..17: mol_type = genomic DNA
cccgccacgaagaggag

SEQ ID NO: 54123 - DNA, 71 bp, Homo sapiens; identical to SEQ ID NO: 33425
  misc_feature 1..71: note = chr10:119311647-119311718
  misc_feature 1..71: note = hyper
  source 1..71: mol_type = genomic DNA

SEQ ID NO: 54124 - DNA, 30 bp, Homo sapiens; identical to SEQ ID NO: 33426
  misc_feature 1..30: note = chr10:119312507-119312537
  misc_feature 1..30: note = hyper
  source 1..30: mol_type = genomic DNA

SEQ ID NO: 54125 - DNA, 164 bp, Homo sapiens; identical to SEQ ID NO: 33428
  misc_feature 1..164: note = chr10:119313340-119313504
  misc_feature 1..164: note = hyper
  source 1..164: mol_type = genomic DNA

SEQ ID NO: 54126 - DNA, 15 bp, Homo sapiens
  misc_feature 1..15: note = chr10:119313528-119313543
  misc_feature 1..15: note = hyper
  source 1..15: mol_type = genomic DNA
cgagttcattagtcg

SEQ ID NO: 54127 - DNA, 42 bp, Homo sapiens; identical to SEQ ID NO: 33430
  misc_feature 1..42: note = chr10:119494127-119494169
  misc_feature 1..42: note = hyper
  source 1..42: mol_type = genomic DNA

SEQ ID NO: 54128 - DNA, 69 bp, Homo sapiens; identical to SEQ ID NO: 33431
  misc_feature 1..69: note = chr10:119494374-119494443
  misc_feature 1..69: note = hyper
  source 1..69: mol_type = genomic DNA

SEQ ID NO: 54129 - DNA, 208 bp, Homo sapiens; identical to SEQ ID NO: 33432
  misc_feature 1..208: note = chr10:119494848-119495056
  misc_feature 1..208: note = hyper
  source 1..208: mol_type = genomic DNA

SEQ ID NO: 54130 - DNA, 412 bp, Homo sapiens
  misc_feature 1..412: note = chr10:120353831-120354243
  misc_feature 1..412: note = hyper
  source 1..412: mol_type = genomic DNA
cgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcga

SEQ ID NO: 54131 - DNA, 45 bp, Homo sapiens
  misc_feature 1..45: note = chr10:120354273-120354318
  misc_feature 1..45: note = hyper
  source 1..45: mol_type = genomic DNA
gacgtagcggtccactgcgatggtggtgagcgtgaacaccgacac

SEQ ID NO: 54132 - DNA, 166 bp, Homo sapiens; identical to SEQ ID NO: 33434
  misc_feature 1..166: note = chr10:120355260-120355426
  misc_feature 1..166: note = hyper
  source 1..166: mol_type = genomic DNA

SEQ ID NO: 54133 - DNA, 87 bp, Homo sapiens
  misc_feature 1..87: note = chr10:120355461-120355548
  misc_feature 1..87: note = hyper
  source 1..87: mol_type = genomic DNA
cgtcaggctatcgggaggagccggtgcagtcttaggagggaaggagcggggaaggaagtagcggtgggagattgcaatgcagctggg

SEQ ID NO: 54134 - DNA, 299 bp, Homo sapiens; identical to SEQ ID NO: 33436
  misc_feature 1..299: note = chr10:121301494-121301793
  misc_feature 1..299: note = hyper
  source 1..299: mol_type = genomic DNA

SEQ ID NO: 54135 - DNA, 166 bp, Homo sapiens; identical to SEQ ID NO: 33437
  misc_feature 1..166: note = chr10:122216112-122216278
  misc_feature 1..166: note = hyper
  source 1..166: mol_type = genomic DNA

SEQ ID NO: 54136 - DNA, 272 bp, Homo sapiens; identical to SEQ ID NO: 33438
  misc_feature 1..272: note = chr10:122216485-122216757
  misc_feature 1..272: note = hyper
  source 1..272: mol_type = genomic DNA

SEQ ID NO: 54137 - DNA, 42 bp, Homo sapiens; identical to SEQ ID NO: 10578
  misc_feature 1..42: note = chr10:122216793-122216835
  misc_feature 1..42: note = hyper
  source 1..42: mol_type = genomic DNA

SEQ ID NO: 54138 - DNA, 298 bp, Homo sapiens
  misc_feature 1..298: note = chr10:122217083-122217381
  misc_feature 1..298: note = hyper
  source 1..298: mol_type = genomic DNA
gcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttc

SEQ ID NO: 54139 - DNA, 23 bp, Homo sapiens
  misc_feature 1..23: note = chr10:122708691-122708714
  misc_feature 1..23: note = hyper
  source 1..23: mol_type = genomic DNA
agggaccgcggggctctctgcct

SEQ ID NO: 54140 - DNA, 352 bp, Homo sapiens; identical to SEQ ID NO: 33442
  misc_feature 1..352: note = chr10:122738898-122739250
  misc_feature 1..352: note = hyper
  source 1..352: mol_type = genomic DNA

SEQ ID NO: 54141 - DNA, 118 bp, Homo sapiens; identical to SEQ ID NO: 33443
  misc_feature 1..118: note = chr10:123356872-123356990
  misc_feature 1..118: note = hyper
  source 1..118: mol_type = genomic DNA

SEQ ID NO: 54142 - DNA, 30 bp, Homo sapiens; identical to SEQ ID NO: 33444
  misc_feature 1..30: note = chr10:123358301-123358331
  misc_feature 1..30: note = hyper
  source 1..30: mol_type = genomic DNA

SEQ ID NO: 54143 - DNA, 34 bp, Homo sapiens; identical to SEQ ID NO: 33445
  misc_feature 1..34: note = chr10:123873006-123873040
  misc_feature 1..34: note = hyper
  source 1..34: mol_type = genomic DNA

SEQ ID NO: 54144 - DNA, 29 bp, Homo sapiens
  misc_feature 1..29: note = chr10:123923517-123923546
  misc_feature 1..29: note = hyper
  source 1..29: mol_type = genomic DNA
cgcccgggccgccccgagtctcccgggga

SEQ ID NO: 54145 - DNA, 46 bp, Homo sapiens; identical to SEQ ID NO: 33448
  misc_feature 1..46: note = chr10:124221003-124221049
  misc_feature 1..46: note = hyper
  source 1..46: mol_type = genomic DNA

SEQ ID NO: 54146 - DNA, 206 bp, Homo sapiens; identical to SEQ ID NO: 33449
  misc_feature 1..206: note = chr10:124221715-124221921
  misc_feature 1..206: note = hyper
  source 1..206: mol_type = genomic DNA

SEQ ID NO: 54147 - DNA, 327 bp, Homo sapiens; identical to SEQ ID NO: 33450
  misc_feature 1..327: note = chr10:124639199-124639526
  misc_feature 1..327: note = hyper
  source 1..327: mol_type = genomic DNA

SEQ ID NO: 54148 - DNA, 30 bp, Homo sapiens; identical to SEQ ID NO: 33451
  misc_feature 1..30: note = chr10:124892329-124892359
  misc_feature 1..30: note = hyper
  source 1..30: mol_type = genomic DNA

SEQ ID NO: 54149 - DNA, 73 bp, Homo sapiens; identical to SEQ ID NO: 33452
  misc_feature 1..73: note = chr10:124892950-124893023
  misc_feature 1..73: note = hyper
  source 1..73: mol_type = genomic DNA

SEQ ID NO: 54150 - DNA, 43 bp, Homo sapiens
  misc_feature 1..43: note = chr10:124893350-124893393
  misc_feature 1..43: note = hyper
  source 1..43: mol_type = genomic DNA
gacctctgggtatccagcagcgattgggcgacctaggcccagt

SEQ ID NO: 54151 - DNA, 41 bp, Homo sapiens; identical to SEQ ID NO: 20844
  misc_feature 1..41: note = chr10:124893594-124893635
  misc_feature 1..41: note = hyper
  source 1..41: mol_type = genomic DNA

SEQ ID NO: 54152 - DNA, 200 bp, Homo sapiens; identical to SEQ ID NO: 20845
  misc_feature 1..200: note = chr10:124893765-124893965
  misc_feature 1..200: note = hyper
  source 1..200: mol_type = genomic DNA

SEQ ID NO: 54153 - DNA, 128 bp, Homo sapiens; identical to SEQ ID NO: 20846
  misc_feature 1..128: note = chr10:124894479-124894607
  misc_feature 1..128: note = hyper
  source 1..128: mol_type = genomic DNA

SEQ ID NO: 54154 - DNA, 19 bp, Homo sapiens
  misc_feature 1..19: note = chr10:124894870-124894889
  misc_feature 1..19: note = hyper
  source 1..19: mol_type = genomic DNA
gggctcgcggccgttagtg

SEQ ID NO: 54155 - DNA, 504 bp, Homo sapiens
  misc_feature 1..504: note = chr10:124894922-124895426
  misc_feature 1..504: note = hyper
  source 1..504: mol_type = genomic DNA
cctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttgg

SEQ ID NO: 54156 - DNA, 77 bp, Homo sapiens
  misc_feature 1..77: note = chr10:124896456-124896533
  misc_feature 1..77: note = hyper
  source 1..77: mol_type = genomic DNA
ctcatggcctgggacctggaggccggcgcgggttgagcctgccgtccccaggcgccgggcctcgctcaaggctgtgt

SEQ ID NO: 54157 - DNA, 283 bp, Homo sapiens
  misc_feature 1..283: note = chr10:124896937-124897220
  misc_feature 1..283: note = hyper
  source 1..283: mol_type = genomic DNA
ggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctct

SEQ ID NO: 54158 - DNA, 33 bp, Homo sapiens; identical to SEQ ID NO: 20849
  misc_feature 1..33: note = chr10:124899116-124899149
  misc_feature 1..33: note = hyper
  source 1..33: mol_type = genomic DNA

SEQ ID NO: 54159 - DNA, 83 bp, Homo sapiens
  misc_feature 1..83: note = chr10:124899671-124899754
  misc_feature 1..83: note = hyper
  source 1..83: mol_type = genomic DNA
ttctctttcccctggcgcccaacacctcctgggcggcatctctagatccccgaccctgtcctggcagacgccgagaagcgtag

SEQ ID NO: 54160 - DNA, 132 bp, Homo sapiens
  misc_feature 1..132: note = chr10:124899786-124899918
  misc_feature 1..132: note = hyper
  source 1..132: mol_type = genomic DNA
ggccgccgcgctcttagtgagcagcctgcggaggcacagcgcgccggaaccgcctggaagggtgggtccgcccgacagaagcaggtgcctgggcgacactcgctggccgggtgtggccgcctgcctttaagc

SEQ ID NO: 54161 - DNA, 30 bp, Homo sapiens; identical to SEQ ID NO: 33461
  misc_feature 1..30: note = chr10:124901599-124901629
  misc_feature 1..30: note = hyper
  source 1..30: mol_type = genomic DNA

SEQ ID NO: 54162 - DNA, 90 bp, Homo sapiens
  misc_feature 1..90: note = chr10:124903238-124903328
  misc_feature 1..90: note = hyper
  source 1..90: mol_type = genomic DNA
atccctttgggtttaggcctgggagaggtatagagccagcgagagagcgcgttgcgcctatcactgaggcaggagcggtgaggtggagtc

SEQ ID NO: 54163 - DNA, 30 bp, Homo sapiens; identical to SEQ ID NO: 33465
  misc_feature 1..30: note = chr10:124904318-124904348
  misc_feature 1..30: note = hyper
  source 1..30: mol_type = genomic DNA

SEQ ID NO: 54164 - DNA, 326 bp, Homo sapiens
  misc_feature 1..326: note = chr10:124904595-124904921
  misc_feature 1..326: note = hyper
  source 1..326: mol_type = genomic DNA
tatgctagaaaggggcggcaaggaaggttgtttcttgtccctcccgtccttgcggtgtgacggctataggtgctggaggggcgggaggtccctcgggctatcaatcgaggggagctcaggggaactgcagtcagtcaggctgcagagctgggtctccaccacagccttccttgccccagccccgtgcccaccaccatctcttccctggtaaagtgcacgcactagtaggagctcagtgaacgtttgctgaatgaatgtgtgagtgtgcgcaggcgtttatgcaagtgccttcatgcgaattaatgcgtcctttgccgggtgtggca

SEQ ID NO: 54165 - DNA, 58 bp, Homo sapiens
  misc_feature 1..58: note = chr10:124905119-124905177
  misc_feature 1..58: note = hyper
  source 1..58: mol_type = genomic DNA
tcactgtttcagggcctgggagttgcttttccgaggcccacttcgaggtcccctgatc

SEQ ID NO: 54166 - DNA, 30 bp, Homo sapiens; identical to SEQ ID NO: 33467
  misc_feature 1..30: note = chr10:124905596-124905626
  misc_feature 1..30: note = hyper
  source 1..30: mol_type = genomic DNA

SEQ ID NO: 54167 - DNA, 15 bp, Homo sapiens
  misc_feature 1..15: note = chr10:124905865-124905880
  misc_feature 1..15: note = hyper
  source 1..15: mol_type = genomic DNA
atttgtaatgtgtct

SEQ ID NO: 54168 - DNA, 115 bp, Homo sapiens; identical to SEQ ID NO: 33470
  misc_feature 1..115: note = chr10:124906829-124906944
  misc_feature 1..115: note = hyper
  source 1..115: mol_type = genomic DNA

SEQ ID NO: 54169 - DNA, 44 bp, Homo sapiens
  misc_feature 1..44: note = chr10:124907268-124907312
  misc_feature 1..44: note = hyper
  source 1..44: mol_type = genomic DNA
caagcccctgggaggcgcggagacccgtcgcctgcggaggcgtc

SEQ ID NO: 54170 - DNA, 557 bp, Homo sapiens
  misc_feature 1..557: note = chr10:124907534-124908091
  misc_feature 1..557: note = hyper
  source 1..557: mol_type = genomic DNA
ttttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgctt

SEQ ID NO: 54171 - DNA, 174 bp, Homo sapiens; identical to SEQ ID NO: 20855
  misc_feature 1..174: note = chr10:124908121-124908295
  misc_feature 1..174: note = hyper
  source 1..174: mol_type = genomic DNA

SEQ ID NO: 54172 - DNA, 182 bp, Homo sapiens
  misc_feature 1..182: note = chr10:124908904-124909086
  misc_feature 1..182: note = hyper
  source 1..182: mol_type = genomic DNA
gtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcagg

SEQ ID NO: 54173 - DNA, 175 bp, Homo sapiens
  misc_feature 1..175: note = chr10:124911048-124911223
  misc_feature 1..175: note = hyper
  source 1..175: mol_type = genomic DNA
aattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggcc

SEQ ID NO: 54174 - DNA, 65 bp, Homo sapiens
  misc_feature 1..65: note = chr10:125425547-125425612
  misc_feature 1..65: note = hyper
  source 1..65: mol_type = genomic DNA
agcgggaggaagcagaggcagaggcggagcaggggcgcaggtgcctgcaacccaggatcccgggg

SEQ ID NO: 54175 - DNA, 259 bp, Homo sapiens; identical to SEQ ID NO: 33477
  misc_feature 1..259: note = chr10:125425689-125425948
  misc_feature 1..259: note = hyper
  source 1..259: mol_type = genomic DNA

SEQ ID NO: 54176 - DNA, 117 bp, Homo sapiens
  misc_feature 1..117: note = chr10:125650749-125650866
  misc_feature 1..117: note = hyper
  source 1..117: mol_type = genomic DNA
caacagggagattcccgggactggcccatcccagacacacacaatgggagaagccagttgtcccctggaggcgcgcaaccaccggcgccccctcgggctgcccagcgcagaaagttc

SEQ ID NO: 54177 - DNA, 88 bp, Homo sapiens; identical to SEQ ID NO: 3676
  misc_feature 1..88: note = chr10:125651372-125651460
  misc_feature 1..88: note = hyper
  source 1..88: mol_type = genomic DNA

SEQ ID NO: 54178 - DNA, 30 bp, Homo sapiens; identical to SEQ ID NO: 33480
  misc_feature 1..30: note = chr10:125732174-125732204
  misc_feature 1..30: note = hyper
  source 1..30: mol_type = genomic DNA

SEQ ID NO: 54179 - DNA, 163 bp, Homo sapiens
  misc_feature 1..163: note = chr10:125851165-125851328
  misc_feature 1..163: note = hyper
  source 1..163: mol_type = genomic DNA
gccacacttcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaaga

SEQ ID NO: 54180 - DNA, 104 bp, Homo sapiens
  misc_feature 1..104: note = chr10:125852195-125852299
  misc_feature 1..104: note = hyper
  source 1..104: mol_type = genomic DNA
ccggggagagagtggcggatgcccacttacctgccccgggccgcgcctggaaacttccccaaagtgcgataggggtgtgggggcggagcgcaaggctgggggga

SEQ ID NO: 54181 - DNA, 213 bp, Homo sapiens
  misc_feature 1..213: note = chr10:125852540-125852753
  misc_feature 1..213: note = hyper
  source 1..213: mol_type = genomic DNA
cggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtc

SEQ ID NO: 54182 - DNA, 140 bp, Homo sapiens; identical to SEQ ID NO: 33484
  misc_feature 1..140: note = chr10:125853707-125853847
  misc_feature 1..140: note = hyper
  source 1..140: mol_type = genomic DNA

SEQ ID NO: 54183 - DNA, 15 bp, Homo sapiens
  misc_feature 1..15: note = chr10:126135816-126135831
  misc_feature 1..15: note = hyper
  source 1..15: mol_type = genomic DNA
ggacactttgaagga

SEQ ID NO: 54184 - DNA, 50 bp, Homo sapiens; identical to SEQ ID NO: 20859
  misc_feature 1..50: note = chr10:126135877-126135927
  misc_feature 1..50: note = hyper
  source 1..50: mol_type = genomic DNA

SEQ ID NO: 54185 - DNA, 441 bp, Homo sapiens
  misc_feature 1..441: note = chr10:126136065-126136506
  misc_feature 1..441: note = hyper
  source 1..441: mol_type = genomic DNA
gggcggcagccgtcagcgggaaggaggcggcggacgggaagaggacattggccgcggagtaggaggggaaagtctggaagtgcagagcgccggtgccgggagggccaggactgccccccgagccgccgccgccgccgccccccgccgcccctggctggggcgcgccaccccccacctgcgccgcgccgtcggcacccgggttctgcttcttccacttggtcctgcgattctggaaccagattttgacctgcgtctcggtgaggctgagagacagcgcgaggttcaggcgctcgcacactgacaggtagcgcgtggcccggaacttgttctccaaggccaccagctgctcgtaggtgaaggcggtgcgcgcgcgccgcggcttggcgcagttgggctccaggcgccggcgcctgggacgcggggagccgggggatcccgggg

SEQ ID NO: 54186 - DNA, 1466 bp, Homo sapiens; identical to SEQ ID NO: 33488
  misc_feature 1..1466: note = chr10:126137640-126139106
  misc_feature 1..1466: note = hyper
  source 1..1466: mol_type = genomic DNA

SEQ ID NO: 54187 - DNA, 338 bp, Homo sapiens; identical to SEQ ID NO: 33489
  misc_feature 1..338: note = chr10:128075686-128076024
  misc_feature 1..338: note = hyper
  source 1..338: mol_type = genomic DNA

SEQ ID NO: 54188 - DNA, 214 bp, Homo sapiens
  misc_feature 1..214: note = chr10:128076347-128076561
  misc_feature 1..214: note = hyper
  source 1..214: mol_type = genomic DNA
ccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcg

SEQ ID NO: 54189 - DNA, 301 bp, Homo sapiens; identical to SEQ ID NO: 33491
  misc_feature 1..301: note = chr10:128076940-128077241
  misc_feature 1..301: note = hyper
  source 1..301: mol_type = genomic DNA

SEQ ID NO: 54190 - DNA, 32 bp, Homo sapiens; identical to SEQ ID NO: 33492
  misc_feature 1..32: note = chr10:128993490-128993522
  misc_feature 1..32: note = hyper
  source 1..32: mol_type = genomic DNA

SEQ ID NO: 54191 - DNA, 147 bp, Homo sapiens; identical to SEQ ID NO: 33493
  misc_feature 1..147: note = chr10:128993580-128993727
  misc_feature 1..147: note = hyper
  source 1..147: mol_type = genomic DNA

SEQ ID NO: 54192 - DNA, 31 bp, Homo sapiens
  misc_feature 1..31: note = chr10:129535733-129535764
  misc_feature 1..31: note = hyper
  source 1..31: mol_type = genomic DNA
cgagctacggggctcccggcccgctcctcgg

SEQ ID NO: 54193 - DNA, 40 bp, Homo sapiens
  misc_feature 1..40: note = chr10:129536040-129536080
  misc_feature 1..40: note = hyper
  source 1..40: mol_type = genomic DNA
cgacccaggtaacagcggcgcgccggctcgctccgtccag

SEQ ID NO: 54194 - DNA, 126 bp, Homo sapiens
  misc_feature 1..126: note = chr10:129947985-129948111
  misc_feature 1..126: note = hyper
  source 1..126: mol_type = genomic DNA
ggatcaggtcaccttcgcaggcccagactccaccgtcagctgccgccgacggagcccacagaggaggctcgggcgcccgcgccccctgcgcagcggcccctccgcagcggccccagcccgcgtccc

SEQ ID NO: 54195 - DNA, 42 bp, Homo sapiens
  misc_feature 1..42: note = chr10:129948140-129948182
  misc_feature 1..42: note = hyper
  source 1..42: mol_type = genomic DNA
gaagcgcccacagcccgcgttcccgcccgcaccccagcccgc

SEQ ID NO: 54196 - DNA, 30 bp, Homo sapiens; identical to SEQ ID NO: 33501
  misc_feature 1..30: note = chr10:129948725-129948755
  misc_feature 1..30: note = hyper
  source 1..30: mol_type = genomic DNA

SEQ ID NO: 54197 - DNA, 379 bp, Homo sapiens; identical to SEQ ID NO: 33502
  misc_feature 1..379: note = chr10:130008498-130008877
  misc_feature 1..379: note = hyper
  source 1..379: mol_type = genomic DNA

SEQ ID NO: 54198 - DNA, 283 bp, Homo sapiens; identical to SEQ ID NO: 33503
  misc_feature 1..283: note = chr10:130008906-130009189
  misc_feature 1..283: note = hyper
  source 1..283: mol_type = genomic DNA

SEQ ID NO: 54199 - DNA, 150 bp, Homo sapiens; identical to SEQ ID NO: 33504
  misc_feature 1..150: note = chr10:130085049-130085199
  misc_feature 1..150: note = hyper
  source 1..150: mol_type = genomic DNA

SEQ ID NO: 54200 - DNA, 76 bp, Homo sapiens; identical to SEQ ID NO: 947
  misc_feature 1..76: note = chr10:130085200-130085276
  misc_feature 1..76: note = hyper
  source 1..76: mol_type = genomic DNA

SEQ ID NO: 54201 - DNA, 76 bp, Homo sapiens
  misc_feature 1..76: note = chr10:130085362-130085438
  misc_feature 1..76: note = hyper
  source 1..76: mol_type = genomic DNA
gtccccgggccgcggcgcgctccccgccacgccgcacatcaaggcccggccggccggcgggcgccttcattagcag

SEQ ID NO: 54202 - DNA, 30 bp, Homo sapiens; identical to SEQ ID NO: 33508
  misc_feature 1..30: note = chr10:130339387-130339417
  misc_feature 1..30: note = hyper
  source 1..30: mol_type = genomic DNA

SEQ ID NO: 54203 - DNA, 56 bp, Homo sapiens; identical to SEQ ID NO: 33509
  misc_feature 1..56: note = chr10:130339734-130339790
  misc_feature 1..56: note = hyper
  source 1..56: mol_type = genomic DNA

SEQ ID NO: 54204 - DNA, 30 bp, Homo sapiens; identical to SEQ ID NO: 33510
  misc_feature 1..30: note = chr10:130830055-130830085
  misc_feature 1..30: note = hyper
  source 1..30: mol_type = genomic DNA

SEQ ID NO: 54205 - DNA, 38 bp, Homo sapiens; identical to SEQ ID NO: 33511
  misc_feature 1..38: note = chr10:131265287-131265325
  misc_feature 1..38: note = hyper
  source 1..38: mol_type = genomic DNA

SEQ ID NO: 54206 - skipped

SEQ ID NO: 54207 - DNA, 136 bp, Homo sapiens; identical to SEQ ID NO: 33513
  misc_feature 1..136: note = chr10:131757717-131757853
  misc_feature 1..136: note = hyper
  source 1..136: mol_type = genomic DNA

SEQ ID NO: 54208 - DNA, 46 bp, Homo sapiens; identical to SEQ ID NO: 33514
  misc_feature 1..46: note = chr10:131758276-131758322
  misc_feature 1..46: note = hyper
  source 1..46: mol_type = genomic DNA

SEQ ID NO: 54209 - DNA, 244 bp, Homo sapiens
  misc_feature 1..244: note = chr10:131761134-131761378
  misc_feature 1..244: note = hyper
  source 1..244: mol_type = genomic DNA
atgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggatt

SEQ ID NO: 54210 - DNA, 246 bp, Homo sapiens
  misc_feature 1..246: note = chr10:131761441-131761687
  misc_feature 1..246: note = hyper
  source 1..246: mol_type = genomic DNA
gagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgccc

SEQ ID NO: 54211 - DNA, 362 bp, Homo sapiens
  misc_feature 1..362: note = chr10:131761725-131762087
  misc_feature 1..362: note = hyper
  source 1..362: mol_type = genomic DNA
tggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcg

SEQ ID NO: 54212 - DNA, 468 bp, Homo sapiens
  misc_feature 1..468: note = chr10:131762124-131762592
  misc_feature 1..468: note = hyper
  source 1..468: mol_type = genomic DNA
ccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagag

SEQ ID NO: 54213 - DNA, 273 bp, Homo sapiens
  misc_feature 1..273: note = chr10:131762631-131762904
  misc_feature 1..273: note = hyper
  source 1..273: mol_type = genomic DNA
cggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaa

SEQ ID NO: 54214 - DNA, 397 bp, Homo sapiens; identical to SEQ ID NO: 20878
  misc_feature 1..397: note = chr10:131762940-131763337
  misc_feature 1..397: note = hyper
  source 1..397: mol_type = genomic DNA

SEQ ID NO: 54215 - DNA, 207 bp, Homo sapiens
  misc_feature 1..207: note = chr10:131763717-131763924
  misc_feature 1..207: note = hyper
  source 1..207: mol_type = genomic DNA
ctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacc

SEQ ID NO: 54216 - DNA, 39 bp, Homo sapiens
  misc_feature 1..39: note = chr10:131768685-131768724
  misc_feature 1..39: note = hyper
  source 1..39: mol_type = genomic DNA
cttctggaagctaaccgcgcacaaaagtttgccaataaa

SEQ ID NO: 54217 - DNA, 105 bp, Homo sapiens
  misc_feature 1..105: note = chr10:131769428-131769533
  misc_feature 1..105: note = hyper
  source 1..105: mol_type = genomic DNA
tgctgggcggcaaggcggcccagggcatagctaggggccatgtagaaataaaaacagataaagaaaagaagaaagaaagaaaccggcttctcttctagactatta

SEQ ID NO: 54218 - DNA, 39 bp, Homo sapiens; identical to SEQ ID NO: 20880
  misc_feature 1..39: note = chr10:131770237-131770276
  misc_feature 1..39: note = hyper
  source 1..39: mol_type = genomic DNA

SEQ ID NO: 54219 - DNA, 54 bp, Homo sapiens; identical to SEQ ID NO: 20881
  misc_feature 1..54: note = chr10:131770603-131770657
  misc_feature 1..54: note = hyper
  source 1..54: mol_type = genomic DNA

SEQ ID NO: 54220 - DNA, 301 bp, Homo sapiens; identical to SEQ ID NO: 20882
  misc_feature 1..301: note = chr10:131770687-131770988
  misc_feature 1..301: note = hyper
  source 1..301: mol_type = genomic DNA

SEQ ID NO: 54221 - DNA, 21 bp, Homo sapiens
  misc_feature 1..21: note = chr10:131771281-131771302
  misc_feature 1..21: note = hyper
  source 1..21: mol_type = genomic DNA
gggagagcccacgggcccggc

SEQ ID NO: 54222 - DNA, 68 bp, Homo sapiens
  misc_feature 1..68: note = chr10:133109124-133109192
  misc_feature 1..68: note = hyper
  source 1..68: mol_type = genomic DNA
agctgaaacagctatcgatttccagcttgctttcaagtctggcagagactgtgaaagtcctaacttct

SEQ ID NO: 54223 - DNA, 121 bp, Homo sapiens; identical to SEQ ID NO: 3684
  misc_feature 1..121: note = chr10:133110064-133110185
  misc_feature 1..121: note = hyper
  source 1..121: mol_type = genomic DNA

SEQ ID NO: 54224 - DNA, 171 bp, Homo sapiens
  misc_feature 1..171: note = chr10:133110704-133110875
  misc_feature 1..171: note = hyper
  source 1..171: mol_type = genomic DNA
ggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgc

SEQ ID NO: 54225 - DNA, 156 bp, Homo sapiens
  misc_feature 1..156: note = chr10:133794727-133794883
  misc_feature 1..156: note = hyper
  source 1..156: mol_type = genomic DNA
gccatattttaaaaacgctgtaaccccctcccatctccgcgttcacccttgaggaaatcctaacagtcaccatggatataaacattaataacaaaattaaagctcataacaggccacttgccacgccttggtgtttggtcattaaaaccaatactg

SEQ ID NO: 54226 - DNA, 252 bp, Homo sapiens; identical to SEQ ID NO: 20886
  misc_feature 1..252: note = chr10:133795430-133795682
  misc_feature 1..252: note = hyper
  source 1..252: mol_type = genomic DNA

SEQ ID NO: 54227 - DNA, 127 bp, Homo sapiens; identical to SEQ ID NO: 20887
  misc_feature 1..127: note = chr10:133850008-133850135
  misc_feature 1..127: note = hyper
  source 1..127: mol_type = genomic DNA

SEQ ID NO: 54228 - DNA, 373 bp, Homo sapiens
  misc_feature 1..373: note = chr10:133850156-133850529
  misc_feature 1..373: note = hyper
  source 1..373: mol_type = genomic DNA
cggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctgcgtctggcacggtgcgtccgggacgcgggcgccctggcggccgtggggcgggcggggggcgacgtcccgagggagggggtcccgcggcagagacgcccctgtctggggcggggtcctccttgcctctcccggcggtccccccgtgggcgggtcctctccacggcaccccctgccctgcacaggcctcggcgctggcgtgacgcggccgctgggtggggcccgcgcaggtgctgggc

SEQ ID NO: 54229 - DNA, 65 bp, Homo sapiens
  misc_feature 1..65: note = chr10:133850774-133850839
  misc_feature 1..65: note = hyper
  source 1..65: mol_type = genomic DNA
ttgcctctcgtggaaagccgctgggagttggagcggctccctcctgcccccgtctgaggtctggc

SEQ ID NO: 54230 - DNA, 161 bp, Homo sapiens
  misc_feature 1..161: note = chr10:133999847-134000008
  misc_feature 1..161: note = hyper
  source 1..161: mol_type = genomic DNA
tctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagag

SEQ ID NO: 54231 - DNA, 57 bp, Homo sapiens; identical to SEQ ID NO: 33532
  misc_feature 1..57: note = chr10:134000125-134000182
  misc_feature 1..57: note = hyper
  source 1..57: mol_type = genomic DNA

SEQ ID NO: 54232 - DNA, 211 bp, Homo sapiens; identical to SEQ ID NO: 33533
  misc_feature 1..211: note = chr10:134000529-134000740
  misc_feature 1..211: note = hyper
  source 1..211: mol_type = genomic DNA

SEQ ID NO: 54233 - DNA, 99 bp, Homo sapiens; identical to SEQ ID NO: 33534
  misc_feature 1..99: note = chr10:134000798-134000897
  misc_feature 1..99: note = hyper
  source 1..99: mol_type = genomic DNA

SEQ ID NO: 54234 - DNA, 165 bp, Homo sapiens
  misc_feature 1..165: note = chr10:134001260-134001425
  misc_feature 1..165: note = hyper
  source 1..165: mol_type = genomic DNA
cccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatgg

SEQ ID NO: 54235 - DNA, 254 bp, Homo sapiens; identical to SEQ ID NO: 33536
  misc_feature 1..254: note = chr10:134120760-134121014
  misc_feature 1..254: note = hyper
  source 1..254: mol_type = genomic DNA

SEQ ID NO: 54236 - DNA, 42 bp, Homo sapiens; identical to SEQ ID NO: 33537
  misc_feature 1..42: note = chr10:134122233-134122275
  misc_feature 1..42: note = hyper
  source 1..42: mol_type = genomic DNA

SEQ ID NO: 54237 - DNA, 64 bp, Homo sapiens
  misc_feature 1..64: note = chr10:134599482-134599546
  misc_feature 1..64: note = hyper
  source 1..64: mol_type = genomic DNA
tccgggccccgccgccgccgcccctgcccgccggcccgggaagtttgcgcgcggcccgggcggg

SEQ ID NO: 54238 - DNA, 83 bp, Homo sapiens; identical to SEQ ID NO: 33541
  misc_feature 1..83: note = chr10:134599708-134599791
  misc_feature 1..83: note = hyper
  source 1..83: mol_type = genomic DNA

SEQ ID NO: 54239 - DNA, 30 bp, Homo sapiens; identical to SEQ ID NO: 33544
  misc_feature 1..30: note = chr10:134601246-134601276
  misc_feature 1..30: note = hyper
  source 1..30: mol_type = genomic DNA

SEQ ID NO: 54240 - DNA, 63 bp, Homo sapiens; identical to SEQ ID NO: 33546
  misc_feature 1..63: note = chr10:134602327-134602390
  misc_feature 1..63: note = hyper
  source 1..63: mol_type = genomic DNA

SEQ ID NO: 54241 - DNA, 85 bp, Homo sapiens; identical to SEQ ID NO: 33547
  misc_feature 1..85: note = chr10:134676528-134676613
  misc_feature 1..85: note = hyper
  source 1..85: mol_type = genomic DNA

SEQ ID NO: 54242 - DNA, 10 bp, Homo sapiens
  misc_feature 1..10: note = chr10:134901183-134901193
  misc_feature 1..10: note = hyper
  source 1..10: mol_type = genomic DNA
ggaataacac

SEQ ID NO: 54243 - DNA, 194 bp, Homo sapiens
  misc_feature 1..194: note = chr10:134901511-134901705
  misc_feature 1..194: note = hyper
  source 1..194: mol_type = genomic DNA
tgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaa

SEQ ID NO: 54244 - DNA, 66 bp, Homo sapiens
  misc_feature 1..66: note = chr10:134901942-134902008
  misc_feature 1..66: note = hyper
  source 1..66: mol_type = genomic DNA
ggttgagtttggctccggagccgggagtggggcgcagattgatttttaaatatggagaaggagacg

SEQ ID NO: 54245 - DNA, 61 bp, Homo sapiens; identical to SEQ ID NO: 33553
  misc_feature 1..61: note = chr10:134973919-134973980
  misc_feature 1..61: note = hyper
  source 1..61: mol_type = genomic DNA

SEQ ID NO: 54246 - DNA, 48 bp, Homo sapiens; identical to SEQ ID NO: 33554
  misc_feature 1..48: note = chr10:134974224-134974272
  misc_feature 1..48: note = hyper
  source 1..48: mol_type = genomic DNA

SEQ ID NO: 54247 - DNA, 96 bp, Homo sapiens; identical to SEQ ID NO: 33555
  misc_feature 1..96: note = chr10:134974307-134974403
  misc_feature 1..96: note = hyper
  source 1..96: mol_type = genomic DNA

SEQ ID NO: 54248 - DNA, 88 bp, Homo sapiens; identical to SEQ ID NO: 20901
  misc_feature 1..88: note = chr10:135043538-135043626
  misc_feature 1..88: note = hyper
  source 1..88: mol_type = genomic DNA

SEQ ID NO: 54249 - DNA, 142 bp, Homo sapiens; identical to SEQ ID NO: 20902
  misc_feature 1..142: note = chr10:135043826-135043968
  misc_feature 1..142: note = hyper
  source 1..142: mol_type = genomic DNA

SEQ ID NO: 54250 - DNA, 263 bp, Homo sapiens
  misc_feature 1..263: note = chr10:135044128-135044391
  misc_feature 1..263: note = hyper
  source 1..263: mol_type = genomic DNA
cagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaac

SEQ ID NO: 54251 - DNA, 173 bp, Homo sapiens
  misc_feature 1..173: note = chr10:135044573-135044746
  misc_feature 1..173: note = hyper
  source 1..173: mol_type = genomic DNA
cggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctga

SEQ ID NO: 54252 - DNA, 349 bp, Homo sapiens
  misc_feature 1..349: note = chr10:135048939-135049288
  misc_feature 1..349: note = hyper
  source 1..349: mol_type = genomic DNA
gggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggaggcttggaggcggaggctttggggacccccaagcctgggctagagcagcctcggcgggctctagagggagggtggagggaggggcccgggctgcaggaggcggggaggcctgagccacggtggtggggccgc

SEQ ID NO: 54253 - DNA, 584 bp, Homo sapiens
  misc_feature 1..584: note = chr10:135049727-135050311
  misc_feature 1..584: note = hyper
  source 1..584: mol_type = genomic DNA
aggcatctgggccctcgctgcccctggccgggacacactgccggtcctgtgcagtggctcaaagcccctctaccgggggtgacccggtctctccggagatgaagtgcagcgggggtctaggccggcttcctggccccccacccctcctggctttacccccgaggccacgtccaaagcccccagcgccccacccccgccagcctcccccttgagggcccagtgacctaactgggccggcagggtccgaggaagaccagggtcagcggcggcacggtccgttccgcgacccctctcctgtgaccccaggtaggccgccgatcggttcccggctgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccg

SEQ ID NO: 54254 - DNA, 188 bp, Homo sapiens
  misc_feature 1..188: note = chr10:135050679-135050867
  misc_feature 1..188: note = hyper
  source 1..188: mol_type = genomic DNA
gggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccct

SEQ ID NO: 54255 - DNA, 635 bp, Homo sapiens
  misc_feature 1..635: note = chr10:135138920-135139555
  misc_feature 1..635: note = hyper
  source 1..635: mol_type = genomic DNA
gaagcctccggtggacgtgaaatctttacttagagaaaagcgacagagtcagagacccacgggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggat

SEQ ID NO: 54256 - DNA, 243 bp, Homo sapiens; identical to SEQ ID NO: 33563
  misc_feature 1..243: note = chr10:135148859-135149102
  misc_feature 1..243: note = hyper
  source 1..243: mol_type = genomic DNA

SEQ ID NO: 54257 - DNA, 176 bp, Homo sapiens; identical to SEQ ID NO: 33564
  misc_feature 1..176: note = chr10:135150325-135150501
  misc_feature 1..176: note = hyper
  source 1..176: mol_type = genomic DNA

SEQ ID NO: 54258 - DNA, 100 bp, Homo sapiens; identical to SEQ ID NO: 33565
  misc_feature 1..100: note = chr10:135170736-135170836
  misc_feature 1..100: note = hyper
  source 1..100: mol_type = genomic DNA

SEQ ID NO: 54259 - DNA, 345 bp, Homo sapiens; identical to SEQ ID NO: 33566
  misc_feature 1..345: note = chr10:135236927-135237272
  misc_feature 1..345: note = hyper
  source 1..345: mol_type = genomic DNA

SEQ ID NO: 54260 - DNA, 32 bp, Homo sapiens; identical to SEQ ID NO: 33567
  misc_feature 1..32: note = chr11:279473-279505
  misc_feature 1..32: note = hyper
  source 1..32: mol_type = genomic DNA

SEQ ID NO: 54261 - DNA, 90 bp, Homo sapiens; identical to SEQ ID NO: 33568
  misc_feature 1..90: note = chr11:280129-280219
  misc_feature 1..90: note = hyper
  source 1..90: mol_type = genomic DNA

SEQ ID NO: 54262 - DNA, 56 bp, Homo sapiens; identical to SEQ ID NO: 33569
  misc_feature 1..56: note = chr11:308110-308166
  misc_feature 1..56: note = hyper
  source 1..56: mol_type = genomic DNA

SEQ ID NO: 54263 - DNA, 32 bp, Homo sapiens; identical to SEQ ID NO: 33570
  misc_feature 1..32: note = chr11:308230-308262
  misc_feature 1..32: note = hyper
  source 1..32: mol_type = genomic DNA

SEQ ID NO: 54264 - DNA, 31 bp, Homo sapiens; identical to SEQ ID NO: 33571
  misc_feature 1..31: note = chr11:308322-308353
  misc_feature 1..31: note = hyper
  source 1..31: mol_type = genomic DNA

SEQ ID NO: 54265 - DNA, 44 bp, Homo sapiens; identical to SEQ ID NO: 33572
  misc_feature 1..44: note = chr11:327148-327192
  misc_feature 1..44: note = hyper
  source 1..44: mol_type = genomic DNA

SEQ ID NO: 54266 - DNA, 35 bp, Homo sapiens; identical to SEQ ID NO: 33573
  misc_feature 1..35: note = chr11:369448-369483
  misc_feature 1..35: note = hyper
  source 1..35: mol_type = genomic DNA

SEQ ID NO: 54267 - DNA, 43 bp, Homo sapiens; identical to SEQ ID NO: 33574
  misc_feature 1..43: note = chr11:370169-370212
  misc_feature 1..43: note = hyper
  source 1..43: mol_type = genomic DNA

SEQ ID NO: 54268 - DNA, 154 bp, Homo sapiens
  misc_feature 1..154: note = chr11:406722-406876
  misc_feature 1..154: note = hyper
  source 1..154: mol_type = genomic DNA
ggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcacc

SEQ ID NO: 54269 - DNA, 103 bp, Homo sapiens; identical to SEQ ID NO: 20910
  misc_feature 1..103: note = chr11:406939-407042
  misc_feature 1..103: note = hyper
  source 1..103: mol_type = genomic DNA

SEQ ID NO: 54270 - DNA, 26 bp, Homo sapiens
  misc_feature 1..26: note = chr11:407401-407427
  misc_feature 1..26: note = hyper
  source 1..26: mol_type = genomic DNA
gcacggggtggggcccgggataccag

SEQ ID NO: 54271 - DNA, 66 bp, Homo sapiens; identical to SEQ ID NO: 33577
  misc_feature 1..66: note = chr11:507716-507782
  misc_feature 1..66: note = hyper
  source 1..66: mol_type = genomic DNA

SEQ ID NO: 54272 - skipped

SEQ ID NO: 54273 - DNA, 70 bp, Homo sapiens; identical to SEQ ID NO: 33579
  misc_feature 1..70: note = chr11:537026-537096
  misc_feature 1..70: note = hyper
  source 1..70: mol_type = genomic DNA

SEQ ID NO: 54274 - DNA, 45 bp, Homo sapiens
  misc_feature 1..45: note = chr11:637441-637486
  misc_feature 1..45: note = hyper
  source 1..45: mol_type = genomic DNA
cgcggtgctcgcggggaactcgctcgtgtgcgtgagcgtggccac

SEQ ID NO: 54275 - DNA, 110 bp, Homo sapiens
  misc_feature 1..110: note = chr11:726307-726417
  misc_feature 1..110: note = hyper
  source 1..110: mol_type = genomic DNA
catgcagcacatggacgaggtcaacgacgagctcatccggaaaatcagcaacatcagggcgcagccacagaggcacttccgcgtggagcgcagccagcccgtgagccagc

SEQ ID NO: 54276 - DNA, 44 bp, Homo sapiens
  misc_feature 1..44: note = chr11:726466-726510
  misc_feature 1..44: note = hyper
  source 1..44: mol_type = genomic DNA
caaggccttcagcccgcggtgagcgggggcgggggatgagctgg

SEQ ID NO: 54277 - DNA, 250 bp, Homo sapiens; identical to SEQ ID NO: 33583
  misc_feature 1..250: note = chr11:1410104-1410354
  misc_feature 1..250: note = hyper
  source 1..250: mol_type = genomic DNA

SEQ ID NO: 54278 - DNA, 34 bp, Homo sapiens; identical to SEQ ID NO: 10675
  misc_feature 1..34: note = chr11:1411655-1411689
  misc_feature 1..34: note = hyper
  source 1..34: mol_type = genomic DNA

SEQ ID NO: 54279 - DNA, 452 bp, Homo sapiens; identical to SEQ ID NO: 33585
  misc_feature 1..452: note = chr11:1411907-1412359
  misc_feature 1..452: note = hyper
  source 1..452: mol_type = genomic DNA

SEQ ID NO: 54280 - DNA, 426 bp, Homo sapiens; identical to SEQ ID NO: 33586
  misc_feature 1..426: note = chr11:1770262-1770688
  misc_feature 1..426: note = hyper
  source 1..426: mol_type = genomic DNA

SEQ ID NO: 54281 - DNA, 52 bp, Homo sapiens; identical to SEQ ID NO: 33587
  misc_feature 1..52: note = chr11:2291148-2291200
  misc_feature 1..52: note = hyper
  source 1..52: mol_type = genomic DNA

SEQ ID NO: 54282 - DNA, 129 bp, Homo sapiens
  misc_feature 1..129: note = chr11:2292636-2292765
  misc_feature 1..129: note = hyper
  source 1..129: mol_type = genomic DNA
ggggtgggaggttcaggttcccggggcgccttccccaacccgccccgctttccccgtccctccacgcgcaccctgcctgtggtttccgtgcgcccccggcctgagggctctgggcggcaccttaacccg

SEQ ID NO: 54283 - DNA, 107 bp, Homo sapiens; identical to SEQ ID NO: 33592
  misc_feature 1..107: note = chr11:2398287-2398394
  misc_feature 1..107: note = hyper
  source 1..107: mol_type = genomic DNA

SEQ ID NO: 54284 - DNA, 29 bp, Homo sapiens
  misc_feature 1..29: note = chr11:2465491-2465520
  misc_feature 1..29: note = hyper
  source 1..29: mol_type = genomic DNA
gctcacagtgatcgcggggccagcacacc

SEQ ID NO: 54285 - DNA, 43 bp, Homo sapiens
  misc_feature 1..43: note = chr11:2466788-2466831
  misc_feature 1..43: note = hyper
  source 1..43: mol_type = genomic DNA
gccacctgccccgtcggagctgcgaccccggagcagaggaggg

SEQ ID NO: 54286 - DNA, 30 bp, Homo sapiens; identical to SEQ ID NO: 33596
  misc_feature 1..30: note = chr11:2554518-2554548
  misc_feature 1..30: note = hyper
  source 1..30: mol_type = genomic DNA

SEQ ID NO: 54287 - DNA, 394 bp, Homo sapiens; identical to SEQ ID NO: 33597
  misc_feature 1..394: note = chr11:2883606-2884000
  misc_feature 1..394: note = hyper
  source 1..394: mol_type = genomic DNA

SEQ ID NO: 54288 - DNA, 49 bp, Homo sapiens; identical to SEQ ID NO: 33598
  misc_feature 1..49: note = chr11:2905392-2905441
  misc_feature 1..49: note = hyper
  source 1..49: mol_type = genomic DNA

SEQ ID NO: 54289 - DNA, 145 bp, Homo sapiens; identical to SEQ ID NO: 33599
  misc_feature 1..145: note = chr11:2905874-2906019
  misc_feature 1..145: note = hyper
  source 1..145: mol_type = genomic DNA

SEQ ID NO: 54290 - DNA, 258 bp, Homo sapiens; identical to SEQ ID NO: 33600
  misc_feature 1..258: note = chr11:2906322-2906580
  misc_feature 1..258: note = hyper
  source 1..258: mol_type = genomic DNA

SEQ ID NO: 54291 - DNA, 49 bp, Homo sapiens; identical to SEQ ID NO: 33601
  misc_feature 1..49: note = chr11:3224699-3224748
  misc_feature 1..49: note = hyper
  source 1..49: mol_type = genomic DNA

SEQ ID NO: 54292 - DNA, 258 bp, Homo sapiens; identical to SEQ ID NO: 33602
  misc_feature 1..258: note = chr11:6280415-6280673
  misc_feature 1..258: note = hyper
  source 1..258: mol_type = genomic DNA

SEQ ID NO: 54293 - DNA, 61 bp, Homo sapiens; identical to SEQ ID NO: 33603
  misc_feature 1..61: note = chr11:6281259-6281320
  misc_feature 1..61: note = hyper
  source 1..61: mol_type = genomic DNA

SEQ ID NO: 54294 - DNA, 15 bp, Homo sapiens
  misc_feature 1..15: note = chr11:6676538-6676553
  misc_feature 1..15: note = hyper
  source 1..15: mol_type = genomic DNA
cgcaccccacacccc

SEQ ID NO: 54295 - DNA, 203 bp, Homo sapiens; identical to SEQ ID NO: 33605
  misc_feature 1..203: note = chr11:6676627-6676830
  misc_feature 1..203: note = hyper
  source 1..203: mol_type = genomic DNA

SEQ ID NO: 54296 - DNA, 109 bp, Homo sapiens; identical to SEQ ID NO: 33606
  misc_feature 1..109: note = chr11:6677219-6677328
  misc_feature 1..109: note = hyper
  source 1..109: mol_type = genomic DNA

SEQ ID NO: 54297 - DNA, 673 bp, Homo sapiens; identical to SEQ ID NO: 33607
  misc_feature 1..673: note = chr11:6947606-6948279
  misc_feature 1..673: note = hyper
  source 1..673: mol_type = genomic DNA

SEQ ID NO: 54298 - DNA, 66 bp, Homo sapiens; identical to SEQ ID NO: 33608
  misc_feature 1..66: note = chr11:7273082-7273148
  misc_feature 1..66: note = hyper
  source 1..66: mol_type = genomic DNA

SEQ ID NO: 54299 - DNA, 111 bp, Homo sapiens; identical to SEQ ID NO: 33609
  misc_feature 1..111: note = chr11:7273149-7273260
  misc_feature 1..111: note = hyper
  source 1..111: mol_type = genomic DNA

SEQ ID NO: 54300 - DNA, 220 bp, Homo sapiens; identical to SEQ ID NO: 33610
  misc_feature 1..220: note = chr11:7273679-7273899
  misc_feature 1..220: note = hyper
  source 1..220: mol_type = genomic DNA

SEQ ID NO: 54301 - DNA, 140 bp, Homo sapiens
  misc_feature 1..140: note = chr11:7274075-7274215
  misc_feature 1..140: note = hyper
  source 1..140: mol_type = genomic DNA
cgcgatccggcgttgggccggggacagggtgcttctggccttgggcagacgggcctgaacccgttcccggcgggtcgcacggcatggaggtggcctgggcctgggcgctaggctcgaccagcgactaccgccggccacga

SEQ ID NO: 54302 - skipped

SEQ ID NO: 54303 - DNA, 126 bp, Homo sapiens; identical to SEQ ID NO: 33612
  misc_feature 1..126: note = chr11:8040298-8040424
  misc_feature 1..126: note = hyper
  source 1..126: mol_type = genomic DNA

SEQ ID NO: 54304 - skipped

SEQ ID NO: 54305 - DNA, 100 bp, Homo sapiens; identical to SEQ ID NO: 33614
  misc_feature 1..100: note = chr11:8040960-8041060
  misc_feature 1..100: note = hyper
  source 1..100: mol_type = genomic DNA

SEQ ID NO: 54306 - DNA, 67 bp, Homo sapiens; identical to SEQ ID NO: 10692
  misc_feature 1..67: note = chr11:8041504-8041571
  misc_feature 1..67: note = hyper
  source 1..67: mol_type = genomic DNA

SEQ ID NO: 54307 - DNA, 386 bp, Homo sapiens
  misc_feature 1..386: note = chr11:8102616-8103002
  misc_feature 1..386: note = hyper
  source 1..386: mol_type = genomic DNA
gcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccg

SEQ ID NO: 54308 - DNA, 41 bp, Homo sapiens; identical to SEQ ID NO: 20931
  misc_feature 1..41: note = chr11:8189946-8189987
  misc_feature 1..41: note = hyper
  source 1..41: mol_type = genomic DNA

SEQ ID NO: 54309 - DNA, 56 bp, Homo sapiens; identical to SEQ ID NO: 33618
  misc_feature 1..56: note = chr11:8284256-8284312
  misc_feature 1..56: note = hyper
  source 1..56: mol_type = genomic DNA

SEQ ID NO: 54310 - DNA, 13 bp, Homo sapiens
  misc_feature 1..13: note = chr11:8284313-8284326
  misc_feature 1..13: note = hyper
  source 1..13: mol_type = genomic DNA
ctcatgcagatgt

SEQ ID NO: 54311 - DNA, 201 bp, Homo sapiens
  misc_feature 1..201: note = chr11:8284760-8284961
  misc_feature 1..201: note = hyper
  source 1..201: mol_type = genomic DNA
cgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgcc

SEQ ID NO: 54312 - DNA, 27 bp, Homo sapiens
  misc_feature 1..27: note = chr11:8289745-8289772
  misc_feature 1..27: note = hyper
  source 1..27: mol_type = genomic DNA
tcccgccgccgccgaagcccgggcgct

SEQ ID NO: 54313 - DNA, 138 bp, Homo sapiens; identical to SEQ ID NO: 20935
  misc_feature 1..138: note = chr11:8290057-8290195
  misc_feature 1..138: note = hyper
  source 1..138: mol_type = genomic DNA

SEQ ID NO: 54314 - DNA, 130 bp, Homo sapiens; identical to SEQ ID NO: 33623
  misc_feature 1..130: note = chr11:8615288-8615418
  misc_feature 1..130: note = hyper
  source 1..130: mol_type = genomic DNA

SEQ ID NO: 54315 - DNA, 125 bp, Homo sapiens; identical to SEQ ID NO: 33624
  misc_feature 1..125: note = chr11:8615762-8615887
  misc_feature 1..125: note = hyper
  source 1..125: mol_type = genomic DNA

SEQ ID NO: 54316 - DNA, 890 bp, Homo sapiens; identical to SEQ ID NO: 20937
  misc_feature 1..890: note = chr11:9025080-9025970
  misc_feature 1..890: note = hyper
  source 1..890: mol_type = genomic DNA

SEQ ID NO: 54317 - DNA, 579 bp, Homo sapiens
  misc_feature 1..579: note = chr11:9112741-9113320
  misc_feature 1..579: note = hyper
  source 1..579: mol_type = genomic DNA
gccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccgacccggcgggacggcccccgccagcagcagcagtggcggcagcagcagcagcagcagcagcaccgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcg

SEQ ID NO: 54318 - DNA, 64 bp, Homo sapiens; identical to SEQ ID NO: 33628
  misc_feature 1..64: note = chr11:10472083-10472147
  misc_feature 1..64: note = hyper
  source 1..64: mol_type = genomic DNA

SEQ ID NO: 54319 - DNA, 60 bp, Homo sapiens; identical to SEQ ID NO: 33629
  misc_feature 1..60: note = chr11:10472462-10472522
  misc_feature 1..60: note = hyper
  source 1..60: mol_type = genomic DNA

SEQ ID NO: 54320 - DNA, 46 bp, Homo sapiens; identical to SEQ ID NO: 33630
  misc_feature 1..46: note = chr11:10472557-10472603
  misc_feature 1..46: note = hyper
  source 1..46: mol_type = genomic DNA

SEQ ID NO: 54321 - DNA, 66 bp, Homo sapiens; identical to SEQ ID NO: 33631
  misc_feature 1..66: note = chr11:11642602-11642668
  misc_feature 1..66: note = hyper
  source 1..66: mol_type = genomic DNA

SEQ ID NO: 54322 - DNA, 96 bp, Homo sapiens; identical to SEQ ID NO: 33632
  misc_feature 1..96: note = chr11:11643016-11643112
  misc_feature 1..96: note = hyper
  source 1..96: mol_type = genomic DNA

SEQ ID NO: 54323 - DNA, 47 bp, Homo sapiens
  misc_feature 1..47: note = chr11:12029910-12029957
  misc_feature 1..47: note = hyper
  source 1..47: mol_type = genomic DNA
acccacctcttccaccgcgctgcgcaatttgtgctgcgtgtcctcca

SEQ ID NO: 54324 - DNA, 288 bp, Homo sapiens; identical to SEQ ID NO: 33634
  misc_feature 1..288: note = chr11:12030273-12030561
  misc_feature 1..288: note = hyper
  source 1..288: mol_type = genomic DNA

SEQ ID NO: 54325 - DNA, 56 bp, Homo sapiens
  misc_feature 1..56: note = chr11:12030852-12030908
  misc_feature 1..56: note = hyper
  source 1..56: mol_type = genomic DNA
cagcgccggtacccgagggagcccgcaagacgcgccccgcccgcccaccaggctcc

SEQ ID NO: 54326 - DNA, 25 bp, Homo sapiens
  misc_feature 1..25: note = chr11:12132499-12132524
  misc_feature 1..25: note = hyper
  source 1..25: mol_type = genomic DNA
ataaaagcctcccaccggcacgccg

SEQ ID NO: 54327 - DNA, 30 bp, Homo sapiens; identical to SEQ ID NO: 33637
  misc_feature 1..30: note = chr11:12398995-12399025
  misc_feature 1..30: note = hyper
  source 1..30: mol_type = genomic DNA

SEQ ID NO: 54328 - DNA, 92 bp, Homo sapiens; identical to SEQ ID NO: 33638
  misc_feature 1..92: note = chr11:12399277-12399369
  misc_feature 1..92: note = hyper
  source 1..92: mol_type = genomic DNA

SEQ ID NO: 54329 - DNA, 258 bp, Homo sapiens; identical to SEQ ID NO: 33640
  misc_feature 1..258: note = chr11:12695888-12696146
  misc_feature 1..258: note = hyper
  source 1..258: mol_type = genomic DNA

SEQ ID NO: 54330 - DNA, 30 bp, Homo sapiens; identical to SEQ ID NO: 33642
  misc_feature 1..30: note = chr11:12715647-12715677
  misc_feature 1..30: note = hyper
  source 1..30: mol_type = genomic DNA

SEQ ID NO: 54331 - DNA, 173 bp, Homo sapiens; identical to SEQ ID NO: 33643
  misc_feature 1..173: note = chr11:13030315-13030488
  misc_feature 1..173: note = hyper
  source 1..173: mol_type = genomic DNA

SEQ ID NO: 54332 - DNA, 380 bp, Homo sapiens; identical to SEQ ID NO: 33644
  misc_feature 1..380: note = chr11:13031244-13031624
  misc_feature 1..380: note = hyper
  source 1..380: mol_type = genomic DNA

SEQ ID NO: 54333 - DNA, 15 bp, Homo sapiens
  misc_feature 1..15: note = chr11:13032000-13032015
  misc_feature 1..15: note = hyper
  source 1..15: mol_type = genomic DNA
agccagaagaggtgg

SEQ ID NO: 54334 - DNA, 219 bp, Homo sapiens; identical to SEQ ID NO: 33646
  misc_feature 1..219: note = chr11:13032093-13032312
  misc_feature 1..219: note = hyper
  source 1..219: mol_type = genomic DNA

SEQ ID NO: 54335 - DNA, 83 bp, Homo sapiens; identical to SEQ ID NO: 33647
  misc_feature 1..83: note = chr11:13032656-13032739
  misc_feature 1..83: note = hyper
  source 1..83: mol_type = genomic DNA

SEQ ID NO: 54336 - DNA, 216 bp, Homo sapiens; identical to SEQ ID NO: 33648
  misc_feature 1..216: note = chr11:13300474-13300690
  misc_feature 1..216: note = hyper
  source 1..216: mol_type = genomic DNA

SEQ ID NO: 54337 - DNA, 30 bp, Homo sapiens; identical to SEQ ID NO: 33649
  misc_feature 1..30: note = chr11:14665073-14665103
  misc_feature 1..30: note = hyper
  source 1..30: mol_type = genomic DNA

SEQ ID NO: 54338 - DNA, 36 bp, Homo sapiens
  misc_feature 1..36: note = chr11:15136049-15136085
  misc_feature 1..36: note = hyper
  source 1..36: mol_type = genomic DNA
caagggaaacgatcgcggcacattcccttcccctct

SEQ ID NO: 54339 - DNA, 62 bp, Homo sapiens
  misc_feature 1..62: note = chr11:15136394-15136456
  misc_feature 1..62: note = hyper
  source 1..62: mol_type = genomic DNA
gggcgggggagaacggggcggggggtggggcgggggccaggggcggcctctcgggctgggcc

SEQ ID NO: 54340 - DNA, 101 bp, Homo sapiens; identical to SEQ ID NO: 33651
  misc_feature 1..101: note = chr11:15136457-15136558
  misc_feature 1..101: note = hyper
  source 1..101: mol_type = genomic DNA

SEQ ID NO: 54341 - DNA, 206 bp, Homo sapiens; identical to SEQ ID NO: 33652
  misc_feature 1..206: note = chr11:16625964-16626170
  misc_feature 1..206: note = hyper
  source 1..206: mol_type = genomic DNA

SEQ ID NO: 54342 - DNA, 44 bp, Homo sapiens; identical to SEQ ID NO: 33653
  misc_feature 1..44: note = chr11:16628305-16628349
  misc_feature 1..44: note = hyper
  source 1..44: mol_type = genomic DNA

SEQ ID NO: 54343 - DNA, 156 bp, Homo sapiens; identical to SEQ ID NO: 33655
  misc_feature 1..156: note = chr11:16629373-16629529
  misc_feature 1..156: note = hyper
  source 1..156: mol_type = genomic DNA

SEQ ID NO: 54344 - DNA, 178 bp, Homo sapiens; identical to SEQ ID NO: 33657
  misc_feature 1..178: note = chr11:16634274-16634452
  misc_feature 1..178: note = hyper
  source 1..178: mol_type = genomic DNA

SEQ ID NO: 54345 - DNA, 132 bp, Homo sapiens; identical to SEQ ID NO: 33658
  misc_feature 1..132: note = chr11:16635795-16635927
  misc_feature 1..132: note = hyper
  source 1..132: mol_type = genomic DNA

SEQ ID NO: 54346 - DNA, 44 bp, Homo sapiens
  misc_feature 1..44: note = chr11:17497448-17497492
  misc_feature 1..44: note = hyper
  source 1..44: mol_type = genomic DNA
ctcagtggagaggcacgcacgattgtcccggccgtggcgcccaa

SEQ ID NO: 54347 - DNA, 230 bp, Homo sapiens; identical to SEQ ID NO: 33661
  misc_feature 1..230: note = chr11:17497951-17498181
  misc_feature 1..230: note = hyper
  source 1..230: mol_type = genomic DNA

SEQ ID NO: 54348 - DNA, 93 bp, Homo sapiens; identical to SEQ ID NO: 33662
  misc_feature 1..93: note = chr11:17565890-17565983
  misc_feature 1..93: note = hyper
  source 1..93: mol_type = genomic DNA

SEQ ID NO: 54349 - DNA, 440 bp, Homo sapiens; identical to SEQ ID NO: 33663
  misc_feature 1..440: note = chr11:17717334-17717774
  misc_feature 1..440: note = hyper
  source 1..440: mol_type = genomic DNA

SEQ ID NO: 54350 - DNA, 79 bp, Homo sapiens; identical to SEQ ID NO: 20947
  misc_feature 1..79: note = chr11:17740414-17740493
  misc_feature 1..79: note = hyper
  source 1..79: mol_type = genomic DNA

SEQ ID NO: 54351 - DNA, 20 bp, Homo sapiens
  misc_feature 1..20: note = chr11:17740570-17740590
  misc_feature 1..20: note = hyper
  source 1..20: mol_type = genomic DNA
tcgtgcgtttctctgcccct

SEQ ID NO: 54352 - DNA, 327 bp, Homo sapiens; identical to SEQ ID NO: 33665
  misc_feature 1..327: note = chr11:17740835-17741162
  misc_feature 1..327: note = hyper
  source 1..327: mol_type = genomic DNA

SEQ ID NO: 54353 - DNA, 41 bp, Homo sapiens; identical to SEQ ID NO: 33666
  misc_feature 1..41: note = chr11:17741528-17741569
  misc_feature 1..41: note = hyper
  source 1..41: mol_type = genomic DNA

SEQ ID NO: 54354 - DNA, 39 bp, Homo sapiens
  misc_feature 1..39: note = chr11:17742445-17742484
  misc_feature 1..39: note = hyper
  source 1..39: mol_type = genomic DNA
cagatggactacagcggccccccgagcggcgcccggcgg

SEQ ID NO: 54355 - DNA, 17 bp, Homo sapiens
  misc_feature 1..17: note = chr11:17743775-17743792
  misc_feature 1..17: note = hyper
  source 1..17: mol_type = genomic DNA
ggcggattgcaaggagg

SEQ ID NO: 54356 - DNA, 49 bp, Homo sapiens; identical to SEQ ID NO: 33670
  misc_feature 1..49: note = chr11:17756617-17756666
  misc_feature 1..49: note = hyper
  source 1..49: mol_type = genomic DNA

SEQ ID NO: 54357 - DNA, 86 bp, Homo sapiens; identical to SEQ ID NO: 33671
  misc_feature 1..86: note = chr11:17756886-17756972
  misc_feature 1..86: note = hyper
  source 1..86: mol_type = genomic DNA

SEQ ID NO: 54358 - DNA, 15 bp, Homo sapiens
  misc_feature 1..15: note = chr11:17756993-17757008
  misc_feature 1..15: note = hyper
  source 1..15: mol_type = genomic DNA
cgaccacctcacaga

SEQ ID NO: 54359 - DNA, 77 bp, Homo sapiens; identical to SEQ ID NO: 33673
  misc_feature 1..77: note = chr11:17757704-17757781
  misc_feature 1..77: note = hyper
  source 1..77: mol_type = genomic DNA

SEQ ID NO: 54360 - DNA, 494 bp, Homo sapiens; identical to SEQ ID NO: 33674
  misc_feature 1..494: note = chr11:18742646-18743140
  misc_feature 1..494: note = hyper
  source 1..494: mol_type = genomic DNA

SEQ ID NO: 54361 - DNA, 57 bp, Homo sapiens; identical to SEQ ID NO: 20953
  misc_feature 1..57: note = chr11:18812557-18812614
  misc_feature 1..57: note = hyper
  source 1..57: mol_type = genomic DNA

SEQ ID NO: 54362 - DNA, 379 bp, Homo sapiens
  misc_feature 1..379: note = chr11:18812653-18813032
  misc_feature 1..379: note = hyper
  source 1..379: mol_type = genomic DNA
gctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccgg

SEQ ID NO: 54363 - DNA, 80 bp, Homo sapiens; identical to SEQ ID NO: 20955
  misc_feature 1..80: note = chr11:18813086-18813166
  misc_feature 1..80: note = hyper
  source 1..80: mol_type = genomic DNA

SEQ ID NO: 54364 - DNA, 75 bp, Homo sapiens; identical to SEQ ID NO: 20956
  misc_feature 1..75: note = chr11:18813376-18813451
  misc_feature 1..75: note = hyper
  source 1..75: mol_type = genomic DNA

SEQ ID NO: 54365 - DNA, 183 bp, Homo sapiens
  misc_feature 1..183: note = chr11:18813609-18813792
  misc_feature 1..183: note = hyper
  source 1..183: mol_type = genomic DNA
cggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcaga

SEQ ID NO: 54366 - DNA, 104 bp, Homo sapiens
  misc_feature 1..104: note = chr11:18813947-18814051
  misc_feature 1..104: note = hyper
  source 1..104: mol_type = genomic DNA
ttctccctgttcagcctctggggagctagagcgagtggacagcccctccctccactgagtcttgccctcctgacgtgcggcgcggggcacgcacctgttttggt

SEQ ID NO: 54367 - DNA, 30 bp, Homo sapiens; identical to SEQ ID NO: 33678
  misc_feature 1..30: note = chr11:19263461-19263491
  misc_feature 1..30: note = hyper
  source 1..30: mol_type = genomic DNA

SEQ ID NO: 54368 - DNA, 404 bp, Homo sapiens
  misc_feature 1..404: note = chr11:19366698-19367102
  misc_feature 1..404: note = hyper
  source 1..404: mol_type = genomic DNA
gcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcct

SEQ ID NO: 54369 - DNA, 29 bp, Homo sapiens
  misc_feature 1..29: note = chr11:19367330-19367359
  misc_feature 1..29: note = hyper
  source 1..29: mol_type = genomic DNA
tccctctgggcgtacgtgcctgaggctgt

SEQ ID NO: 54370 - DNA, 91 bp, Homo sapiens; identical to SEQ ID NO: 33682
  misc_feature 1..91: note = chr11:19367846-19367937
  misc_feature 1..91: note = hyper
  source 1..91: mol_type = genomic DNA

SEQ ID NO: 54371 - DNA, 39 bp, Homo sapiens; identical to SEQ ID NO: 10733
  misc_feature 1..39: note = chr11:19367938-19367977
  misc_feature 1..39: note = hyper
  source 1..39: mol_type = genomic DNA

SEQ ID NO: 54372 - DNA, 120 bp, Homo sapiens; identical to SEQ ID NO: 33684
  misc_feature 1..120: note = chr11:19368011-19368131
  misc_feature 1..120: note = hyper
  source 1..120: mol_type = genomic DNA

SEQ ID NO: 54373 - DNA, 90 bp, Homo sapiens; identical to SEQ ID NO: 33685
  misc_feature 1..90: note = chr11:19734976-19735066
  misc_feature 1..90: note = hyper
  source 1..90: mol_type = genomic DNA

SEQ ID NO: 54374 - DNA, 30 bp, Homo sapiens; identical to SEQ ID NO: 10734
  misc_feature 1..30: note = chr11:19735404-19735434
  misc_feature 1..30: note = hyper
  source 1..30: mol_type = genomic DNA

SEQ ID NO: 54375 - DNA, 19 bp, Homo sapiens
  misc_feature 1..19: note = chr11:20153699-20153718
  misc_feature 1..19: note = hyper
  source 1..19: mol_type = genomic DNA
ccgcccatccacattcggc

SEQ ID NO: 54376 - DNA, 127 bp, Homo sapiens; identical to SEQ ID NO: 20965
  misc_feature 1..127: note = chr11:20153764-20153891
  misc_feature 1..127: note = hyper
  source 1..127: mol_type = genomic DNA

SEQ ID NO: 54377 - DNA, 90 bp, Homo sapiens; identical to SEQ ID NO: 33689
  misc_feature 1..90: note = chr11:20154109-20154199
  misc_feature 1..90: note = hyper
  source 1..90: mol_type = genomic DNA

SEQ ID NO: 54378 - DNA, 145 bp, Homo sapiens; identical to SEQ ID NO: 33690
  misc_feature 1..145: note = chr11:20177698-20177843
  misc_feature 1..145: note = hyper
  source 1..145: mol_type = genomic DNA

SEQ ID NO: 54379 - DNA, 688 bp, Homo sapiens
  misc_feature 1..688: note = chr11:20178305-20178993
  misc_feature 1..688: note = hyper
  source 1..688: mol_type = genomic DNA
ttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggat

SEQ ID NO: 54380 - DNA, 33 bp, Homo sapiens; identical to SEQ ID NO: 20969
  misc_feature 1..33: note = chr11:20180793-20180826
  misc_feature 1..33: note = hyper
  source 1..33: mol_type = genomic DNA

SEQ ID NO: 54381 - DNA, 28 bp, Homo sapiens
  misc_feature 1..28: note = chr11:20181185-20181213
  misc_feature 1..28: note = hyper
  source 1..28: mol_type = genomic DNA
tgtctcctagaagctcgaaggcagaaac

SEQ ID NO: 54382 - DNA, 390 bp, Homo sapiens
  misc_feature 1..390: note = chr11:20181254-20181644
  misc_feature 1..390: note = hyper
  source 1..390: mol_type = genomic DNA
tgactgcgcacagtctccgactgcgtgtgctcaagttcactccgaggatggggcgagcctggaggcttttcttccccggaattgactggactattctcacattgcctgacgtagggtctcagagttcgtgcgtattgtgtgtgcaccgatgtgtgtgtgggggcccgctcgctagaggaaactgaggccaggatgactccgcgcatgcctagtacctgaatgggcccttagggttctgacctcgcttacctgttctgggccccgaggagaggatggcgttcactccaaacttcagaaacgtcgtctcgctggcaggggagaaggcagtcggcggagagccgccccgtcggctgccgggacccggggagcccaggtccgaggcccccgtgt

SEQ ID NO: 54383 - DNA, 10 bp, Homo sapiens
  misc_feature 1..10: note = chr11:20182854-20182864
  misc_feature 1..10: note = hyper
  source 1..10: mol_type = genomic DNA
accttgcggg

SEQ ID NO: 54384 - DNA, 32 bp, Homo sapiens; identical to SEQ ID NO: 10745
  misc_feature 1..32: note = chr11:20184112-20184144
  misc_feature 1..32: note = hyper
  source 1..32: mol_type = genomic DNA

SEQ ID NO: 54385 - DNA, 69 bp, Homo sapiens; identical to SEQ ID NO: 20973
  misc_feature 1..69: note = chr11:20184500-20184569
  misc_feature 1..69: note = hyper
  source 1..69: mol_type = genomic DNA

SEQ ID NO: 54386 - DNA, 77 bp, Homo sapiens
  misc_feature 1..77: note = chr11:20185410-20185487
  misc_feature 1..77: note = hyper
  source 1..77: mol_type = genomic DNA
cccgacgcctggctttggggtggggggtgtggggagggggggcagggagctaacgggcgaggcgaaggaggagggct

SEQ ID NO: 54387 - DNA, 17 bp, Homo sapiens
  misc_feature 1..17: note = chr11:20229550-20229567
  misc_feature 1..17: note = hyper
  source 1..17: mol_type = genomic DNA
gacgctcccttaggacc

SEQ ID NO: 54388 - DNA, 46 bp, Homo sapiens
  misc_feature 1..46: note = chr11:20230464-20230510
  misc_feature 1..46: note = hyper
  source 1..46: mol_type = genomic DNA
ggttgctgcttttgagccggttgcttcgggccggcagcccttctta

SEQ ID NO: 54389 - DNA, 498 bp, Homo sapiens
  misc_feature 1..498: note = chr11:20619219-20619717
  misc_feature 1..498: note = hyper
  source 1..498: mol_type = genomic DNA
cgtcccccaagatgccaagagcctgcggggtgcttctcagcgccagccggaacttgagcaggcacccctgcggaattctcagtcccacccactcagacgaccctcctccagccagagtccaccacagcccaccctaccctcttaaccctcgttcccgacctctccctacgagcgggccccggggagagagcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccc

SEQ ID NO: 54390 - skipped

SEQ ID NO: 54391 - DNA, 127 bp, Homo sapiens
  misc_feature 1..127: note = chr11:20622578-20622705
  misc_feature 1..127: note = hyper
  source 1..127: mol_type = genomic DNA
tctggacctgagttgcgaacgtctccatatctagatacaggtattttaaaagctgttgtgactttgttttgcacgaacttgacattgtgtttgcaggattgcagtgctcccaaggaaatgaataaac

SEQ ID NO: 54392 - DNA, 38 bp, Homo sapiens
  misc_feature 1..38: note = chr11:20623359-20623397
  misc_feature 1..38: note = hyper
  source 1..38: mol_type = genomic DNA
ggaagctcgcactgcgctggggtcggcagttcagggcg

SEQ ID NO: 54393 - DNA, 30 bp, Homo sapiens; identical to SEQ ID NO: 33709
  misc_feature 1..30: note = chr11:20623598-20623628
  misc_feature 1..30: note = hyper
  source 1..30: mol_type = genomic DNA

SEQ ID NO: 54394 - DNA, 265 bp, Homo sapiens
  misc_feature 1..265: note = chr11:20690388-20690653
  misc_feature 1..265: note = hyper
  source 1..265: mol_type = genomic DNA
accccaaccacagctcgctccgcctcgaggaccccttttctgcacccccacctcagcgccctcttcctgcacccacaaagagagtactcagtcataggggttcaacaggagagaggagacagaaggtacaggcggtgagcagggactcagccatcatccccctcaggtccctccccacccagttgacagagcgaatcccgagtaattgttttccgagggggtccgtgcgcgctcggtggcgccgcctcggtctgggttcccccga

SEQ ID NO: 54395 - DNA, 104 bp, Homo sapiens; identical to SEQ ID NO: 33711
  misc_feature 1..104: note = chr11:20690982-20691086
  misc_feature 1..104: note = hyper
  source 1..104: mol_type = genomic DNA

SEQ ID NO: 54396 - DNA, 40 bp, Homo sapiens; identical to SEQ ID NO: 956
  misc_feature 1..40: note = chr11:20691121-20691161
  misc_feature 1..40: note = hyper
  source 1..40: mol_type = genomic DNA

SEQ ID NO: 54397 - DNA, 57 bp, Homo sapiens; identical to SEQ ID NO: 20981
  misc_feature 1..57: note = chr11:20691162-20691219
  misc_feature 1..57: note = hyper
  source 1..57: mol_type = genomic DNA

SEQ ID NO: 54398 - DNA, 164 bp, Homo sapiens; identical to SEQ ID NO: 20982
  misc_feature 1..164: note = chr11:20691452-20691616
  misc_feature 1..164: note = hyper
  source 1..164: mol_type = genomic DNA

SEQ ID NO: 54399 - DNA, 377 bp, Homo sapiens
  misc_feature 1..377: note = chr11:20692076-20692453
  misc_feature 1..377: note = hyper
  source 1..377: mol_type = genomic DNA
ttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggag

SEQ ID NO: 54400 - DNA, 37 bp, Homo sapiens
  misc_feature 1..37: note = chr11:20692529-20692566
  misc_feature 1..37: note = hyper
  source 1..37: mol_type = genomic DNA
gttagcccgctggaagatctagcgtctaggagctttc

SEQ ID NO: 54401 - DNA, 182 bp, Homo sapiens; identical to SEQ ID NO: 33717
  misc_feature 1..182: note = chr11:20692775-20692957
  misc_feature 1..182: note = hyper
  source 1..182: mol_type = genomic DNA

SEQ ID NO: 54402 - DNA, 763 bp, Homo sapiens
  misc_feature 1..763: note = chr11:22214360-22215123
  misc_feature 1..763: note = hyper
  source 1..763: mol_type = genomic DNA
gccggccaacagggccggggggcggcgggtcccgaggagggacgggaggctgcatgtccggaggaggtgcgggaggcggcagagcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgc

SEQ ID NO: 54403 - DNA, 46 bp, Homo sapiens
  misc_feature 1..46: note = chr11:22215287-22215333
  misc_feature 1..46: note = hyper
  source 1..46: mol_type = genomic DNA
ttctctgctgctcctgcgcgccagggacctgcgacctgtgacccct

SEQ ID NO: 54404 - DNA, 15 bp, Homo sapiens
  misc_feature 1..15: note = chr11:22359403-22359418
  misc_feature 1..15: note = hyper
  source 1..15: mol_type = genomic DNA
tcttttatttactca

SEQ ID NO: 54405 - DNA, 136 bp, Homo sapiens; identical to SEQ ID NO: 33720
  misc_feature 1..136: note = chr11:22359746-22359882
  misc_feature 1..136: note = hyper
  source 1..136: mol_type = genomic DNA

SEQ ID NO: 54406 - DNA, 401 bp, Homo sapiens
  misc_feature 1..401: note = chr11:22362533-22362934
  misc_feature 1..401: note = hyper
  source 1..401: mol_type = genomic DNA
tcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacctgcagaatgtgagagagcctgggaggtcttgcagcttggtgtcaccc

SEQ ID NO: 54407 - DNA, 432 bp, Homo sapiens
  misc_feature 1..432: note = chr11:22364975-22365407
  misc_feature 1..432: note = hyper
  source 1..432: mol_type = genomic DNA
agctggagcagagacaacagcccagaggggtttgaggactcccgggcgaagtcttctagtcccttgacacaccctctcagggctggagctgctggtgactccttcctgaattagtcgcctaaacgaatgtaggctctctgggaccagcgcacgcggcctccttccctctgctgtggctgaacttgcttttggcgaaataatcgacgtgctgtatggcctgacaggagctgagggcagaccgggagcaggcagagcagggacagtgcgcctgagtgcacaaaggggtgtagaacggcagatgctgcgctctctcctgcactccccgcaggctcccaggctccccgagggtctgacctcctggcaaggcgcctcgaagacctggccccgtcccccgcccagttggtgctctgggtatgaagtatttgtttctag

SEQ ID NO: 54408 - DNA, 70 bp, Homo sapiens; identical to SEQ ID NO: 20990
  misc_feature 1..70: note = chr11:22365477-22365547
  misc_feature 1..70: note = hyper
  source 1..70: mol_type = genomic DNA

SEQ ID NO: 54409 - DNA, 408 bp, Homo sapiens; identical to SEQ ID NO: 33723
  misc_feature 1..408: note = chr11:22688123-22688531
  misc_feature 1..408: note = hyper
  source 1..408: mol_type = genomic DNA

SEQ ID NO: 54410 - DNA, 30 bp, Homo sapiens; identical to SEQ ID NO: 33724
  misc_feature 1..30: note = chr11:24518383-24518413
  misc_feature 1..30: note = hyper
  source 1..30: mol_type = genomic DNA

SEQ ID NO: 54411 - DNA, 30 bp, Homo sapiens; identical to SEQ ID NO: 33725
  misc_feature 1..30: note = chr11:26353691-26353721
  misc_feature 1..30: note = hyper
  source 1..30: mol_type = genomic DNA

SEQ ID NO: 54412 - DNA, 30 bp, Homo sapiens; identical to SEQ ID NO: 33726
  misc_feature 1..30: note = chr11:27720990-27721020
  misc_feature 1..30: note = hyper
  source 1..30: mol_type = genomic DNA

SEQ ID NO: 54413 - DNA, 15 bp, Homo sapiens
  misc_feature 1..15: note = chr11:27740193-27740208
  misc_feature 1..15: note = hyper
  source 1..15: mol_type = genomic DNA
gctgcaggcttgctc

SEQ ID NO: 54414 - DNA, 53 bp, Homo sapiens; identical to SEQ ID NO: 33728
  misc_feature 1..53: note = chr11:27740933-27740986
  misc_feature 1..53: note = hyper
  source 1..53: mol_type = genomic DNA

SEQ ID NO: 54415 - DNA, 67 bp, Homo sapiens
  misc_feature 1..67: note = chr11:27743048-27743115
  misc_feature 1..67: note = hyper
  source 1..67: mol_type = genomic DNA
atcatgtgagaagttcggctttgctcagtggatcgcccaccacttggtgtgacttatgaatctaata

SEQ ID NO: 54416 - DNA, 17 bp, Homo sapiens
  misc_feature 1..17: note = chr11:27743419-27743436
  misc_feature 1..17: note = hyper
  source 1..17: mol_type = genomic DNA
actcagcctgcacaccg

SEQ ID NO: 54417 - DNA, 85 bp, Homo sapiens
  misc_feature 1..85: note = chr11:27743608-27743693
  misc_feature 1..85: note = hyper
  source 1..85: mol_type = genomic DNA
accagaaaagcgcagcagggagggggtggggggcggcaacggcgacgactaacctcgctgtttacgtgaccgactcactgtgact

SEQ ID NO: 54418 - DNA, 250 bp, Homo sapiens; identical to SEQ ID NO: 20993
  misc_feature 1..250: note = chr11:27743897-27744147
  misc_feature 1..250: note = hyper
  source 1..250: mol_type = genomic DNA

SEQ ID NO: 54419 - DNA, 53 bp, Homo sapiens
  misc_feature 1..53: note = chr11:27744504-27744557
  misc_feature 1..53: note = hyper
  source 1..53: mol_type = genomic DNA
cgggaaataggcaataactcgagctttggcaacgtcccccagcctagggaggc

SEQ ID NO: 54420 - DNA, 153 bp, Homo sapiens
  misc_feature 1..153: note = chr11:27744558-27744711
  misc_feature 1..153: note = hyper
  source 1..153: mol_type = genomic DNA
ctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccag

SEQ ID NO: 54421 - skipped

SEQ ID NO: 54422 - DNA, 395 bp, Homo sapiens
  misc_feature 1..395: note = chr11:30038294-30038689
  misc_feature 1..395: note = hyper
  source 1..395: mol_type = genomic DNA
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaagcccgaattcctcctccaacatccatccctctctcgctctcgctggctgcgggagcagcacacgcctcccctggccgcgaacgcgctctgggcgggggcggggccagggccgaaccgagggtgtggcgttcgcgacggtcgccaggggcgcctcccggcgcggcggggcgggtgcagtcacgacgccgcgactccccgcac

SEQ ID NO: 54423 - DNA, 391 bp, Homo sapiens
  misc_feature 1..391: note = chr11:30038739-30039130
  misc_feature 1..391: note = hyper
  source 1..391: mol_type = genomic DNA
ttggctgtggtccccacaggcgaggagcaaatcctggagaagtgtccccgttggggccggaataggggtttcgacggcagcgcgggagtccccagagggcttgggagcggggagctccaatgggaggtgcagtcccgaaaatggggtcctctgggacatctcctctacctaacttgctttctctatatctcccctcgagccccgagccccgtcttcttttccccaccccatcccctcccaaagcgggtttgttgggttgggagccgggtgcatctccggcgaggccacgggcggggagccctcctgtgcctgccagagcgcccagatccctcagtctccgtctcctttgcacacaggagttgggaggcttcagcgccggggttgggcctca

SEQ ID NO: 54424 - DNA, 106 bp, Homo sapiens; identical to SEQ ID NO: 33735
  misc_feature 1..106: note = chr11:30040131-30040237
  misc_feature 1..106: note = hyper
  source 1..106: mol_type = genomic DNA

SEQ ID NO: 54425 - DNA, 41 bp, Homo sapiens; identical to SEQ ID NO: 33736
  misc_feature 1..41: note = chr11:30605841-30605882
  misc_feature 1..41: note = hyper
  source 1..41: mol_type = genomic DNA

SEQ ID NO: 54426 - DNA, 62 bp, Homo sapiens; identical to SEQ ID NO: 33739
  misc_feature 1..62: note = chr11:30606323-30606385
  misc_feature 1..62: note = hyper
  source 1..62: mol_type = genomic DNA

SEQ ID NO: 54427 - DNA, 57 bp, Homo sapiens; identical to SEQ ID NO: 33740
  misc_feature 1..57: note = chr11:30606698-30606755
  misc_feature 1..57: note = hyper
  source 1..57: mol_type = genomic DNA

SEQ ID NO: 54428 - DNA, 242 bp, Homo sapiens
  misc_feature 1..242: note = chr11:30606864-30607106
  misc_feature 1..242: note = hyper
  source 1..242: mol_type = genomic DNA
cggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagta

SEQ ID NO: 54429 - DNA, 51 bp, Homo sapiens
  misc_feature 1..51: note = chr11:30607316-30607367
  misc_feature 1..51: note = hyper
  source 1..51: mol_type = genomic DNA
aaaagaatttgctttcgctcaggggttgaaaatcagccctccccgagcgcc

SEQ ID NO: 54430 - DNA, 341 bp, Homo sapiens
  misc_feature 1..341: note = chr11:30607409-30607750
  misc_feature 1..341: note = hyper
  source 1..341: mol_type = genomic DNA
ccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgc

SEQ ID NO: 54431 - DNA, 212 bp, Homo sapiens; identical to SEQ ID NO: 21004
  misc_feature 1..212: note = chr11:31819833-31820045
  misc_feature 1..212: note = hyper
  source 1..212: mol_type = genomic DNA

SEQ ID NO: 54432 - DNA, 272 bp, Homo sapiens
  misc_feature 1..272: note = chr11:31821025-31821297
  misc_feature 1..272: note = hyper
  source 1..272: mol_type = genomic DNA
cttgtggaacatttctacagctgtctccttcaactagacgcttattcatgtcgccttaatgagaaacaaaacgttctctaatgagcaattacagagcgacaggattgttcccataacaaattcttgcgagtgacagaagcatcctttgtaccagatatttcgcatactgttaccgattttcccttccctcgcccgactccatggaggcgccgggcatccggagccggtccgagagctcacggatgcgccggcagcctcctcgcagtcccgcg

SEQ ID NO: 54433 - DNA, 107 bp, Homo sapiens; identical to SEQ ID NO: 33748
  misc_feature 1..107: note = chr11:31822002-31822109
  misc_feature 1..107: note = hyper
  source 1..107: mol_type = genomic DNA

SEQ ID NO: 54434 - DNA, 315 bp, Homo sapiens
  misc_feature 1..315: note = chr11:31822393-31822708
  misc_feature 1..315: note = hyper
  source 1..315: mol_type = genomic DNA
attgatgacacctgcaaatcaaaccaaaatcaaaccaaatggtagtgtctcctgaagacacagtcacccatctcagctcacccacaaccttaaaaagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 54435 - DNA, 40 bp, Homo sapiens; identical to SEQ ID NO: 33750
  misc_feature 1..40: note = chr11:31823165-31823205
  misc_feature 1..40: note = hyper
  source 1..40: mol_type = genomic DNA

SEQ ID NO: 54436 - DNA, 146 bp, Homo sapiens
  misc_feature 1..146: note = chr11:31824154-31824300
  misc_feature 1..146: note = hyper
  source 1..146: mol_type = genomic DNA
gtccataattagcatcgtttacagtaagaaatgaagagagggcgttgagagtggagggccgcgggggcggcgagtggggcggcgccgggaggatcacctgcagaattcgggaaatgtcgcacggccgggccccgctgtgagctagc

SEQ ID NO: 54437 - DNA, 209 bp, Homo sapiens; identical to SEQ ID NO: 21008
  misc_feature 1..209: note = chr11:31824355-31824564
  misc_feature 1..209: note = hyper
  source 1..209: mol_type = genomic DNA

SEQ ID NO: 54438 - DNA, 284 bp, Homo sapiens; identical to SEQ ID NO: 21009
  misc_feature 1..284: note = chr11:31824680-31824964
  misc_feature 1..284: note = hyper
  source 1..284: mol_type = genomic DNA

SEQ ID NO: 54439 - DNA, 234 bp, Homo sapiens
  misc_feature 1..234: note = chr11:31827204-31827438
  misc_feature 1..234: note = hyper
  source 1..234: mol_type = genomic DNA
gtgggaccccacggggtctgggcagaggaaagcagggaggtacaagggccataagtatcaaaagcgctctgggcctgggactatcaggacccaagcaattgcagttgccagggcagggattttccaattcctgggcacctccttaccagacccagtaaaccgtgctctctcccgcgccctgtaacagcgagtttaccacccctaccctgctgcaggcctgggggctcctctccc

SEQ ID NO: 54440 - DNA, 329 bp, Homo sapiens; identical to SEQ ID NO: 10798
  misc_feature 1..329: note = chr11:31829116-31829445
  misc_feature 1..329: note = hyper
  source 1..329: mol_type = genomic DNA

SEQ ID NO: 54441 - DNA, 80 bp, Homo sapiens; identical to SEQ ID NO: 33758
  misc_feature 1..80: note = chr11:31830319-31830399
  misc_feature 1..80: note = hyper
  source 1..80: mol_type = genomic DNA

SEQ ID NO: 54442 - DNA, 278 bp, Homo sapiens; identical to SEQ ID NO: 33759
  misc_feature 1..278: note = chr11:31831502-31831780
  misc_feature 1..278: note = hyper
  source 1..278: mol_type = genomic DNA

SEQ ID NO: 54443 - DNA, 138 bp, Homo sapiens; identical to SEQ ID NO: 33760
  misc_feature 1..138: note = chr11:31832001-31832139
  misc_feature 1..138: note = hyper
  source 1..138: mol_type = genomic DNA

SEQ ID NO: 54444 - DNA, 50 bp, Homo sapiens; identical to SEQ ID NO: 10801
  misc_feature 1..50: note = chr11:31832795-31832845
  misc_feature 1..50: note = hyper
  source 1..50: mol_type = genomic DNA

SEQ ID NO: 54445 - DNA, 49 bp, Homo sapiens; identical to SEQ ID NO: 10802
  misc_feature 1..49: note = chr11:31833553-31833602
  misc_feature 1..49: note = hyper
  source 1..49: mol_type = genomic DNA

SEQ ID NO: 54446 - DNA, 149 bp, Homo sapiens; identical to SEQ ID NO: 10803
  misc_feature 1..149: note = chr11:31834086-31834235
  misc_feature 1..149: note = hyper
  source 1..149: mol_type = genomic DNA

SEQ ID NO: 54447 - DNA, 293 bp, Homo sapiens; identical to SEQ ID NO: 33764
  misc_feature 1..293: note = chr11:31834502-31834795
  misc_feature 1..293: note = hyper
  source 1..293: mol_type = genomic DNA

SEQ ID NO: 54448 - DNA, 162 bp, Homo sapiens; identical to SEQ ID NO: 33765
  misc_feature 1..162: note = chr11:31835180-31835342
  misc_feature 1..162: note = hyper
  source 1..162: mol_type = genomic DNA

SEQ ID NO: 54449 - DNA, 116 bp, Homo sapiens; identical to SEQ ID NO: 21018
  misc_feature 1..116: note = chr11:31835591-31835707
  misc_feature 1..116: note = hyper
  source 1..116: mol_type = genomic DNA

SEQ ID NO: 54450 - DNA, 249 bp, Homo sapiens
  misc_feature 1..249: note = chr11:31835797-31836046
  misc_feature 1..249: note = hyper
  source 1..249: mol_type = genomic DNA
gctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttcc

SEQ ID NO: 54451 - DNA, 63 bp, Homo sapiens
  misc_feature 1..63: note = chr11:31836470-31836533
  misc_feature 1..63: note = hyper
  source 1..63: mol_type = genomic DNA
ggccagtgctaggggctccctgggttcagtcctcagtcctcttccgttcgctctgggaggcca

SEQ ID NO: 54452 - DNA, 30 bp, Homo sapiens; identical to SEQ ID NO: 33767
  misc_feature 1..30: note = chr11:31836824-31836854
  misc_feature 1..30: note = hyper
  source 1..30: mol_type = genomic DNA

SEQ ID NO: 54453 - DNA, 94 bp, Homo sapiens
  misc_feature 1..94: note = chr11:31838584-31838678
  misc_feature 1..94: note = hyper
  source 1..94: mol_type = genomic DNA
ccgcagggtggtgggcgcttctctttcccgggcttggcggcccggctcccatggcgcccgcgcgcttcccgccgaggcagccagcgcagcgccc

SEQ ID NO: 54454 - DNA, 256 bp, Homo sapiens; identical to SEQ ID NO: 21021
  misc_feature 1..256: note = chr11:31839051-31839307
  misc_feature 1..256: note = hyper
  source 1..256: mol_type = genomic DNA

SEQ ID NO: 54455 - DNA, 93 bp, Homo sapiens; identical to SEQ ID NO: 21022
  misc_feature 1..93: note = chr11:31840080-31840173
  misc_feature 1..93: note = hyper
  source 1..93: mol_type = genomic DNA

SEQ ID NO: 54456 - DNA, 195 bp, Homo sapiens; identical to SEQ ID NO: 33774
  misc_feature 1..195: note = chr11:31845092-31845287
  misc_feature 1..195: note = hyper
  source 1..195: mol_type = genomic DNA

SEQ ID NO: 54457 - DNA, 58 bp, Homo sapiens; identical to SEQ ID NO: 33775
  misc_feature 1..58: note = chr11:31845842-31845900
  misc_feature 1..58: note = hyper
  source 1..58: mol_type = genomic DNA

SEQ ID NO: 54458 - DNA, 204 bp, Homo sapiens
  misc_feature 1..204: note = chr11:31846230-31846434
  misc_feature 1..204: note = hyper
  source 1..204: mol_type = genomic DNA
atgagaagtggggtgcagggtgctatttgcccagcaaaagctcatttcctcccaaatgagtataatgaaaacccgagaggcgatattagtgtaaagatcgggattagtccaaataggagccgcggacttgggcttcaaaggcgacccctactctttttgcccagtctgggggcggagggcgctcgaagggatacttcaaggaca

SEQ ID NO: 54459 - DNA, 265 bp, Homo sapiens
  misc_feature 1..265: note = chr11:31846985-31847250
  misc_feature 1..265: note = hyper
  source 1..265: mol_type = genomic DNA
tttttttttatccttgacaacttgtgtcctaaagaaagtgtattgaagataattgaaatgattacaattcattgctgcctgactttgaatatgaacagtcacataatgacatccccgccacacaacaacagtttaatttccattatccgacttcgggatcctagcgccagccgccggggcaacgtggcgctaatgcagaaatcttggctcctgcctgcattattcatttcggggacgtggggatgggataggagtggagagtggg

SEQ ID NO: 54460 - DNA, 46 bp, Homo sapiens; identical to SEQ ID NO: 21023
  misc_feature 1..46: note = chr11:31847925-31847971
  misc_feature 1..46: note = hyper
  source 1..46: mol_type = genomic DNA

SEQ ID NO: 54461 - DNA, 149 bp, Homo sapiens
  misc_feature 1..149: note = chr11:31848323-31848472
  misc_feature 1..149: note = hyper
  source 1..149: mol_type = genomic DNA
tggcataactcgaaccggagaagcgaggggagcctgagtgactggggcgcacatgacccccctcctggggcctttgggctcaacccttacttttaacttgttctaacaggaataatggagtagtactactaatgcatggtcagaagggg

SEQ ID NO: 54462 - skipped

SEQ ID NO: 54463 - DNA, 117 bp, Homo sapiens
  misc_feature 1..117: note = chr11:32355197-32355314
  misc_feature 1..117: note = hyper
  source 1..117: mol_type = genomic DNA
tatccaggcggaagggaagcagccaggccgccgcggatctgaacttgaatcccgggtggaccggacgccccggccggcgctcctgacgcgcggaggagctggcgagaacctgcagat

SEQ ID NO: 54464 - DNA, 59 bp, Homo sapiens
  misc_feature 1..59: note = chr11:32448524-32448583
  misc_feature 1..59: note = hyper
  source 1..59: mol_type = genomic DNA
acctccttcccttgacgtcagccccgggtccccgcgcggaggggagggaggatggggat

SEQ ID NO: 54465 - DNA, 120 bp, Homo sapiens
  misc_feature 1..120: note = chr11:32455482-32455602
  misc_feature 1..120: note = hyper
  source 1..120: mol_type = genomic DNA
tccttccactgcctgcggtagaacctggtcccgcatagcttggactcggataagtcaagttctcttccatccccagaacctgcgtggccgccgcctgagcgaagcccagtgaagatccac

SEQ ID NO: 54466 - DNA, 207 bp, Homo sapiens
  misc_feature 1..207: note = chr11:32455634-32455841
  misc_feature 1..207: note = hyper
  source 1..207: mol_type = genomic DNA
gacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagac

SEQ ID NO: 54467 - DNA, 254 bp, Homo sapiens
  misc_feature 1..254: note = chr11:32456025-32456279
  misc_feature 1..254: note = hyper
  source 1..254: mol_type = genomic DNA
ctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggca

SEQ ID NO: 54468 - DNA, 23 bp, Homo sapiens
  misc_feature 1..23: note = chr11:32457176-32457199
  misc_feature 1..23: note = hyper
  source 1..23: mol_type = genomic DNA
gcagcccaagcccggccaggcag

SEQ ID NO: 54469 - DNA, 218 bp, Homo sapiens; identical to SEQ ID NO: 33790
  misc_feature 1..218: note = chr11:32457219-32457437
  misc_feature 1..218: note = hyper
  source 1..218: mol_type = genomic DNA

SEQ ID NO: 54470 - DNA, 28 bp, Homo sapiens
  misc_feature 1..28: note = chr11:32457684-32457712
  misc_feature 1..28: note = hyper
  source 1..28: mol_type = genomic DNA
cctcagttgggtggccgggagttgcacc

SEQ ID NO: 54471 - DNA, 214 bp, Homo sapiens; identical to SEQ ID NO: 21025
  misc_feature 1..214: note = chr11:32458175-32458389
  misc_feature 1..214: note = hyper
  source 1..214: mol_type = genomic DNA

SEQ ID NO: 54472 - DNA, 30 bp, Homo sapiens; identical to SEQ ID NO: 33793
  misc_feature 1..30: note = chr11:32460192-32460222
  misc_feature 1..30: note = hyper
  source 1..30: mol_type = genomic DNA

SEQ ID NO: 54473 - DNA, 25 bp, Homo sapiens
  misc_feature 1..25: note = chr11:32460864-32460889
  misc_feature 1..25: note = hyper
  source 1..25: mol_type = genomic DNA
gagccccacgcgcaagacagcccaa

SEQ ID NO: 54474 - DNA, 84 bp, Homo sapiens
  misc_feature 1..84: note = chr11:33037556-33037640
  misc_feature 1..84: note = hyper
  source 1..84: mol_type = genomic DNA
ccgcgcacaggcctccgggtaggtgccgaggactgccgcctgggatggcgcggggcgggctggggtgcgcgggctgggtcccgg

SEQ ID NO: 54475 - DNA, 30 bp, Homo sapiens; identical to SEQ ID NO: 33797
  misc_feature 1..30: note = chr11:33850927-33850957
  misc_feature 1..30: note = hyper
  source 1..30: mol_type = genomic DNA

SEQ ID NO: 54476 - DNA, 61 bp, Homo sapiens
  misc_feature 1..61: note = chr11:33890236-33890297
  misc_feature 1..61: note = hyper
  source 1..61: mol_type = genomic DNA
tggtgcattaactttcgaggttcacatgtccccatcggtggaccccgaggaggggtacacc

SEQ ID NO: 54477 - DNA, 281 bp, Homo sapiens
  misc_feature 1..281: note = chr11:33890334-33890615
  misc_feature 1..281: note = hyper
  source 1..281: mol_type = genomic DNA
ccctggaggcccagagccagctccgaggtggacggtcggacccctcacccgcccgttatccgcaaggctggcagcggctccacctgcggaccgggaaggcggccgttggggaccccggaggccgccacttggaatgttcccctttccaagaccaaatggacaaagagaaaggaccgagaaggagagggaagaagggagcagagtcaagcccagaacgctctccggactgcacctgcgcgcctccaggctctcctcgtgcctgctcccgtgcaaactttctg

SEQ ID NO: 54478 - DNA, 30 bp, Homo sapiens; identical to SEQ ID NO: 33799
  misc_feature 1..30: note = chr11:33892097-33892127
  misc_feature 1..30: note = hyper
  source 1..30: mol_type = genomic DNA

SEQ ID NO: 54479 - DNA, 208 bp, Homo sapiens; identical to SEQ ID NO: 33800
  misc_feature 1..208: note = chr11:35440486-35440694
  misc_feature 1..208: note = hyper
  source 1..208: mol_type = genomic DNA

SEQ ID NO: 54480 - DNA, 93 bp, Homo sapiens; identical to SEQ ID NO: 33801
  misc_feature 1..93: note = chr11:35440936-35441029
  misc_feature 1..93: note = hyper
  source 1..93: mol_type = genomic DNA

SEQ ID NO: 54481 - DNA, 342 bp, Homo sapiens; identical to SEQ ID NO: 33802
  misc_feature 1..342: note = chr11:35441295-35441637
  misc_feature 1..342: note = hyper
  source 1..342: mol_type = genomic DNA

SEQ ID NO: 54482 - DNA, 13 bp, Homo sapiens
  misc_feature 1..13: note = chr11:35547562-35547575
  misc_feature 1..13: note = hyper
  source 1..13: mol_type = genomic DNA
ggagctggctttg

SEQ ID NO: 54483 - DNA, 42 bp, Homo sapiens; identical to SEQ ID NO: 33804
  misc_feature 1..42: note = chr11:35639614-35639656
  misc_feature 1..42: note = hyper
  source 1..42: mol_type = genomic DNA

SEQ ID NO: 54484 - DNA, 79 bp, Homo sapiens; identical to SEQ ID NO: 33805
  misc_feature 1..79: note = chr11:35639657-35639736
  misc_feature 1..79: note = hyper
  source 1..79: mol_type = genomic DNA

SEQ ID NO: 54485 - DNA, 915 bp, Homo sapiens; identical to SEQ ID NO: 33806
  misc_feature 1..915: note = chr11:35640687-35641602
  misc_feature 1..915: note = hyper
  source 1..915: mol_type = genomic DNA

SEQ ID NO: 54486 - DNA, 263 bp, Homo sapiens; identical to SEQ ID NO: 33807
  misc_feature 1..263: note = chr11:36398106-36398369
  misc_feature 1..263: note = hyper
  source 1..263: mol_type = genomic DNA

SEQ ID NO: 54487 - DNA, 32 bp, Homo sapiens; identical to SEQ ID NO: 33808
  misc_feature 1..32: note = chr11:36398880-36398912
  misc_feature 1..32: note = hyper
  source 1..32: mol_type = genomic DNA

SEQ ID NO: 54488 - DNA, 162 bp, Homo sapiens; identical to SEQ ID NO: 33809
  misc_feature 1..162: note = chr11:36399187-36399349
  misc_feature 1..162: note = hyper
  source 1..162: mol_type = genomic DNA

SEQ ID NO: 54489 - DNA, 207 bp, Homo sapiens; identical to SEQ ID NO: 33810
  misc_feature 1..207: note = chr11:40314716-40314923
  misc_feature 1..207: note = hyper
  source 1..207: mol_type = genomic DNA

SEQ ID NO: 54490 - DNA, 135 bp, Homo sapiens; identical to SEQ ID NO: 33811
  misc_feature 1..135: note = chr11:40315465-40315600
  misc_feature 1..135: note = hyper
  source 1..135: mol_type = genomic DNA

SEQ ID NO: 54491 - DNA, 115 bp, Homo sapiens; identical to SEQ ID NO: 33812
  misc_feature 1..115: note = chr11:43568960-43569075
  misc_feature 1..115: note = hyper
  source 1..115: mol_type = genomic DNA

SEQ ID NO: 54492 - DNA, 187 bp, Homo sapiens; identical to SEQ ID NO: 33813
  misc_feature 1..187: note = chr11:43569128-43569315
  misc_feature 1..187: note = hyper
  source 1..187: mol_type = genomic DNA

SEQ ID NO: 54493 - DNA, 32 bp, Homo sapiens; identical to SEQ ID NO: 33814
  misc_feature 1..32: note = chr11:43569580-43569612
  misc_feature 1..32: note = hyper
  source 1..32: mol_type = genomic DNA

SEQ ID NO: 54494 - DNA, 24 bp, Homo sapiens
  misc_feature 1..24: note = chr11:43596489-43596513
  misc_feature 1..24: note = hyper
  source 1..24: mol_type = genomic DNA
ggtgagtttcctcttcgggtggag

SEQ ID NO: 54495 - DNA, 360 bp, Homo sapiens; identical to SEQ ID NO: 33816
  misc_feature 1..360: note = chr11:43596850-43597210
  misc_feature 1..360: note = hyper
  source 1..360: mol_type = genomic DNA

SEQ ID NO: 54496 - DNA, 45 bp, Homo sapiens; identical to SEQ ID NO: 33817
  misc_feature 1..45: note = chr11:43598418-43598463
  misc_feature 1..45: note = hyper
  source 1..45: mol_type = genomic DNA

SEQ ID NO: 54497 - DNA, 30 bp, Homo sapiens; identical to SEQ ID NO: 10840
  misc_feature 1..30: note = chr11:43599075-43599105
  misc_feature 1..30: note = hyper
  source 1..30: mol_type = genomic DNA

SEQ ID NO: 54498 - DNA, 114 bp, Homo sapiens; identical to SEQ ID NO: 33819
  misc_feature 1..114: note = chr11:43600016-43600130
  misc_feature 1..114: note = hyper
  source 1..114: mol_type = genomic DNA

SEQ ID NO: 54499 - DNA, 537 bp, Homo sapiens
  misc_feature 1..537: note = chr11:43600557-43601094
  misc_feature 1..537: note = hyper
  source 1..537: mol_type = genomic DNA
cacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtgaccctcccacacagtacagtaacttatatacttacctggaagaacccgctttgccgccgggcaaacacccgtggggggcggggaggggccggagggagcgggccggcaggagaggggctgcttccagctggctgcagtgcggacgggaccggcgcgctcccgtggcccccagaccgaggtaaggagcagggagtcggcgcccgggt

SEQ ID NO: 54500 - DNA, 75 bp, Homo sapiens; identical to SEQ ID NO: 21040
  misc_feature 1..75: note = chr11:43602393-43602468
  misc_feature 1..75: note = hyper
  source 1..75: mol_type = genomic DNA

SEQ ID NO: 54501 - DNA, 40 bp, Homo sapiens; identical to SEQ ID NO: 3747
  misc_feature 1..40: note = chr11:43603446-43603486
  misc_feature 1..40: note = hyper
  source 1..40: mol_type = genomic DNA

SEQ ID NO: 54502 - DNA, 73 bp, Homo sapiens; identical to SEQ ID NO: 33826
  misc_feature 1..73: note = chr11:43604791-43604864
  misc_feature 1..73: note = hyper
  source 1..73: mol_type = genomic DNA

SEQ ID NO: 54503 - DNA, 31 bp, Homo sapiens; identical to SEQ ID NO: 10848
  misc_feature 1..31: note = chr11:43963534-43963565
  misc_feature 1..31: note = hyper
  source 1..31: mol_type = genomic DNA

SEQ ID NO: 54504 - DNA, 390 bp, Homo sapiens; identical to SEQ ID NO: 33828
  misc_feature 1..390: note = chr11:43963625-43964015
  misc_feature 1..390: note = hyper
  source 1..390: mol_type = genomic DNA

SEQ ID NO: 54505 - DNA, 207 bp, Homo sapiens; identical to SEQ ID NO: 33829
  misc_feature 1..207: note = chr11:43964444-43964651
  misc_feature 1..207: note = hyper
  source 1..207: mol_type = genomic DNA

SEQ ID NO: 54506 - DNA, 404 bp, Homo sapiens; identical to SEQ ID NO: 33830
  misc_feature 1..404: note = chr11:43964895-43965299
  misc_feature 1..404: note = hyper
  source 1..404: mol_type = genomic DNA

SEQ ID NO: 54507 - DNA, 371 bp, Homo sapiens; identical to SEQ ID NO: 33831
  misc_feature 1..371: note = chr11:43965690-43966061
  misc_feature 1..371: note = hyper
  source 1..371: mol_type = genomic DNA

SEQ ID NO: 54508 - DNA, 33 bp, Homo sapiens; identical to SEQ ID NO: 33832
  misc_feature 1..33: note = chr11:44324942-44324975
  misc_feature 1..33: note = hyper
  source 1..33: mol_type = genomic DNA

SEQ ID NO: 54509 - DNA, 75 bp, Homo sapiens
  misc_feature 1..75: note = chr11:44326062-44326137
  misc_feature 1..75: note = hyper
  source 1..75: mol_type = genomic DNA
ccaaggcctctgagccgcgggggctccgggcaactatccccctcctctcctggcctcaggcaccccagtccaggg

SEQ ID NO: 54510 - skipped

SEQ ID NO: 54511 - DNA, 48 bp, Homo sapiens; identical to SEQ ID NO: 33838
  misc_feature 1..48: note = chr11:44332524-44332572
  misc_feature 1..48: note = hyper
  source 1..48: mol_type = genomic DNA

SEQ ID NO: 54512 - DNA, 122 bp, Homo sapiens; identical to SEQ ID NO: 10857
  misc_feature 1..122: note = chr11:44332922-44333044
  misc_feature 1..122: note = hyper
  source 1..122: mol_type = genomic DNA

SEQ ID NO: 54513 - DNA, 45 bp, Homo sapiens; identical to SEQ ID NO: 33840
  misc_feature 1..45: note = chr11:44333583-44333628
  misc_feature 1..45: note = hyper
  source 1..45: mol_type = genomic DNA

SEQ ID NO: 54514 - DNA, 249 bp, Homo sapiens
  misc_feature 1..249: note = chr11:44338086-44338335
  misc_feature 1..249: note = hyper
  source 1..249: mol_type = genomic DNA
cgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcaca

SEQ ID NO: 54515 - DNA, 159 bp, Homo sapiens
  misc_feature 1..159: note = chr11:44338367-44338526
  misc_feature 1..159: note = hyper
  source 1..159: mol_type = genomic DNA
aagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttc

SEQ ID NO: 54516 - DNA, 52 bp, Homo sapiens; identical to SEQ ID NO: 33844
  misc_feature 1..52: note = chr11:44341230-44341282
  misc_feature 1..52: note = hyper
  source 1..52: mol_type = genomic DNA

SEQ ID NO: 54517 - DNA, 117 bp, Homo sapiens; identical to SEQ ID NO: 33846
  misc_feature 1..117: note = chr11:44748226-44748343
  misc_feature 1..117: note = hyper
  source 1..117: mol_type = genomic DNA

SEQ ID NO: 54518 - DNA, 106 bp, Homo sapiens; identical to SEQ ID NO: 33847
  misc_feature 1..106: note = chr11:44748708-44748814
  misc_feature 1..106: note = hyper
  source 1..106: mol_type = genomic DNA

SEQ ID NO: 54519 - DNA, 220 bp, Homo sapiens; identical to SEQ ID NO: 33848
  misc_feature 1..220: note = chr11:45376858-45377078
  misc_feature 1..220: note = hyper
  source 1..220: mol_type = genomic DNA

SEQ ID NO: 54520 - DNA, 75 bp, Homo sapiens; identical to SEQ ID NO: 33849
  misc_feature 1..75: note = chr11:45377121-45377196
  misc_feature 1..75: note = hyper
  source 1..75: mol_type = genomic DNA

SEQ ID NO: 54521 - DNA, 187 bp, Homo sapiens; identical to SEQ ID NO: 33850
  misc_feature 1..187: note = chr11:45686237-45686424
  misc_feature 1..187: note = hyper
  source 1..187: mol_type = genomic DNA

SEQ ID NO: 54522 - DNA, 20 bp, Homo sapiens
  misc_feature 1..20: note = chr11:45686449-45686469
  misc_feature 1..20: note = hyper
  source 1..20: mol_type = genomic DNA
cgcctcgggggccaccgcgc

SEQ ID NO: 54523 - DNA, 66 bp, Homo sapiens; identical to SEQ ID NO: 33852
  misc_feature 1..66: note = chr11:45686717-45686783
  misc_feature 1..66: note = hyper
  source 1..66: mol_type = genomic DNA

SEQ ID NO: 54524 - DNA, 119 bp, Homo sapiens; identical to SEQ ID NO: 33853
  misc_feature 1..119: note = chr11:46259315-46259434
  misc_feature 1..119: note = hyper
  source 1..119: mol_type = genomic DNA

SEQ ID NO: 54525 - DNA, 67 bp, Homo sapiens; identical to SEQ ID NO: 33854
  misc_feature 1..67: note = chr11:46299747-46299814
  misc_feature 1..67: note = hyper
  source 1..67: mol_type = genomic DNA

SEQ ID NO: 54526 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 54527 - DNA, 17 bp, Homo sapiens
  misc_feature 1..17: note = chr11:46317680-46317697
  misc_feature 1..17: note = hyper
  source 1..17: mol_type = genomic DNA
gccgaccccttgctctt

SEQ ID NO: 54528 - DNA, 128 bp, Homo sapiens; identical to SEQ ID NO: 33858
  misc_feature 1..128: note = chr11:46354365-46354493
  misc_feature 1..128: note = hyper
  source 1..128: mol_type = genomic DNA

SEQ ID NO: 54529 - DNA, 165 bp, Homo sapiens; identical to SEQ ID NO: 33859
  misc_feature 1..165: note = chr11:46354770-46354935
  misc_feature 1..165: note = hyper
  source 1..165: mol_type = genomic DNA

SEQ ID NO: 54530 - DNA, 30 bp, Homo sapiens; identical to SEQ ID NO: 33860
  misc_feature 1..30: note = chr11:46404027-46404057
  misc_feature 1..30: note = hyper
  source 1..30: mol_type = genomic DNA

SEQ ID NO: 54531 - DNA, 137 bp, Homo sapiens; identical to SEQ ID NO: 10866
  misc_feature 1..137: note = chr11:46414563-46414700
  misc_feature 1..137: note = hyper
  source 1..137: mol_type = genomic DNA

SEQ ID NO: 54532 - DNA, 635 bp, Homo sapiens; identical to SEQ ID NO: 33862
  misc_feature 1..635: note = chr11:46938439-46939074
  misc_feature 1..635: note = hyper
  source 1..635: mol_type = genomic DNA

SEQ ID NO: 54533 - DNA, 369 bp, Homo sapiens
  misc_feature 1..369: note = chr11:47208675-47209044
  misc_feature 1..369: note = hyper
  source 1..369: mol_type = genomic DNA
tacatttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagagga

SEQ ID NO: 54534 - DNA, 91 bp, Homo sapiens
  misc_feature 1..91: note = chr11:47209189-47209280
  misc_feature 1..91: note = hyper
  source 1..91: mol_type = genomic DNA
tagcaaaattatgttgtttctaaatccaggaggaatcactgacgcgttctttacgcagatgaatccgctcacaaaacgggaaagggacctg

SEQ ID NO: 54535 - DNA, 174 bp, Homo sapiens; identical to SEQ ID NO: 33864
  misc_feature 1..174: note = chr11:47615713-47615887
  misc_feature 1..174: note = hyper
  source 1..174: mol_type = genomic DNA

SEQ ID NO: 54536 - DNA, 60 bp, Homo sapiens; identical to SEQ ID NO: 33865
  misc_feature 1..60: note = chr11:49229810-49229870
  misc_feature 1..60: note = hyper
  source 1..60: mol_type = genomic DNA

SEQ ID NO: 54537 - DNA, 177 bp, Homo sapiens; identical to SEQ ID NO: 21057
  misc_feature 1..177: note = chr11:57194178-57194355
  misc_feature 1..177: note = hyper
  source 1..177: mol_type = genomic DNA

SEQ ID NO: 54538 - DNA, 225 bp, Homo sapiens
  misc_feature 1..225: note = chr11:57194509-57194734
  misc_feature 1..225: note = hyper
  source 1..225: mol_type = genomic DNA
cccgaaaggggacccttcgccctacccgcctgctccgcgccggggctctccgcgccctttccgcacgggccaggttcgcattcgcgcctctcgcagcccctcccagtcccctgctcgcctccgccccctcctgcccgcccggaaggggctggggcagacctcccactctccatcacttccttcttcttttcccttgctcacagcctcccgcgccctttttacctc

SEQ ID NO: 54539 - DNA, 30 bp, Homo sapiens; identical to SEQ ID NO: 33867
  misc_feature 1..30: note = chr11:57243673-57243703
  misc_feature 1..30: note = hyper
  source 1..30: mol_type = genomic DNA

SEQ ID NO: 54540 - DNA, 150 bp, Homo sapiens; identical to SEQ ID NO: 33868
  misc_feature 1..150: note = chr11:58668329-58668479
  misc_feature 1..150: note = hyper
  source 1..150: mol_type = genomic DNA

SEQ ID NO: 54541 - DNA, 46 bp, Homo sapiens
  misc_feature 1..46: note = chr11:58672700-58672746
  misc_feature 1..46: note = hyper
  source 1..46: mol_type = genomic DNA
tcgccagcccctccacgaagttggatcatttgcggagcaggccaag

SEQ ID NO: 54542 - DNA, 103 bp, Homo sapiens; identical to SEQ ID NO: 21060
  misc_feature 1..103: note = chr11:58673064-58673167
  misc_feature 1..103: note = hyper
  source 1..103: mol_type = genomic DNA

SEQ ID NO: 54543 - DNA, 80 bp, Homo sapiens; identical to SEQ ID NO: 3759
  misc_feature 1..80: note = chr11:58673168-58673248
  misc_feature 1..80: note = hyper
  source 1..80: mol_type = genomic DNA

SEQ ID NO: 54544 - DNA, 53 bp, Homo sapiens; identical to SEQ ID NO: 33871
  misc_feature 1..53: note = chr11:59318986-59319039
  misc_feature 1..53: note = hyper
  source 1..53: mol_type = genomic DNA

SEQ ID NO: 54545 - DNA, 69 bp, Homo sapiens
  misc_feature 1..69: note = chr11:59333336-59333405
  misc_feature 1..69: note = hyper
  source 1..69: mol_type = genomic DNA
ccccggtccttgttacggtttaaaaagctggacaaagcccgtgcgccgaacgctttcgaggacttcttt

SEQ ID NO: 54546 - DNA, 36 bp, Homo sapiens
  misc_feature 1..36: note = chr11:59333541-59333577
  misc_feature 1..36: note = hyper
  source 1..36: mol_type = genomic DNA
cgaaagaagaggagcggggtgcggggacacagggtt

SEQ ID NO: 54547 - skipped

SEQ ID NO: 54548 - DNA, 84 bp, Homo sapiens
  misc_feature 1..84: note = chr11:61062738-61062822
  misc_feature 1..84: note = hyper
  source 1..84: mol_type = genomic DNA
aacacacaaaggcaacgccgcccgcctgctgatgcctctccgagaggcgcggagcccggggcgggggcaaagatcagggacccc

SEQ ID NO: 54549 - DNA, 20 bp, Homo sapiens
  misc_feature 1..20: note = chr11:61063138-61063158
  misc_feature 1..20: note = hyper
  source 1..20: mol_type = genomic DNA
ccaaccgctccctggcctgg

SEQ ID NO: 54550 - DNA, 73 bp, Homo sapiens; identical to SEQ ID NO: 33877
  misc_feature 1..73: note = chr11:61276431-61276504
  misc_feature 1..73: note = hyper
  source 1..73: mol_type = genomic DNA

SEQ ID NO: 54551 - DNA, 467 bp, Homo sapiens
  misc_feature 1..467: note = chr11:61276535-61277002
  misc_feature 1..467: note = hyper
  source 1..467: mol_type = genomic DNA
cgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgc

SEQ ID NO: 54552 - DNA, 15 bp, Homo sapiens
  misc_feature 1..15: note = chr11:61277327-61277342
  misc_feature 1..15: note = hyper
  source 1..15: mol_type = genomic DNA
cgctccaggactggg

SEQ ID NO: 54553 - DNA, 38 bp, Homo sapiens; identical to SEQ ID NO: 33880
  misc_feature 1..38: note = chr11:61334835-61334873
  misc_feature 1..38: note = hyper
  source 1..38: mol_type = genomic DNA

SEQ ID NO: 54554 - DNA, 213 bp, Homo sapiens; identical to SEQ ID NO: 33881
  misc_feature 1..213: note = chr11:61335097-61335310
  misc_feature 1..213: note = hyper
  source 1..213: mol_type = genomic DNA

SEQ ID NO: 54555 - DNA, 72 bp, Homo sapiens; identical to SEQ ID NO: 33882
  misc_feature 1..72: note = chr11:61582570-61582642
  misc_feature 1..72: note = hyper
  source 1..72: mol_type = genomic DNA

SEQ ID NO: 54556 - DNA, 310 bp, Homo sapiens; identical to SEQ ID NO: 33883
  misc_feature 1..310: note = chr11:61583252-61583562
  misc_feature 1..310: note = hyper
  source 1..310: mol_type = genomic DNA

SEQ ID NO: 54557 - DNA, 105 bp, Homo sapiens
  misc_feature 1..105: note = chr11:61594981-61595086
  misc_feature 1..105: note = hyper
  source 1..105: mol_type = genomic DNA
gaggttgcagaaaggcgccagaatgtggatggcgcggacaatgtgggatactggagtctcgactgccgcgcgccaaggaagggcgtcacctagccaagccggccc

SEQ ID NO: 54558 - DNA, 217 bp, Homo sapiens
  misc_feature 1..217: note = chr11:61595262-61595479
  misc_feature 1..217: note = hyper
  source 1..217: mol_type = genomic DNA
gatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcg

SEQ ID NO: 54559 - DNA, 300 bp, Homo sapiens; identical to SEQ ID NO: 21070
  misc_feature 1..300: note = chr11:61596120-61596420
  misc_feature 1..300: note = hyper
  source 1..300: mol_type = genomic DNA

SEQ ID NO: 54560 - DNA, 137 bp, Homo sapiens; identical to SEQ ID NO: 33886
  misc_feature 1..137: note = chr11:61722850-61722987
  misc_feature 1..137: note = hyper
  source 1..137: mol_type = genomic DNA

SEQ ID NO: 54561 - DNA, 34 bp, Homo sapiens; identical to SEQ ID NO: 33887
  misc_feature 1..34: note = chr11:61793162-61793196
  misc_feature 1..34: note = hyper
  source 1..34: mol_type = genomic DNA

SEQ ID NO: 54562 - DNA, 77 bp, Homo sapiens; identical to SEQ ID NO: 33888
  misc_feature 1..77: note = chr11:63258635-63258712
  misc_feature 1..77: note = hyper
  source 1..77: mol_type = genomic DNA

SEQ ID NO: 54563 - DNA, 30 bp, Homo sapiens; identical to SEQ ID NO: 33889
  misc_feature 1..30: note = chr11:63537177-63537207
  misc_feature 1..30: note = hyper
  source 1..30: mol_type = genomic DNA

SEQ ID NO: 54564 - DNA, 14 bp, Homo sapiens
  misc_feature 1..14: note = chr11:63768254-63768268
  misc_feature 1..14: note = hyper
  source 1..14: mol_type = genomic DNA
gggcctcagcgtcg

SEQ ID NO: 54565 - DNA, 180 bp, Homo sapiens; identical to SEQ ID NO: 33891
  misc_feature 1..180: note = chr11:63803518-63803698
  misc_feature 1..180: note = hyper
  source 1..180: mol_type = genomic DNA

SEQ ID NO: 54566 - DNA, 60 bp, Homo sapiens; identical to SEQ ID NO: 33892
  misc_feature 1..60: note = chr11:64058891-64058951
  misc_feature 1..60: note = hyper
  source 1..60: mol_type = genomic DNA

SEQ ID NO: 54567 - DNA, 216 bp, Homo sapiens; identical to SEQ ID NO: 33893
  misc_feature 1..216: note = chr11:64059895-64060111
  misc_feature 1..216: note = hyper
  source 1..216: mol_type = genomic DNA

SEQ ID NO: 54568 - DNA, 33 bp, Homo sapiens; identical to SEQ ID NO: 33894
  misc_feature 1..33: note = chr11:64060160-64060193
  misc_feature 1..33: note = hyper
  source 1..33: mol_type = genomic DNA

SEQ ID NO: 54569 - DNA, 363 bp, Homo sapiens; identical to SEQ ID NO: 33895
  misc_feature 1..363: note = chr11:64066842-64067205
  misc_feature 1..363: note = hyper
  source 1..363: mol_type = genomic DNA

SEQ ID NO: 54570 - DNA, 229 bp, Homo sapiens; identical to SEQ ID NO: 33896
  misc_feature 1..229: note = chr11:64409956-64410185
  misc_feature 1..229: note = hyper
  source 1..229: mol_type = genomic DNA

SEQ ID NO: 54571 - DNA, 233 bp, Homo sapiens; identical to SEQ ID NO: 33897
  misc_feature 1..233: note = chr11:64410203-64410436
  misc_feature 1..233: note = hyper
  source 1..233: mol_type = genomic DNA

SEQ ID NO: 54572 - DNA, 45 bp, Homo sapiens
  misc_feature 1..45: note = chr11:64410678-64410723
  misc_feature 1..45: note = hyper
  source 1..45: mol_type = genomic DNA
agctggggagcggggcggtgcgggctggaggagagaagagggacg

SEQ ID NO: 54573 - DNA, 196 bp, Homo sapiens; identical to SEQ ID NO: 33899
  misc_feature 1..196: note = chr11:64478789-64478985
  misc_feature 1..196: note = hyper
  source 1..196: mol_type = genomic DNA

SEQ ID NO: 54574 - DNA, 78 bp, Homo sapiens; identical to SEQ ID NO: 33900
  misc_feature 1..78: note = chr11:64480253-64480331
  misc_feature 1..78: note = hyper
  source 1..78: mol_type = genomic DNA

SEQ ID NO: 54575 - DNA, 50 bp, Homo sapiens; identical to SEQ ID NO: 21077
  misc_feature 1..50: note = chr11:64480379-64480429
  misc_feature 1..50: note = hyper
  source 1..50: mol_type = genomic DNA

SEQ ID NO: 54576 - DNA, 231 bp, Homo sapiens; identical to SEQ ID NO: 21078
  misc_feature 1..231: note = chr11:64480593-64480824
  misc_feature 1..231: note = hyper
  source 1..231: mol_type = genomic DNA

SEQ ID NO: 54577 - DNA, 182 bp, Homo sapiens
  misc_feature 1..182: note = chr11:64481042-64481224
  misc_feature 1..182: note = hyper
  source 1..182: mol_type = genomic DNA
gcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcaga

SEQ ID NO: 54578 - DNA, 129 bp, Homo sapiens; identical to SEQ ID NO: 33902
  misc_feature 1..129: note = chr11:64511955-64512084
  misc_feature 1..129: note = hyper
  source 1..129: mol_type = genomic DNA

SEQ ID NO: 54579 - DNA, 405 bp, Homo sapiens; identical to SEQ ID NO: 33903
  misc_feature 1..405: note = chr11:64512898-64513303
  misc_feature 1..405: note = hyper
  source 1..405: mol_type = genomic DNA

SEQ ID NO: 54580 - DNA, 233 bp, Homo sapiens; identical to SEQ ID NO: 33904
  misc_feature 1..233: note = chr11:64513515-64513748
  misc_feature 1..233: note = hyper
  source 1..233: mol_type = genomic DNA

SEQ ID NO: 54581 - DNA, 180 bp, Homo sapiens
  misc_feature 1..180: note = chr11:64739288-64739468
  misc_feature 1..180: note = hyper
  source 1..180: mol_type = genomic DNA
agaaataaacagaaacgcaaagacaacttcccgagggcccgggccgtcgtgtgccgttacctcagccccaggtggttcccaggctcggccaggctatgtctcacacactgactaggggtccttcggcctcagaaaagtggccccggacggaatacccactaagaagtgctctctgaaaaa

SEQ ID NO: 54582 - DNA, 255 bp, Homo sapiens
  misc_feature 1..255: note = chr11:64739508-64739763
  misc_feature 1..255: note = hyper
  source 1..255: mol_type = genomic DNA
gctcgccagctcctaagcaacttcggggctcgtgccgcgcacccaccaggccttctgcgcacgcgcaagtgcgcttcccaccgccccttcgggcgcagctccaaggcctggccgcggtctgcgcgtgcgcatttcattgtcgacaccgagaggacgccttggcgccttcaggtccctcctggatttaccagcccattgtttatttcgcgcctgctttagcgtggtgtcgtcgggaactagcgactgcagagtcct

SEQ ID NO: 54583 - DNA, 30 bp, Homo sapiens; identical to SEQ ID NO: 10894
  misc_feature 1..30: note = chr11:65185213-65185243
  misc_feature 1..30: note = hyper
  source 1..30: mol_type = genomic DNA

SEQ ID NO: 54584 - DNA, 81 bp, Homo sapiens
  misc_feature 1..81: note = chr11:65185467-65185548
  misc_feature 1..81: note = hyper
  source 1..81: mol_type = genomic DNA
gagtgctcaggaggacgggggaccaaggcctggggtaaggggcaggtgcccaggcactctagcatggcacggaacagggga

SEQ ID NO: 54585 - DNA, 190 bp, Homo sapiens; identical to SEQ ID NO: 33908
  misc_feature 1..190: note = chr11:65197700-65197890
  misc_feature 1..190: note = hyper
  source 1..190: mol_type = genomic DNA

SEQ ID NO: 54586 - DNA, 61 bp, Homo sapiens
  misc_feature 1..61: note = chr11:65600749-65600810
  misc_feature 1..61: note = hyper
  source 1..61: mol_type = genomic DNA
ccccaggttttctctcgcagcatcggcacccccttgcagccccgctccagtggcgaccgtt

SEQ ID NO: 54587 - DNA, 17 bp, Homo sapiens
  misc_feature 1..17: note = chr11:65601640-65601657
  misc_feature 1..17: note = hyper
  source 1..17: mol_type = genomic DNA
tgcggtggtgtgtgtgt

SEQ ID NO: 54588 - DNA, 34 bp, Homo sapiens; identical to SEQ ID NO: 33911
  misc_feature 1..34: note = chr11:65640238-65640272
  misc_feature 1..34: note = hyper
  source 1..34: mol_type = genomic DNA

SEQ ID NO: 54589 - DNA, 138 bp, Homo sapiens
  misc_feature 1..138: note = chr11:65816564-65816702
  misc_feature 1..138: note = hyper
  source 1..138: mol_type = genomic DNA
gtccgagggtgcccggggccctgcgcgccgagtgccggtggcttgcctctcagcgcctggatgggatcaggtggcagcgtccgctaggctcgctcctcccggctctgcccgccccccgccccccgccccccatcgcac

SEQ ID NO: 54590 - DNA, 44 bp, Homo sapiens; identical to SEQ ID NO: 33914
  misc_feature 1..44: note = chr11:66186333-66186377
  misc_feature 1..44: note = hyper
  source 1..44: mol_type = genomic DNA

SEQ ID NO: 54591 - DNA, 93 bp, Homo sapiens; identical to SEQ ID NO: 33915
  misc_feature 1..93: note = chr11:66187374-66187467
  misc_feature 1..93: note = hyper
  source 1..93: mol_type = genomic DNA

SEQ ID NO: 54592 - DNA, 20 bp, Homo sapiens
  misc_feature 1..20: note = chr11:66188095-66188115
  misc_feature 1..20: note = hyper
  source 1..20: mol_type = genomic DNA
aattagtgtcagtgccggcc

SEQ ID NO: 54593 - DNA, 328 bp, Homo sapiens
  misc_feature 1..328: note = chr11:66188145-66188473
  misc_feature 1..328: note = hyper
  source 1..328: mol_type = genomic DNA
ggcttcaggccgccctaaacctggccctgtcgcttccctcaactgaacgcattcagacgccagggtccccacactccattcaagctttcctaacgcagcgccttcctctccgctcagctcccgccaggcttggccccctccgcagcctcctgctcccccctcgcccgcctccctccctctctcattctacgtcatgagatgacgtcggaagccgggcgggaggaggagcccccctccccagtcagcggctcccgctgcagcttgcttagcccagcctcccgctctcccgcccccccggctctaaaacgagccccccacgcctggcagg

SEQ ID NO: 54594 - DNA, 135 bp, Homo sapiens; identical to SEQ ID NO: 21089
  misc_feature 1..135: note = chr11:66188974-66189109
  misc_feature 1..135: note = hyper
  source 1..135: mol_type = genomic DNA

SEQ ID NO: 54595 - DNA, 51 bp, Homo sapiens; identical to SEQ ID NO: 33919
  misc_feature 1..51: note = chr11:66726274-66726325
  misc_feature 1..51: note = hyper
  source 1..51: mol_type = genomic DNA

SEQ ID NO: 54596 - DNA, 211 bp, Homo sapiens; identical to SEQ ID NO: 33920
  misc_feature 1..211: note = chr11:66790706-66790917
  misc_feature 1..211: note = hyper
  source 1..211: mol_type = genomic DNA

SEQ ID NO: 54597 - DNA, 30 bp, Homo sapiens; identical to SEQ ID NO: 33921
  misc_feature 1..30: note = chr11:66791312-66791342
  misc_feature 1..30: note = hyper
  source 1..30: mol_type = genomic DNA

SEQ ID NO: 54598 - DNA, 32 bp, Homo sapiens; identical to SEQ ID NO: 33922
  misc_feature 1..32: note = chr11:67232123-67232155
  misc_feature 1..32: note = hyper
  source 1..32: mol_type = genomic DNA

SEQ ID NO: 54599 - DNA, 468 bp, Homo sapiens; identical to SEQ ID NO: 33923
  misc_feature 1..468: note = chr11:67478815-67479283
  misc_feature 1..468: note = hyper
  source 1..468: mol_type = genomic DNA

SEQ ID NO: 54600 - DNA, 373 bp, Homo sapiens; identical to SEQ ID NO: 33924
  misc_feature 1..373: note = chr11:67895795-67896168
  misc_feature 1..373: note = hyper
  source 1..373: mol_type = genomic DNA

SEQ ID NO: 54601 - DNA, 371 bp, Homo sapiens; identical to SEQ ID NO: 33925
  misc_feature 1..371: note = chr11:68451833-68452204
  misc_feature 1..371: note = hyper
  source 1..371: mol_type = genomic DNA

SEQ ID NO: 54602 - DNA, 38 bp, Homo sapiens; identical to SEQ ID NO: 33926
  misc_feature 1..38: note = chr11:68452502-68452540
  misc_feature 1..38: note = hyper
  source 1..38: mol_type = genomic DNA

SEQ ID NO: 54603 - DNA, 41 bp, Homo sapiens; identical to SEQ ID NO: 33927
  misc_feature 1..41: note = chr11:68607302-68607343
  misc_feature 1..41: note = hyper
  source 1..41: mol_type = genomic DNA

SEQ ID NO: 54604 - DNA, 43 bp, Homo sapiens; identical to SEQ ID NO: 33928
  misc_feature 1..43: note = chr11:69452211-69452254
  misc_feature 1..43: note = hyper
  source 1..43: mol_type = genomic DNA

SEQ ID NO: 54605 - DNA, 30 bp, Homo sapiens; identical to SEQ ID NO: 33929
  misc_feature 1..30: note = chr11:69452718-69452748
  misc_feature 1..30: note = hyper
  source 1..30: mol_type = genomic DNA

SEQ ID NO: 54606 - DNA, 59 bp, Homo sapiens; identical to SEQ ID NO: 33930
  misc_feature 1..59: note = chr11:69453263-69453322
  misc_feature 1..59: note = hyper
  source 1..59: mol_type = genomic DNA

SEQ ID NO: 54607 - DNA, 262 bp, Homo sapiens
  misc_feature 1..262: note = chr11:69517174-69517436
  misc_feature 1..262: note = hyper
  source 1..262: mol_type = genomic DNA
tccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacaggtgaggcccgcaggaggaaaagc

SEQ ID NO: 54608 - DNA, 55 bp, Homo sapiens; identical to SEQ ID NO: 33932
  misc_feature 1..55: note = chr11:69517954-69518009
  misc_feature 1..55: note = hyper
  source 1..55: mol_type = genomic DNA

SEQ ID NO: 54609 - DNA, 319 bp, Homo sapiens
  misc_feature 1..319: note = chr11:69518211-69518530
  misc_feature 1..319: note = hyper
  source 1..319: mol_type = genomic DNA
tgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgcc

SEQ ID NO: 54610 - DNA, 37 bp, Homo sapiens; identical to SEQ ID NO: 33934
  misc_feature 1..37: note = chr11:69519059-69519096
  misc_feature 1..37: note = hyper
  source 1..37: mol_type = genomic DNA

SEQ ID NO: 54611 - DNA, 243 bp, Homo sapiens; identical to SEQ ID NO: 33935
  misc_feature 1..243: note = chr11:69519374-69519617
  misc_feature 1..243: note = hyper
  source 1..243: mol_type = genomic DNA

SEQ ID NO: 54612 - DNA, 43 bp, Homo sapiens
  misc_feature 1..43: note = chr11:69588887-69588930
  misc_feature 1..43: note = hyper
  source 1..43: mol_type = genomic DNA
cagcaggcctgggggcggggcgcaggtcattgcggggcaggtg

SEQ ID NO: 54613 - DNA, 100 bp, Homo sapiens; identical to SEQ ID NO: 10910
  misc_feature 1..100: note = chr11:69589407-69589507
  misc_feature 1..100: note = hyper
  source 1..100: mol_type = genomic DNA

SEQ ID NO: 54614 - DNA, 259 bp, Homo sapiens; identical to SEQ ID NO: 21098
  misc_feature 1..259: note = chr11:69589854-69590113
  misc_feature 1..259: note = hyper
  source 1..259: mol_type = genomic DNA

SEQ ID NO: 54615 - DNA, 35 bp, Homo sapiens; identical to SEQ ID NO: 21099
  misc_feature 1..35: note = chr11:69590114-69590149
  misc_feature 1..35: note = hyper
  source 1..35: mol_type = genomic DNA

SEQ ID NO: 54616 - DNA, 413 bp, Homo sapiens
  misc_feature 1..413: note = chr11:69590222-69590635
  misc_feature 1..413: note = hyper
  source 1..413: mol_type = genomic DNA
ggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacgggaacttggttcctttgctggggccttgaggaccggcctgggaaggaggggtggataagagcagtaagcgacaccggggcctggctggg

SEQ ID NO: 54617 - DNA, 54 bp, Homo sapiens; identical to SEQ ID NO: 33940
  misc_feature 1..54: note = chr11:71274712-71274766
  misc_feature 1..54: note = hyper
  source 1..54: mol_type = genomic DNA

SEQ ID NO: 54618 - DNA, 58 bp, Homo sapiens
  misc_feature 1..58: note = chr11:71318274-71318332
  misc_feature 1..58: note = hyper
  source 1..58: mol_type = genomic DNA
taggcggggaaggtgcggggcgaggcggccgcggctccctggcatccctctccttacc

SEQ ID NO: 54619 - DNA, 51 bp, Homo sapiens; identical to SEQ ID NO: 21102
  misc_feature 1..51: note = chr11:71318967-71319018
  misc_feature 1..51: note = hyper
  source 1..51: mol_type = genomic DNA

SEQ ID NO: 54620 - DNA, 88 bp, Homo sapiens; identical to SEQ ID NO: 33943
  misc_feature 1..88: note = chr11:71951172-71951260
  misc_feature 1..88: note = hyper
  source 1..88: mol_type = genomic DNA

SEQ ID NO: 54621 - DNA, 56 bp, Homo sapiens; identical to SEQ ID NO: 21103
  misc_feature 1..56: note = chr11:71951583-71951639
  misc_feature 1..56: note = hyper
  source 1..56: mol_type = genomic DNA

SEQ ID NO: 54622 - DNA, 205 bp, Homo sapiens
  misc_feature 1..205: note = chr11:71952135-71952340
  misc_feature 1..205: note = hyper
  source 1..205: mol_type = genomic DNA
atacacgcacctgcacgcgagcctcagtgaggtcgatcttgagcgccagctcctcacgcgtgtaaatgtcggggtagtgggtctcagcgaaaacgcgctccagctccttgagctgcgcgctggtgaacgtggtgcggatgcgccgctgcttgcgcttctcgtgcaggccggatggctctgggaagaacttgtagggcactgcggg

SEQ ID NO: 54623 - DNA, 19 bp, Homo sapiens
  misc_feature 1..19: note = chr11:71954593-71954612
  misc_feature 1..19: note = hyper
  source 1..19: mol_type = genomic DNA
ttgacctgaagggcacgag

SEQ ID NO: 54624 - DNA, 182 bp, Homo sapiens
  misc_feature 1..182: note = chr11:71954642-71954824
  misc_feature 1..182: note = hyper
  source 1..182: mol_type = genomic DNA
ggagagatgagagggtgaggctcattcctgcggaggagaacctcgtattctgggggtctctcggggcattggagggtctggccaaggcaggaatgggggcggctgagggggacagtcgcattcacttggcgagcgggcccagggattctgcaggaattggagggagggttgggccggggctg

SEQ ID NO: 54625 - DNA, 57 bp, Homo sapiens; identical to SEQ ID NO: 33948
  misc_feature 1..57: note = chr11:71955068-71955125
  misc_feature 1..57: note = hyper
  source 1..57: mol_type = genomic DNA

SEQ ID NO: 54626 - DNA, 155 bp, Homo sapiens
  misc_feature 1..155: note = chr11:71955189-71955344
  misc_feature 1..155: note = hyper
  source 1..155: mol_type = genomic DNA
cggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgaccccc

SEQ ID NO: 54627 - DNA, 76 bp, Homo sapiens
  misc_feature 1..76: note = chr11:71955377-71955453
  misc_feature 1..76: note = hyper
  source 1..76: mol_type = genomic DNA
cagaggtgtggagctgggatgcgcgggaccctatccccggagtccctatcctgccccaatccggaccagaccttcg

SEQ ID NO: 54628 - DNA, 56 bp, Homo sapiens; identical to SEQ ID NO: 33950
  misc_feature 1..56: note = chr11:71955705-71955761
  misc_feature 1..56: note = hyper
  source 1..56: mol_type = genomic DNA

SEQ ID NO: 54629 - DNA, 37 bp, Homo sapiens; identical to SEQ ID NO: 21107
  misc_feature 1..37: note = chr11:71956340-71956377
  misc_feature 1..37: note = hyper
  source 1..37: mol_type = genomic DNA

SEQ ID NO: 54630 - DNA, 30 bp, Homo sapiens; identical to SEQ ID NO: 33952
  misc_feature 1..30: note = chr11:72388069-72388099
  misc_feature 1..30: note = hyper
  source 1..30: mol_type = genomic DNA

SEQ ID NO: 54631 - DNA, 243 bp, Homo sapiens
  misc_feature 1..243: note = chr11:72432916-72433159
  misc_feature 1..243: note = hyper
  source 1..243: mol_type = genomic DNA
ggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggtttttgagcccaggtatggctttgcacctgtgatttatgtctttaagtgtttgtgaatcacttctctacgtgcgtgtgtgtttgttt

SEQ ID NO: 54632 - DNA, 30 bp, Homo sapiens; identical to SEQ ID NO: 33954
  misc_feature 1..30: note = chr11:72929613-72929643
  misc_feature 1..30: note = hyper
  source 1..30: mol_type = genomic DNA

SEQ ID NO: 54633 - DNA, 109 bp, Homo sapiens; identical to SEQ ID NO: 33955
  misc_feature 1..109: note = chr11:73019882-73019991
  misc_feature 1..109: note = hyper
  source 1..109: mol_type = genomic DNA

SEQ ID NO: 54634 - DNA, 36 bp, Homo sapiens; identical to SEQ ID NO: 33956
  misc_feature 1..36: note = chr11:74178590-74178626
  misc_feature 1..36: note = hyper
  source 1..36: mol_type = genomic DNA

SEQ ID NO: 54635 - DNA, 96 bp, Homo sapiens
  misc_feature 1..96: note = chr11:74394395-74394491
  misc_feature 1..96: note = hyper
  source 1..96: mol_type = genomic DNA
ggtggccctgggtagcgagcgcggccgggcgggcgccgtggcctcaggggccctccccgggctgggcacccccacgccgcccgggcactgctcgcg

SEQ ID NO: 54636 - DNA, 167 bp, Homo sapiens; identical to SEQ ID NO: 33958
  misc_feature 1..167: note = chr11:74441835-74442002
  misc_feature 1..167: note = hyper
  source 1..167: mol_type = genomic DNA

SEQ ID NO: 54637 - DNA, 388 bp, Homo sapiens; identical to SEQ ID NO: 10923
  misc_feature 1..388: note = chr11:74442255-74442643
  misc_feature 1..388: note = hyper
  source 1..388: mol_type = genomic DNA

SEQ ID NO: 54638 - DNA, 136 bp, Homo sapiens; identical to SEQ ID NO: 33960
  misc_feature 1..136: note = chr11:74442705-74442841
  misc_feature 1..136: note = hyper
  source 1..136: mol_type = genomic DNA

SEQ ID NO: 54639 - DNA, 103 bp, Homo sapiens; identical to SEQ ID NO: 33961
  misc_feature 1..103: note = chr11:74951674-74951777
  misc_feature 1..103: note = hyper
  source 1..103: mol_type = genomic DNA

SEQ ID NO: 54640 - DNA, 303 bp, Homo sapiens; identical to SEQ ID NO: 33962
  misc_feature 1..303: note = chr11:74952123-74952426
  misc_feature 1..303: note = hyper
  source 1..303: mol_type = genomic DNA

SEQ ID NO: 54641 - skipped

SEQ ID NO: 54642 - DNA, 242 bp, Homo sapiens; identical to SEQ ID NO: 33964
  misc_feature 1..242: note = chr11:74952948-74953190
  misc_feature 1..242: note = hyper
  source 1..242: mol_type = genomic DNA

SEQ ID NO: 54643 - DNA, 313 bp, Homo sapiens; identical to SEQ ID NO: 33965
  misc_feature 1..313: note = chr11:75141346-75141659
  misc_feature 1..313: note = hyper
  source 1..313: mol_type = genomic DNA

SEQ ID NO: 54644 - DNA, 247 bp, Homo sapiens; identical to SEQ ID NO: 33966
  misc_feature 1..247: note = chr11:75294375-75294622
  misc_feature 1..247: note = hyper
  source 1..247: mol_type = genomic DNA

SEQ ID NO: 54645 - DNA, 75 bp, Homo sapiens; identical to SEQ ID NO: 33967
  misc_feature 1..75: note = chr11:75294662-75294737
  misc_feature 1..75: note = hyper
  source 1..75: mol_type = genomic DNA

SEQ ID NO: 54646 - DNA, 848 bp, Homo sapiens; identical to SEQ ID NO: 33968
  misc_feature 1..848: note = chr11:75378401-75379249
  misc_feature 1..848: note = hyper
  source 1..848: mol_type = genomic DNA

SEQ ID NO: 54647 - DNA, 190 bp, Homo sapiens
  misc_feature 1..190: note = chr11:75379895-75380085
  misc_feature 1..190: note = hyper
  source 1..190: mol_type = genomic DNA
gctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgc

SEQ ID NO: 54648 - DNA, 358 bp, Homo sapiens; identical to SEQ ID NO: 33970
  misc_feature 1..358: note = chr11:75863301-75863659
  misc_feature 1..358: note = hyper
  source 1..358: mol_type = genomic DNA

SEQ ID NO: 54649 - DNA, 218 bp, Homo sapiens; identical to SEQ ID NO: 33971
  misc_feature 1..218: note = chr11:76032896-76033114
  misc_feature 1..218: note = hyper
  source 1..218: mol_type = genomic DNA

SEQ ID NO: 54650 - DNA, 127 bp, Homo sapiens; identical to SEQ ID NO: 33972
  misc_feature 1..127: note = chr11:76382096-76382223
  misc_feature 1..127: note = hyper
  source 1..127: mol_type = genomic DNA

SEQ ID NO: 54651 - DNA, 26 bp, Homo sapiens
  misc_feature 1..26: note = chr11:78672891-78672917
  misc_feature 1..26: note = hyper
  source 1..26: mol_type = genomic DNA
ctgatgtttccttctcgtgatgtctg

SEQ ID NO: 54652 - DNA, 354 bp, Homo sapiens
  misc_feature 1..354: note = chr11:78672964-78673318
  misc_feature 1..354: note = hyper
  source 1..354: mol_type = genomic DNA
gggttggggacagaagcagccctccaactcttgcacactccagcggcgccgcggggcaagagcggggctgcctgagcccgcggagccacgtcaggcccccagctcccccggatcccaccacgcaccaggcccctccgcccggcaagtggcccaagcaggcatccgcaacggaaggacaattttaaaaacaaaccctcaaaagtaggaagagagagggacttaccgttcgccgcgacccccaggctggcggagccacttttaactaagaatgaattagggacaaactcttcctcagagtctgagtccggggttggctgggccacaccgttgcctagcaaccgcctctggctctca

SEQ ID NO: 54653 - DNA, 66 bp, Homo sapiens; identical to SEQ ID NO: 33974
  misc_feature 1..66: note = chr11:79148413-79148479
  misc_feature 1..66: note = hyper
  source 1..66: mol_type = genomic DNA

SEQ ID NO: 54654 - DNA, 142 bp, Homo sapiens; identical to SEQ ID NO: 10935
  misc_feature 1..142: note = chr11:79148873-79149015
  misc_feature 1..142: note = hyper
  source 1..142: mol_type = genomic DNA

SEQ ID NO: 54655 - DNA, 479 bp, Homo sapiens; identical to SEQ ID NO: 33976
  misc_feature 1..479: note = chr11:79149239-79149718
  misc_feature 1..479: note = hyper
  source 1..479: mol_type = genomic DNA

SEQ ID NO: 54656 - DNA, 141 bp, Homo sapiens; identical to SEQ ID NO: 33977
  misc_feature 1..141: note = chr11:79149929-79150070
  misc_feature 1..141: note = hyper
  source 1..141: mol_type = genomic DNA

SEQ ID NO: 54657 - DNA, 47 bp, Homo sapiens; identical to SEQ ID NO: 33978
  misc_feature 1..47: note = chr11:79150289-79150336
  misc_feature 1..47: note = hyper
  source 1..47: mol_type = genomic DNA

SEQ ID NO: 54658 - DNA, 180 bp, Homo sapiens; identical to SEQ ID NO: 33979
  misc_feature 1..180: note = chr11:79150890-79151070
  misc_feature 1..180: note = hyper
  source 1..180: mol_type = genomic DNA

SEQ ID NO: 54659 - DNA, 40 bp, Homo sapiens; identical to SEQ ID NO: 33980
  misc_feature 1..40: note = chr11:79151349-79151389
  misc_feature 1..40: note = hyper
  source 1..40: mol_type = genomic DNA

SEQ ID NO: 54660 - DNA, 205 bp, Homo sapiens; identical to SEQ ID NO: 33981
  misc_feature 1..205: note = chr11:79151681-79151886
  misc_feature 1..205: note = hyper
  source 1..205: mol_type = genomic DNA

SEQ ID NO: 54661 - DNA, 264 bp, Homo sapiens; identical to SEQ ID NO: 33982
  misc_feature 1..264: note = chr11:79152006-79152270
  misc_feature 1..264: note = hyper
  source 1..264: mol_type = genomic DNA

SEQ ID NO: 54662 - DNA, 30 bp, Homo sapiens; identical to SEQ ID NO: 33983
  misc_feature 1..30: note = chr11:79152805-79152835
  misc_feature 1..30: note = hyper
  source 1..30: mol_type = genomic DNA

SEQ ID NO: 54663 - DNA, 149 bp, Homo sapiens; identical to SEQ ID NO: 33984
  misc_feature 1..149: note = chr11:82443420-82443569
  misc_feature 1..149: note = hyper
  source 1..149: mol_type = genomic DNA

SEQ ID NO: 54664 - DNA, 69 bp, Homo sapiens; identical to SEQ ID NO: 10941
  misc_feature 1..69: note = chr11:82443651-82443720
  misc_feature 1..69: note = hyper
  source 1..69: mol_type = genomic DNA

SEQ ID NO: 54665 - DNA, 153 bp, Homo sapiens; identical to SEQ ID NO: 33986
  misc_feature 1..153: note = chr11:82444032-82444185
  misc_feature 1..153: note = hyper
  source 1..153: mol_type = genomic DNA

SEQ ID NO: 54666 - DNA, 91 bp, Homo sapiens
  misc_feature 1..91: note = chr11:82445101-82445192
  misc_feature 1..91: note = hyper
  source 1..91: mol_type = genomic DNA
gactcctctaaccgcaaggggtgaggaagagatggctggtctcaaactccagttcaggcccatgaggccgctgcagcgcttgataggcttc

SEQ ID NO: 54667 - DNA, 83 bp, Homo sapiens; identical to SEQ ID NO: 33988
  misc_feature 1..83: note = chr11:84431452-84431535
  misc_feature 1..83: note = hyper
  source 1..83: mol_type = genomic DNA

SEQ ID NO: 54668 - DNA, 164 bp, Homo sapiens; identical to SEQ ID NO: 33989
  misc_feature 1..164: note = chr11:84431536-84431700
  misc_feature 1..164: note = hyper
  source 1..164: mol_type = genomic DNA

SEQ ID NO: 54669 - DNA, 316 bp, Homo sapiens; identical to SEQ ID NO: 33990
  misc_feature 1..316: note = chr11:84431954-84432270
  misc_feature 1..316: note = hyper
  source 1..316: mol_type = genomic DNA

SEQ ID NO: 54670 - DNA, 23 bp, Homo sapiens
  misc_feature 1..23: note = chr11:86085968-86085991
  misc_feature 1..23: note = hyper
  source 1..23: mol_type = genomic DNA
gagctgcccgagagccagagcag

SEQ ID NO: 54671 - DNA, 257 bp, Homo sapiens; identical to SEQ ID NO: 33993
  misc_feature 1..257: note = chr11:86382846-86383103
  misc_feature 1..257: note = hyper
  source 1..257: mol_type = genomic DNA

SEQ ID NO: 54672 - DNA, 190 bp, Homo sapiens; identical to SEQ ID NO: 33994
  misc_feature 1..190: note = chr11:87908294-87908484
  misc_feature 1..190: note = hyper
  source 1..190: mol_type = genomic DNA

SEQ ID NO: 54673 - skipped

SEQ ID NO: 54674 - DNA, 185 bp, Homo sapiens; identical to SEQ ID NO: 33998
  misc_feature 1..185: note = chr11:88798746-88798931
  misc_feature 1..185: note = hyper
  source 1..185: mol_type = genomic DNA

SEQ ID NO: 54675 - DNA, 117 bp, Homo sapiens; identical to SEQ ID NO: 21137
  misc_feature 1..117: note = chr11:88798965-88799082
  misc_feature 1..117: note = hyper
  source 1..117: mol_type = genomic DNA

SEQ ID NO: 54676 - skipped

SEQ ID NO: 54677 - DNA, 124 bp, Homo sapiens; identical to SEQ ID NO: 34000
  misc_feature 1..124: note = chr11:89224502-89224626
  misc_feature 1..124: note = hyper
  source 1..124: mol_type = genomic DNA

SEQ ID NO: 54678 - DNA, 185 bp, Homo sapiens; identical to SEQ ID NO: 21139
  misc_feature 1..185: note = chr11:91957315-91957500
  misc_feature 1..185: note = hyper
  source 1..185: mol_type = genomic DNA

SEQ ID NO: 54679 - DNA, 210 bp, Homo sapiens
  misc_feature 1..210: note = chr11:91957674-91957884
  misc_feature 1..210: note = hyper
  source 1..210: mol_type = genomic DNA
agagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggagg

SEQ ID NO: 54680 - DNA, 33 bp, Homo sapiens
  misc_feature 1..33: note = chr11:91958230-91958263
  misc_feature 1..33: note = hyper
  source 1..33: mol_type = genomic DNA
cggcagcagccgggggaccggctcgcccggagc

SEQ ID NO: 54681 - DNA, 165 bp, Homo sapiens
  misc_feature 1..165: note = chr11:91958569-91958734
  misc_feature 1..165: note = hyper
  source 1..165: mol_type = genomic DNA
ccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcag

SEQ ID NO: 54682 - DNA, 120 bp, Homo sapiens; identical to SEQ ID NO: 34004
  misc_feature 1..120: note = chr11:91959509-91959629
  misc_feature 1..120: note = hyper
  source 1..120: mol_type = genomic DNA

SEQ ID NO: 54683 - DNA, 58 bp, Homo sapiens; identical to SEQ ID NO: 34005
  misc_feature 1..58: note = chr11:91960056-91960114
  misc_feature 1..58: note = hyper
  source 1..58: mol_type = genomic DNA

SEQ ID NO: 54684 - DNA, 101 bp, Homo sapiens; identical to SEQ ID NO: 34006
  misc_feature 1..101: note = chr11:91960369-91960470
  misc_feature 1..101: note = hyper
  source 1..101: mol_type = genomic DNA

SEQ ID NO: 54685 - DNA, 73 bp, Homo sapiens; identical to SEQ ID NO: 34007
  misc_feature 1..73: note = chr11:92675236-92675309
  misc_feature 1..73: note = hyper
  source 1..73: mol_type = genomic DNA

SEQ ID NO: 54686 - DNA, 225 bp, Homo sapiens
  misc_feature 1..225: note = chr11:93063645-93063870
  misc_feature 1..225: note = hyper
  source 1..225: mol_type = genomic DNA
gaggcagccgaggagccgcacagggcagcgcctgccgccgccgccgcgcccatcccccactccgacggccacgagttcgggccgcgacgtccccatggcaacacgcggcggcgccgcgcgcggggagggagaggcccaactgcctcgttggtcgcgcggcgggagggcccaggcggcgggagcgcggcggcgggtggcggggccccttggggcgggcctggcggg

SEQ ID NO: 54687 - DNA, 37 bp, Homo sapiens
  misc_feature 1..37: note = chr11:94134049-94134086
  misc_feature 1..37: note = hyper
  source 1..37: mol_type = genomic DNA
gcgtgatcattatgtcggcaactgccaggttgacgat

SEQ ID NO: 54688 - DNA, 52 bp, Homo sapiens; identical to SEQ ID NO: 34011
  misc_feature 1..52: note = chr11:94277933-94277985
  misc_feature 1..52: note = hyper
  source 1..52: mol_type = genomic DNA

SEQ ID NO: 54689 - DNA, 177 bp, Homo sapiens
  misc_feature 1..177: note = chr11:94473423-94473600
  misc_feature 1..177: note = hyper
  source 1..177: mol_type = genomic DNA
agcccacagaacaaacgatttcccaagcatcagaggagggcagacataacataacagagcagggaatcgggttagaacgggttatgctctgattttttggaaaatgggcaaacggggcggggactagggaggattccgccagccgggagttgggaggccgcgcgcgcctctgcggag

SEQ ID NO: 54690 - DNA, 58 bp, Homo sapiens; identical to SEQ ID NO: 34015
  misc_feature 1..58: note = chr11:94474489-94474547
  misc_feature 1..58: note = hyper
  source 1..58: mol_type = genomic DNA

SEQ ID NO: 54691 - DNA, 577 bp, Homo sapiens; identical to SEQ ID NO: 34016
  misc_feature 1..577: note = chr11:94501445-94502022
  misc_feature 1..577: note = hyper
  source 1..577: mol_type = genomic DNA

SEQ ID NO: 54692 - DNA, 15 bp, Homo sapiens
  misc_feature 1..15: note = chr11:94502757-94502772
  misc_feature 1..15: note = hyper
  source 1..15: mol_type = genomic DNA
cgaagatttttgcct

SEQ ID NO: 54693 - DNA, 34 bp, Homo sapiens; identical to SEQ ID NO: 34018
  misc_feature 1..34: note = chr11:94884262-94884296
  misc_feature 1..34: note = hyper
  source 1..34: mol_type = genomic DNA

SEQ ID NO: 54694 - DNA, 110 bp, Homo sapiens
  misc_feature 1..110: note = chr11:98891367-98891477
  misc_feature 1..110: note = hyper
  source 1..110: mol_type = genomic DNA
gttgcagagcagaaacgctcggggaaggggggcaggtcctctgtacttagcagggaaggaaaatgccggttgactagtgagacgagtggagaaacacagagcaccctccg

SEQ ID NO: 54695 - skipped

SEQ ID NO: 54696 - DNA, 295 bp, Homo sapiens; identical to SEQ ID NO: 21151
  misc_feature 1..295: note = chr11:100997981-100998276
  misc_feature 1..295: note = hyper
  source 1..295: mol_type = genomic DNA

SEQ ID NO: 54697 - DNA, 103 bp, Homo sapiens
  misc_feature 1..103: note = chr11:100998318-100998421
  misc_feature 1..103: note = hyper
  source 1..103: mol_type = genomic DNA
ggccgtcccgcgggagcaggcagccgctcgcgcccggcgccttgcagggcggcggcgcgaacgggccctgctggggcggcgcgccctccgctttgtacaggat

SEQ ID NO: 54698 - DNA, 88 bp, Homo sapiens; identical to SEQ ID NO: 34022
  misc_feature 1..88: note = chr11:100999617-100999705
  misc_feature 1..88: note = hyper
  source 1..88: mol_type = genomic DNA

SEQ ID NO: 54699 - DNA, 90 bp, Homo sapiens; identical to SEQ ID NO: 21154
  misc_feature 1..90: note = chr11:101453090-101453180
  misc_feature 1..90: note = hyper
  source 1..90: mol_type = genomic DNA

SEQ ID NO: 54700 - DNA, 187 bp, Homo sapiens; identical to SEQ ID NO: 34024
  misc_feature 1..187: note = chr11:101454510-101454697
  misc_feature 1..187: note = hyper
  source 1..187: mol_type = genomic DNA

SEQ ID NO: 54701 - DNA, 154 bp, Homo sapiens; identical to SEQ ID NO: 34025
  misc_feature 1..154: note = chr11:101918352-101918506
  misc_feature 1..154: note = hyper
  source 1..154: mol_type = genomic DNA

SEQ ID NO: 54702 - DNA, 30 bp, Homo sapiens; identical to SEQ ID NO: 34026
  misc_feature 1..30: note = chr11:102980458-102980488
  misc_feature 1..30: note = hyper
  source 1..30: mol_type = genomic DNA

SEQ ID NO: 54703 - DNA, 34 bp, Homo sapiens; identical to SEQ ID NO: 34027
  misc_feature 1..34: note = chr11:104034042-104034076
  misc_feature 1..34: note = hyper
  source 1..34: mol_type = genomic DNA

SEQ ID NO: 54704 - DNA, 112 bp, Homo sapiens; identical to SEQ ID NO: 21157
  misc_feature 1..112: note = chr11:104034409-104034521
  misc_feature 1..112: note = hyper
  source 1..112: mol_type = genomic DNA

SEQ ID NO: 54705 - DNA, 222 bp, Homo sapiens; identical to SEQ ID NO: 21158
  misc_feature 1..222: note = chr11:104034996-104035218
  misc_feature 1..222: note = hyper
  source 1..222: mol_type = genomic DNA

SEQ ID NO: 54706 - DNA, 211 bp, Homo sapiens; identical to SEQ ID NO: 21159
  misc_feature 1..211: note = chr11:105481005-105481216
  misc_feature 1..211: note = hyper
  source 1..211: mol_type = genomic DNA

SEQ ID NO: 54707 - DNA, 256 bp, Homo sapiens; identical to SEQ ID NO: 34034
  misc_feature 1..256: note = chr11:105481621-105481877
  misc_feature 1..256: note = hyper
  source 1..256: mol_type = genomic DNA

SEQ ID NO: 54708 - DNA, 25 bp, Homo sapiens
  misc_feature 1..25: note = chr11:106888283-106888308
  misc_feature 1..25: note = hyper
  source 1..25: mol_type = genomic DNA
tgtagtcccctcttccgccctagcc

SEQ ID NO: 54709 - DNA, 212 bp, Homo sapiens
  misc_feature 1..212: note = chr11:106888429-106888641
  misc_feature 1..212: note = hyper
  source 1..212: mol_type = genomic DNA
tccgcgttctctcccccgaaggcggtccccccttccgccccccgctcaccgagggcgccgtcaggcggctgatgctctcgcccagcgagtccaggttgacccgcctccggcgctgcaccctcctggccccggcagtggcagcggcggcggcggcagaagcagccggggtcggggccggggcggcggcagcggcagctgcggccgggctgggc

SEQ ID NO: 54710 - DNA, 290 bp, Homo sapiens
  misc_feature 1..290: note = chr11:106888801-106889091
  misc_feature 1..290: note = hyper
  source 1..290: mol_type = genomic DNA
ggccgaggcggtggcggcgaggacgcgagcggcggcggaggcggcggtggcgggaccggcaagcgacaacgttaagcgcgtcggggccgcggggcgctgcggtcgcgcccggcggggcgggagtccccggggccgcggagccccccgagccggctgctcatggcgggaacttggggcgccgccgcaccttggggcccgggctcggcggcggcgccgggctgggctgggggccgccgccgcctctgctgctgctcgcgcggcgccgcctcagcgcccgcctcggcgcatcg

SEQ ID NO: 54711 - DNA, 32 bp, Homo sapiens; identical to SEQ ID NO: 34036
  misc_feature 1..32: note = chr11:106889400-106889432
  misc_feature 1..32: note = hyper
  source 1..32: mol_type = genomic DNA

SEQ ID NO: 54712 - DNA, 494 bp, Homo sapiens; identical to SEQ ID NO: 34037
  misc_feature 1..494: note = chr11:106889690-106890184
  misc_feature 1..494: note = hyper
  source 1..494: mol_type = genomic DNA

SEQ ID NO: 54713 - DNA, 762 bp, Homo sapiens
  misc_feature 1..762: note = chr11:107461653-107462415
  misc_feature 1..762: note = hyper
  source 1..762: mol_type = genomic DNA
ggaggccacccgggagcaattaaactgggccacaccagccacctcccacagcagcggggtccgcagatttaaccctttccccccagattccggcactgggtgccgcgctctctcccccagcaccgcgcccgcgcccccggctcccggactgggcatgctcagtagccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcg

SEQ ID NO: 54714 - DNA, 11 bp, Homo sapiens
  misc_feature 1..11: note = chr11:107462459-107462470
  misc_feature 1..11: note = hyper
  source 1..11: mol_type = genomic DNA
gaagggatccc

SEQ ID NO: 54715 - DNA, 499 bp, Homo sapiens; identical to SEQ ID NO: 34039
  misc_feature 1..499: note = chr11:107799306-107799805
  misc_feature 1..499: note = hyper
  source 1..499: mol_type = genomic DNA

SEQ ID NO: 54716 - DNA, 30 bp, Homo sapiens; identical to SEQ ID NO: 34040
  misc_feature 1..30: note = chr11:107800015-107800045
  misc_feature 1..30: note = hyper
  source 1..30: mol_type = genomic DNA

SEQ ID NO: 54717 - DNA, 43 bp, Homo sapiens; identical to SEQ ID NO: 34041
  misc_feature 1..43: note = chr11:109292787-109292830
  misc_feature 1..43: note = hyper
  source 1..43: mol_type = genomic DNA

SEQ ID NO: 54718 - DNA, 15 bp, Homo sapiens
  misc_feature 1..15: note = chr11:109292891-109292906
  misc_feature 1..15: note = hyper
  source 1..15: mol_type = genomic DNA
cgcggctcggtctct

SEQ ID NO: 54719 - DNA, 123 bp, Homo sapiens; identical to SEQ ID NO: 21169
  misc_feature 1..123: note = chr11:109293052-109293175
  misc_feature 1..123: note = hyper
  source 1..123: mol_type = genomic DNA

SEQ ID NO: 54720 - DNA, 214 bp, Homo sapiens
  misc_feature 1..214: note = chr11:109293506-109293720
  misc_feature 1..214: note = hyper
  source 1..214: mol_type = genomic DNA
agaagagatggagcgcgttcctgcgcgtcagccgcggtcgcggacagaggcagagtgggatgtggtgccaggggtatccccctgggaatgggacccaagggatctgacgctgtccagggagggcgagtctggacggggagggaaaggaagggaggactgcgtacccggagcccgcgcggcggcccggagtgggtgctgggaagggtaggatcca

SEQ ID NO: 54721 - DNA, 26 bp, Homo sapiens
  misc_feature 1..26: note = chr11:109293873-109293899
  misc_feature 1..26: note = hyper
  source 1..26: mol_type = genomic DNA
cgcggtgccggcgcagaccccatcct

SEQ ID NO: 54722 - DNA, 51 bp, Homo sapiens; identical to SEQ ID NO: 34045
  misc_feature 1..51: note = chr11:109294138-109294189
  misc_feature 1..51: note = hyper
  source 1..51: mol_type = genomic DNA

SEQ ID NO: 54723 - DNA, 459 bp, Homo sapiens
  misc_feature 1..459: note = chr11:110581773-110582232
  misc_feature 1..459: note = hyper
  source 1..459: mol_type = genomic DNA
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgaccc

SEQ ID NO: 54724 - DNA, 461 bp, Homo sapiens
  misc_feature 1..461: note = chr11:110582434-110582895
  misc_feature 1..461: note = hyper
  source 1..461: mol_type = genomic DNA
ggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagg

SEQ ID NO: 54725 - DNA, 524 bp, Homo sapiens; identical to SEQ ID NO: 21175
  misc_feature 1..524: note = chr11:110583050-110583574
  misc_feature 1..524: note = hyper
  source 1..524: mol_type = genomic DNA

SEQ ID NO: 54726 - DNA, 422 bp, Homo sapiens
  misc_feature 1..422: note = chr11:110583730-110584152
  misc_feature 1..422: note = hyper
  source 1..422: mol_type = genomic DNA
tcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaa

SEQ ID NO: 54727 - DNA, 35 bp, Homo sapiens; identical to SEQ ID NO: 34049
  misc_feature 1..35: note = chr11:111170024-111170059
  misc_feature 1..35: note = hyper
  source 1..35: mol_type = genomic DNA

SEQ ID NO: 54728 - DNA, 58 bp, Homo sapiens
  misc_feature 1..58: note = chr11:111383125-111383183
  misc_feature 1..58: note = hyper
  source 1..58: mol_type = genomic DNA
ctcccccacccgccccgtctcgcgcccgccccgcccctcggcccgcggggttccaagg

SEQ ID NO: 54729 - DNA, 223 bp, Homo sapiens; identical to SEQ ID NO: 21179
  misc_feature 1..223: note = chr11:111383682-111383905
  misc_feature 1..223: note = hyper
  source 1..223: mol_type = genomic DNA

SEQ ID NO: 54730 - DNA, 30 bp, Homo sapiens; identical to SEQ ID NO: 34053
  misc_feature 1..30: note = chr11:111385419-111385449
  misc_feature 1..30: note = hyper
  source 1..30: mol_type = genomic DNA

SEQ ID NO: 54731 - DNA, 195 bp, Homo sapiens
  misc_feature 1..195: note = chr11:111412061-111412256
  misc_feature 1..195: note = hyper
  source 1..195: mol_type = genomic DNA
ccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctc

SEQ ID NO: 54732 - DNA, 30 bp, Homo sapiens; identical to SEQ ID NO: 34057
  misc_feature 1..30: note = chr11:111412594-111412624
  misc_feature 1..30: note = hyper
  source 1..30: mol_type = genomic DNA

SEQ ID NO: 54733 - DNA, 137 bp, Homo sapiens; identical to SEQ ID NO: 34058
  misc_feature 1..137: note = chr11:113345029-113345166
  misc_feature 1..137: note = hyper
  source 1..137: mol_type = genomic DNA

SEQ ID NO: 54734 - DNA, 320 bp, Homo sapiens; identical to SEQ ID NO: 11002
  misc_feature 1..320: note = chr11:113345418-113345738
  misc_feature 1..320: note = hyper
  source 1..320: mol_type = genomic DNA

SEQ ID NO: 54735 - DNA, 102 bp, Homo sapiens; identical to SEQ ID NO: 34060
  misc_feature 1..102: note = chr11:113346239-113346341
  misc_feature 1..102: note = hyper
  source 1..102: mol_type = genomic DNA

SEQ ID NO: 54736 - DNA, 181 bp, Homo sapiens; identical to SEQ ID NO: 34061
  misc_feature 1..181: note = chr11:113929598-113929779
  misc_feature 1..181: note = hyper
  source 1..181: mol_type = genomic DNA

SEQ ID NO: 54737 - DNA, 32 bp, Homo sapiens; identical to SEQ ID NO: 34062
  misc_feature 1..32: note = chr11:113929995-113930027
  misc_feature 1..32: note = hyper
  source 1..32: mol_type = genomic DNA

SEQ ID NO: 54738 - DNA, 352 bp, Homo sapiens; identical to SEQ ID NO: 11005
  misc_feature 1..352: note = chr11:113930374-113930726
  misc_feature 1..352: note = hyper
  source 1..352: mol_type = genomic DNA

SEQ ID NO: 54739 - DNA, 34 bp, Homo sapiens; identical to SEQ ID NO: 34064
  misc_feature 1..34: note = chr11:113931033-113931067
  misc_feature 1..34: note = hyper
  source 1..34: mol_type = genomic DNA

SEQ ID NO: 54740 - DNA, 354 bp, Homo sapiens; identical to SEQ ID NO: 34065
  misc_feature 1..354: note = chr11:113931343-113931697
  misc_feature 1..354: note = hyper
  source 1..354: mol_type = genomic DNA

SEQ ID NO: 54741 - DNA, 30 bp, Homo sapiens; identical to SEQ ID NO: 34066
  misc_feature 1..30: note = chr11:113932041-113932071
  misc_feature 1..30: note = hyper
  source 1..30: mol_type = genomic DNA

SEQ ID NO: 54742 - DNA, 30 bp, Homo sapiens; identical to SEQ ID NO: 34067
  misc_feature 1..30: note = chr11:115373239-115373269
  misc_feature 1..30: note = hyper
  source 1..30: mol_type = genomic DNA

SEQ ID NO: 54743 - DNA, 792 bp, Homo sapiens; identical to SEQ ID NO: 34068
  misc_feature 1..792: note = chr11:115373755-115374547
  misc_feature 1..792: note = hyper
  source 1..792: mol_type = genomic DNA

SEQ ID NO: 54744 - DNA, 249 bp, Homo sapiens; identical to SEQ ID NO: 34069
  misc_feature 1..249: note = chr11:115375185-115375434
  misc_feature 1..249: note = hyper
  source 1..249: mol_type = genomic DNA

SEQ ID NO: 54745 - DNA, 72 bp, Homo sapiens; identical to SEQ ID NO: 34070
  misc_feature 1..72: note = chr11:115530024-115530096
  misc_feature 1..72: note = hyper
  source 1..72: mol_type = genomic DNA

SEQ ID NO: 54746 - DNA, 63 bp, Homo sapiens; identical to SEQ ID NO: 34072
  misc_feature 1..63: note = chr11:115630411-115630474
  misc_feature 1..63: note = hyper
  source 1..63: mol_type = genomic DNA

SEQ ID NO: 54747 - DNA, 397 bp, Homo sapiens
  misc_feature 1..397: note = chr11:115630910-115631307
  misc_feature 1..397: note = hyper
  source 1..397: mol_type = genomic DNA
acagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagcc

SEQ ID NO: 54748 - DNA, 35 bp, Homo sapiens; identical to SEQ ID NO: 34076
  misc_feature 1..35: note = chr11:116451313-116451348
  misc_feature 1..35: note = hyper
  source 1..35: mol_type = genomic DNA

SEQ ID NO: 54749 - DNA, 264 bp, Homo sapiens; identical to SEQ ID NO: 34077
  misc_feature 1..264: note = chr11:116706504-116706768
  misc_feature 1..264: note = hyper
  source 1..264: mol_type = genomic DNA

SEQ ID NO: 54750 - DNA, 227 bp, Homo sapiens; identical to SEQ ID NO: 34078
  misc_feature 1..227: note = chr11:117667351-117667578
  misc_feature 1..227: note = hyper
  source 1..227: mol_type = genomic DNA

SEQ ID NO: 54751 - DNA, 197 bp, Homo sapiens; identical to SEQ ID NO: 34079
  misc_feature 1..197: note = chr11:117667865-117668062
  misc_feature 1..197: note = hyper
  source 1..197: mol_type = genomic DNA

SEQ ID NO: 54752 - DNA, 178 bp, Homo sapiens; identical to SEQ ID NO: 34080
  misc_feature 1..178: note = chr11:117746361-117746539
  misc_feature 1..178: note = hyper
  source 1..178: mol_type = genomic DNA

SEQ ID NO: 54753 - DNA, 220 bp, Homo sapiens; identical to SEQ ID NO: 34081
  misc_feature 1..220: note = chr11:117747536-117747756
  misc_feature 1..220: note = hyper
  source 1..220: mol_type = genomic DNA

SEQ ID NO: 54754 - DNA, 64 bp, Homo sapiens; identical to SEQ ID NO: 34082
  misc_feature 1..64: note = chr11:118024161-118024225
  misc_feature 1..64: note = hyper
  source 1..64: mol_type = genomic DNA

SEQ ID NO: 54755 - DNA, 90 bp, Homo sapiens; identical to SEQ ID NO: 34083
  misc_feature 1..90: note = chr11:118663112-118663202
  misc_feature 1..90: note = hyper
  source 1..90: mol_type = genomic DNA

SEQ ID NO: 54756 - DNA, 52 bp, Homo sapiens; identical to SEQ ID NO: 34084
  misc_feature 1..52: note = chr11:119191797-119191849
  misc_feature 1..52: note = hyper
  source 1..52: mol_type = genomic DNA

SEQ ID NO: 54757 - DNA, 510 bp, Homo sapiens; identical to SEQ ID NO: 34085
  misc_feature 1..510: note = chr11:119210471-119210981
  misc_feature 1..510: note = hyper
  source 1..510: mol_type = genomic DNA

SEQ ID NO: 54758 - DNA, 44 bp, Homo sapiens; identical to SEQ ID NO: 34086
  misc_feature 1..44: note = chr11:119211198-119211242
  misc_feature 1..44: note = hyper
  source 1..44: mol_type = genomic DNA

SEQ ID NO: 54759 - DNA, 83 bp, Homo sapiens; identical to SEQ ID NO: 34087
  misc_feature 1..83: note = chr11:119234852-119234935
  misc_feature 1..83: note = hyper
  source 1..83: mol_type = genomic DNA

SEQ ID NO: 54760 - DNA, 10 bp, Homo sapiens
  misc_feature 1..10: note = chr11:119292809-119292819
  misc_feature 1..10: note = hyper
  source 1..10: mol_type = genomic DNA
gggtgcgcag

SEQ ID NO: 54761 - DNA, 15 bp, Homo sapiens
  misc_feature 1..15: note = chr11:119293305-119293320
  misc_feature 1..15: note = hyper
  source 1..15: mol_type = genomic DNA
agctctcccctcccc

SEQ ID NO: 54762 - DNA, 18 bp, Homo sapiens
  misc_feature 1..18: note = chr11:119293352-119293370
  misc_feature 1..18: note = hyper
  source 1..18: mol_type = genomic DNA
cggcactgcggcttcctt

SEQ ID NO: 54763 - DNA, 333 bp, Homo sapiens
  misc_feature 1..333: note = chr11:119293615-119293948
  misc_feature 1..333: note = hyper
  source 1..333: mol_type = genomic DNA
cgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggc

SEQ ID NO: 54764 - DNA, 105 bp, Homo sapiens
  misc_feature 1..105: note = chr11:119612122-119612227
  misc_feature 1..105: note = hyper
  source 1..105: mol_type = genomic DNA
gcgcctgggaccctgcggggcctcctggaggcgggacgggcacggcgccacctagcggtcgtgggccgcggagagagcgtccctgtccttccccgtgtgggacct

SEQ ID NO: 54765 - DNA, 33 bp, Homo sapiens
  misc_feature 1..33: note = chr11:119612399-119612432
  misc_feature 1..33: note = hyper
  source 1..33: mol_type = genomic DNA
cagcctcccaccctcccccgcacacgtcgttcc

SEQ ID NO: 54766 - DNA, 344 bp, Homo sapiens
  misc_feature 1..344: note = chr11:119613075-119613419
  misc_feature 1..344: note = hyper
  source 1..344: mol_type = genomic DNA
ctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggaggg

SEQ ID NO: 54767 - DNA, 94 bp, Homo sapiens; identical to SEQ ID NO: 34095
  misc_feature 1..94: note = chr11:119884295-119884389
  misc_feature 1..94: note = hyper
  source 1..94: mol_type = genomic DNA

SEQ ID NO: 54768 - DNA, 118 bp, Homo sapiens; identical to SEQ ID NO: 34096
  misc_feature 1..118: note = chr11:120110849-120110967
  misc_feature 1..118: note = hyper
  source 1..118: mol_type = genomic DNA

SEQ ID NO: 54769 - DNA, 131 bp, Homo sapiens; identical to SEQ ID NO: 34097
  misc_feature 1..131: note = chr11:120382817-120382948
  misc_feature 1..131: note = hyper
  source 1..131: mol_type = genomic DNA

SEQ ID NO: 54770 - skipped

SEQ ID NO: 54771 - DNA, 323 bp, Homo sapiens
  misc_feature 1..323: note = chr11:120435477-120435800
  misc_feature 1..323: note = hyper
  source 1..323: mol_type = genomic DNA
gctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggc

SEQ ID NO: 54772 - DNA, 47 bp, Homo sapiens; identical to SEQ ID NO: 21205
  misc_feature 1..47: note = chr11:120435830-120435877
  misc_feature 1..47: note = hyper
  source 1..47: mol_type = genomic DNA

SEQ ID NO: 54773 - DNA, 129 bp, Homo sapiens; identical to SEQ ID NO: 34099
  misc_feature 1..129: note = chr11:121298044-121298173
  misc_feature 1..129: note = hyper
  source 1..129: mol_type = genomic DNA

SEQ ID NO: 54774 - DNA, 163 bp, Homo sapiens; identical to SEQ ID NO: 34100
  misc_feature 1..163: note = chr11:121593473-121593636
  misc_feature 1..163: note = hyper
  source 1..163: mol_type = genomic DNA

SEQ ID NO: 54775 - DNA, 95 bp, Homo sapiens; identical to SEQ ID NO: 21207
  misc_feature 1..95: note = chr11:122847170-122847265
  misc_feature 1..95: note = hyper
  source 1..95: mol_type = genomic DNA

SEQ ID NO: 54776 - DNA, 383 bp, Homo sapiens
  misc_feature 1..383: note = chr11:122847696-122848079
  misc_feature 1..383: note = hyper
  source 1..383: mol_type = genomic DNA
aacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggt

SEQ ID NO: 54777 - DNA, 168 bp, Homo sapiens
  misc_feature 1..168: note = chr11:122848591-122848759
  misc_feature 1..168: note = hyper
  source 1..168: mol_type = genomic DNA
gttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaa

SEQ ID NO: 54778 - DNA, 261 bp, Homo sapiens
  misc_feature 1..261: note = chr11:122850163-122850424
  misc_feature 1..261: note = hyper
  source 1..261: mol_type = genomic DNA
ccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataa

SEQ ID NO: 54779 - DNA, 641 bp, Homo sapiens
  misc_feature 1..641: note = chr11:122850536-122851177
  misc_feature 1..641: note = hyper
  source 1..641: mol_type = genomic DNA
tttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctt

SEQ ID NO: 54780 - DNA, 55 bp, Homo sapiens
  misc_feature 1..55: note = chr11:122851209-122851264
  misc_feature 1..55: note = hyper
  source 1..55: mol_type = genomic DNA
ctgtcttgcccccagcccctccaccgaccatggttgttgccgcctctgagctatg

SEQ ID NO: 54781 - DNA, 68 bp, Homo sapiens
  misc_feature 1..68: note = chr11:122852370-122852438
  misc_feature 1..68: note = hyper
  source 1..68: mol_type = genomic DNA
gagattcatcttgagcggagcacctgccacaggacaagggccgggacgaagtggaggacgcaggcaga

SEQ ID NO: 54782 - DNA, 377 bp, Homo sapiens
  misc_feature 1..377: note = chr11:122852475-122852852
  misc_feature 1..377: note = hyper
  source 1..377: mol_type = genomic DNA
gaggctcgaatctccgctgctctctcccgggcctgggctaccccgggcgctggagaggcaagaagacaagctcctgggtaggttgggtctctgtgttggagaattggcagcttggagaggggggccgggagagccaatgacgaggctgccagaggcagaggggagggtgcgggaggctcggggcggggcggggagctgtccgcggtgctgaacaccaccggccgagcctgggaacaacagagcccgcagggttcttgttcctaccaggtttctcgacctcaatttctgccccgtcactgcaggggctgctttgttcccagtcgtttttaaaagaaagccaaaaggaaaaagtctctgttgtccggcaaactcctctt

SEQ ID NO: 54783 - DNA, 93 bp, Homo sapiens; identical to SEQ ID NO: 21213
  misc_feature 1..93: note = chr11:122854915-122855008
  misc_feature 1..93: note = hyper
  source 1..93: mol_type = genomic DNA

SEQ ID NO: 54784 - skipped

SEQ ID NO: 54785 - DNA, 17 bp, Homo sapiens
  misc_feature 1..17: note = chr11:122855721-122855738
  misc_feature 1..17: note = hyper
  source 1..17: mol_type = genomic DNA
cgcgggccccagggctg

SEQ ID NO: 54786 - DNA, 440 bp, Homo sapiens; identical to SEQ ID NO: 34109
  misc_feature 1..440: note = chr11:123065493-123065933
  misc_feature 1..440: note = hyper
  source 1..440: mol_type = genomic DNA

SEQ ID NO: 54787 - DNA, 53 bp, Homo sapiens; identical to SEQ ID NO: 34110
  misc_feature 1..53: note = chr11:123066144-123066197
  misc_feature 1..53: note = hyper
  source 1..53: mol_type = genomic DNA

SEQ ID NO: 54788 - DNA, 381 bp, Homo sapiens; identical to SEQ ID NO: 34111
  misc_feature 1..381: note = chr11:123172482-123172863
  misc_feature 1..381: note = hyper
  source 1..381: mol_type = genomic DNA

SEQ ID NO: 54789 - DNA, 75 bp, Homo sapiens; identical to SEQ ID NO: 34112
  misc_feature 1..75: note = chr11:123172915-123172990
  misc_feature 1..75: note = hyper
  source 1..75: mol_type = genomic DNA

SEQ ID NO: 54790 - DNA, 80 bp, Homo sapiens; identical to SEQ ID NO: 34113
  misc_feature 1..80: note = chr11:123228636-123228716
  misc_feature 1..80: note = hyper
  source 1..80: mol_type = genomic DNA

SEQ ID NO: 54791 - DNA, 270 bp, Homo sapiens; identical to SEQ ID NO: 21219
  misc_feature 1..270: note = chr11:123228788-123229058
  misc_feature 1..270: note = hyper
  source 1..270: mol_type = genomic DNA

SEQ ID NO: 54792 - skipped

SEQ ID NO: 54793 - DNA, 13 bp, Homo sapiens
  misc_feature 1..13: note = chr11:123300811-123300824
  misc_feature 1..13: note = hyper
  source 1..13: mol_type = genomic DNA
cctttacttggag

SEQ ID NO: 54794 - DNA, 46 bp, Homo sapiens
  misc_feature 1..46: note = chr11:123302026-123302072
  misc_feature 1..46: note = hyper
  source 1..46: mol_type = genomic DNA
atggtggcattcagcttccacgcgtgccacccgctccccaactcag

SEQ ID NO: 54795 - DNA, 30 bp, Homo sapiens; identical to SEQ ID NO: 34120
  misc_feature 1..30: note = chr11:123524569-123524599
  misc_feature 1..30: note = hyper
  source 1..30: mol_type = genomic DNA

SEQ ID NO: 54796 - DNA, 150 bp, Homo sapiens; identical to SEQ ID NO: 34121
  misc_feature 1..150: note = chr11:123524827-123524977
  misc_feature 1..150: note = hyper
  source 1..150: mol_type = genomic DNA

SEQ ID NO: 54797 - DNA, 61 bp, Homo sapiens; identical to SEQ ID NO: 34122
  misc_feature 1..61: note = chr11:123525412-123525473
  misc_feature 1..61: note = hyper
  source 1..61: mol_type = genomic DNA

SEQ ID NO: 54798 - DNA, 20 bp, Homo sapiens
  misc_feature 1..20: note = chr11:124629399-124629419
  misc_feature 1..20: note = hyper
  source 1..20: mol_type = genomic DNA
ctcggccctctgcctcggag

SEQ ID NO: 54799 - DNA, 15 bp, Homo sapiens
  misc_feature 1..15: note = chr11:124629499-124629514
  misc_feature 1..15: note = hyper
  source 1..15: mol_type = genomic DNA
cgccctaggagagcc

SEQ ID NO: 54800 - DNA, 214 bp, Homo sapiens; identical to SEQ ID NO: 34125
  misc_feature 1..214: note = chr11:124631577-124631791
  misc_feature 1..214: note = hyper
  source 1..214: mol_type = genomic DNA

SEQ ID NO: 54801 - DNA, 46 bp, Homo sapiens; identical to SEQ ID NO: 34126
  misc_feature 1..46: note = chr11:124709117-124709163
  misc_feature 1..46: note = hyper
  source 1..46: mol_type = genomic DNA

SEQ ID NO: 54802 - DNA, 183 bp, Homo sapiens; identical to SEQ ID NO: 34127
  misc_feature 1..183: note = chr11:124709482-124709665
  misc_feature 1..183: note = hyper
  source 1..183: mol_type = genomic DNA

SEQ ID NO: 54803 - DNA, 156 bp, Homo sapiens; identical to SEQ ID NO: 34128
  misc_feature 1..156: note = chr11:124712781-124712937
  misc_feature 1..156: note = hyper
  source 1..156: mol_type = genomic DNA

SEQ ID NO: 54804 - DNA, 336 bp, Homo sapiens; identical to SEQ ID NO: 34129
  misc_feature 1..336: note = chr11:124713057-124713393
  misc_feature 1..336: note = hyper
  source 1..336: mol_type = genomic DNA

SEQ ID NO: 54805 - DNA, 49 bp, Homo sapiens; identical to SEQ ID NO: 11053
  misc_feature 1..49: note = chr11:124735054-124735103
  misc_feature 1..49: note = hyper
  source 1..49: mol_type = genomic DNA

SEQ ID NO: 54806 - DNA, 55 bp, Homo sapiens
  misc_feature 1..55: note = chr11:124735382-124735437
  misc_feature 1..55: note = hyper
  source 1..55: mol_type = genomic DNA
ctgtggaggggcttacggctcccagcccacgggtctcagacccaggggctgggcc

SEQ ID NO: 54807 - DNA, 714 bp, Homo sapiens
  misc_feature 1..714: note = chr11:124735482-124736196
  misc_feature 1..714: note = hyper
  source 1..714: mol_type = genomic DNA
tacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccacc

SEQ ID NO: 54808 - DNA, 205 bp, Homo sapiens
  misc_feature 1..205: note = chr11:124736252-124736457
  misc_feature 1..205: note = hyper
  source 1..205: mol_type = genomic DNA
cggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 54809 - DNA, 316 bp, Homo sapiens
  misc_feature 1..316: note = chr11:124738461-124738777
  misc_feature 1..316: note = hyper
  source 1..316: mol_type = genomic DNA
gatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagccc

SEQ ID NO: 54810 - DNA, 60 bp, Homo sapiens; identical to SEQ ID NO: 34133
  misc_feature 1..60: note = chr11:124739403-124739463
  misc_feature 1..60: note = hyper
  source 1..60: mol_type = genomic DNA

SEQ ID NO: 54811 - DNA, 252 bp, Homo sapiens; identical to SEQ ID NO: 34134
  misc_feature 1..252: note = chr11:124933396-124933648
  misc_feature 1..252: note = hyper
  source 1..252: mol_type = genomic DNA

SEQ ID NO: 54812 - DNA, 77 bp, Homo sapiens; identical to SEQ ID NO: 34135
  misc_feature 1..77: note = chr11:125034228-125034305
  misc_feature 1..77: note = hyper
  source 1..77: mol_type = genomic DNA

SEQ ID NO: 54813 - DNA, 50 bp, Homo sapiens; identical to SEQ ID NO: 34136
  misc_feature 1..50: note = chr11:125034731-125034781
  misc_feature 1..50: note = hyper
  source 1..50: mol_type = genomic DNA

SEQ ID NO: 54814 - DNA, 395 bp, Homo sapiens
  misc_feature 1..395: note = chr11:125035368-125035763
  misc_feature 1..395: note = hyper
  source 1..395: mol_type = genomic DNA
tccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaa

SEQ ID NO: 54815 - DNA, 129 bp, Homo sapiens
  misc_feature 1..129: note = chr11:125036208-125036337
  misc_feature 1..129: note = hyper
  source 1..129: mol_type = genomic DNA
tgaaagtagttgatctgagccatggcaggcgagccccgaatttttgctgcttccccctgaaagtgtttctttaggaggagaggacttgggccacacaggacccggtcctaagagagcgattccgggaag

SEQ ID NO: 54816 - DNA, 30 bp, Homo sapiens; identical to SEQ ID NO: 34138
  misc_feature 1..30: note = chr11:125133214-125133244
  misc_feature 1..30: note = hyper
  source 1..30: mol_type = genomic DNA

SEQ ID NO: 54817 - DNA, 584 bp, Homo sapiens; identical to SEQ ID NO: 34139
  misc_feature 1..584: note = chr11:125365065-125365649
  misc_feature 1..584: note = hyper
  source 1..584: mol_type = genomic DNA

SEQ ID NO: 54818 - DNA, 583 bp, Homo sapiens; identical to SEQ ID NO: 34140
  misc_feature 1..583: note = chr11:125365709-125366292
  misc_feature 1..583: note = hyper
  source 1..583: mol_type = genomic DNA

SEQ ID NO: 54819 - DNA, 327 bp, Homo sapiens; identical to SEQ ID NO: 34142
  misc_feature 1..327: note = chr11:125774122-125774449
  misc_feature 1..327: note = hyper
  source 1..327: mol_type = genomic DNA

SEQ ID NO: 54820 - DNA, 15 bp, Homo sapiens
  misc_feature 1..15: note = chr11:125774480-125774495
  misc_feature 1..15: note = hyper
  source 1..15: mol_type = genomic DNA
cgccaccgagccggg

SEQ ID NO: 54821 - DNA, 58 bp, Homo sapiens; identical to SEQ ID NO: 34144
  misc_feature 1..58: note = chr11:126226052-126226110
  misc_feature 1..58: note = hyper
  source 1..58: mol_type = genomic DNA

SEQ ID NO: 54822 - DNA, 16 bp, Homo sapiens
  misc_feature 1..16: note = chr11:126870413-126870429
  misc_feature 1..16: note = hyper
  source 1..16: mol_type = genomic DNA
gcagcgaaggaaagcc

SEQ ID NO: 54823 - DNA, 23 bp, Homo sapiens
  misc_feature 1..23: note = chr11:126870430-126870453
  misc_feature 1..23: note = hyper
  source 1..23: mol_type = genomic DNA
gcggggtaacttggctgtggtta

SEQ ID NO: 54824 - DNA, 197 bp, Homo sapiens
  misc_feature 1..197: note = chr11:126870543-126870740
  misc_feature 1..197: note = hyper
  source 1..197: mol_type = genomic DNA
gtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgag

SEQ ID NO: 54825 - DNA, 332 bp, Homo sapiens
  misc_feature 1..332: note = chr11:126873058-126873390
  misc_feature 1..332: note = hyper
  source 1..332: mol_type = genomic DNA
aaaaggaccaggaggcgtatcaagcctgagtgccggaaaacccacggcaatcttcagcagccaccacgtggggcagagaacgcgagcagtacctgcaggacccacagccggtcgggctctggcgccagcctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagagg

SEQ ID NO: 54826 - DNA, 307 bp, Homo sapiens
  misc_feature 1..307: note = chr11:126873515-126873822
  misc_feature 1..307: note = hyper
  source 1..307: mol_type = genomic DNA
tggaaaaccgcccgaattctgggtttctgcacatccaggctggctccaggtctcttgtgcccaccgtgcaagccggcgggatgccagcaggtggcatcctctccagcgtttcttcgccaggcgtggagtccggaggccgaatccatcagtccccagccccctccccaagcctccggtgccaagtgctgggtcctgtgagcccctggcccgccccccacctccgccagcggggcgagccggagctgggtgacccagaccctcgcggaggcgggagcctacagaggatgccggccggccccaggttctg

SEQ ID NO: 54827 - DNA, 106 bp, Homo sapiens; identical to SEQ ID NO: 34150
  misc_feature 1..106: note = chr11:128556994-128557100
  misc_feature 1..106: note = hyper
  source 1..106: mol_type = genomic DNA

SEQ ID NO: 54828 - DNA, 129 bp, Homo sapiens
  misc_feature 1..129: note = chr11:128562763-128562892
  misc_feature 1..129: note = hyper
  source 1..129: mol_type = genomic DNA
aactggggcgcgcggcggcccaggagggaggcggggaggtctccgggttgggccggggaacgccggcctccaggctgggtagggaggacggtccagagcgcgggcctccgggtctcaccccgggaaaag

SEQ ID NO: 54829 - DNA, 90 bp, Homo sapiens
  misc_feature 1..90: note = chr11:128563730-128563820
  misc_feature 1..90: note = hyper
  source 1..90: mol_type = genomic DNA
tgtgtgatgcgaaaagcaggaccagcaggggaggaagagggggtgtggggggggagggaagacgagggagagcagaggggagagaagaga

SEQ ID NO: 54830 - DNA, 60 bp, Homo sapiens
  misc_feature 1..60: note = chr11:128563880-128563940
  misc_feature 1..60: note = hyper
  source 1..60: mol_type = genomic DNA
gagagagataggacttcctccccgattcgcaaagtgaagtcacttcccaaaattagctga

SEQ ID NO: 54831 - DNA, 67 bp, Homo sapiens; identical to SEQ ID NO: 21242
  misc_feature 1..67: note = chr11:128564329-128564396
  misc_feature 1..67: note = hyper
  source 1..67: mol_type = genomic DNA

SEQ ID NO: 54832 - DNA, 89 bp, Homo sapiens
  misc_feature 1..89: note = chr11:128564651-128564740
  misc_feature 1..89: note = hyper
  source 1..89: mol_type = genomic DNA
gtgggtaagtggcctcgttgcacgagggtaggggtgcaagtgagtgtgtcgggggatctatctgagcgggctcctccagatggaagccc

SEQ ID NO: 54833 - DNA, 154 bp, Homo sapiens
  misc_feature 1..154: note = chr11:128565379-128565533
  misc_feature 1..154: note = hyper
  source 1..154: mol_type = genomic DNA
ggctcagcaagagaaggctaagatgttgggctcagagaattcaagagatttttatcttctgggtggggtcgtggtttttattttctaagttttttttatgaaagtttgaaatatgctgacttaggtaaaagacaccaaccgaaggaacttgcaa

SEQ ID NO: 54834 - DNA, 96 bp, Homo sapiens
  misc_feature 1..96: note = chr11:129242780-129242876
  misc_feature 1..96: note = hyper
  source 1..96: mol_type = genomic DNA
gaagagagaaaacagaagcgggaaattcgacagaggaggagaggcccaaagggcggggagcaatgcggggaagggagaagtgggagggaagaagag

SEQ ID NO: 54835 - DNA, 97 bp, Homo sapiens
  misc_feature 1..97: note = chr11:129243587-129243684
  misc_feature 1..97: note = hyper
  source 1..97: mol_type = genomic DNA
tcaaagacgcgttgcgggccttgtctaatgctaggctgtgacttggcctcttaacatctattttctcacgcctgtaatcccagcactttgggaggcg

SEQ ID NO: 54836 - DNA, 41 bp, Homo sapiens; identical to SEQ ID NO: 21246
  misc_feature 1..41: note = chr11:129244603-129244644
  misc_feature 1..41: note = hyper
  source 1..41: mol_type = genomic DNA

SEQ ID NO: 54837 - DNA, 30 bp, Homo sapiens; identical to SEQ ID NO: 34161
  misc_feature 1..30: note = chr11:129245832-129245862
  misc_feature 1..30: note = hyper
  source 1..30: mol_type = genomic DNA

SEQ ID NO: 54838 - DNA, 206 bp, Homo sapiens; identical to SEQ ID NO: 34162
  misc_feature 1..206: note = chr11:129565510-129565716
  misc_feature 1..206: note = hyper
  source 1..206: mol_type = genomic DNA

SEQ ID NO: 54839 - DNA, 308 bp, Homo sapiens; identical to SEQ ID NO: 34163
  misc_feature 1..308: note = chr11:130297447-130297755
  misc_feature 1..308: note = hyper
  source 1..308: mol_type = genomic DNA

SEQ ID NO: 54840 - DNA, 91 bp, Homo sapiens; identical to SEQ ID NO: 34164
  misc_feature 1..91: note = chr11:130298269-130298360
  misc_feature 1..91: note = hyper
  source 1..91: mol_type = genomic DNA

SEQ ID NO: 54841 - DNA, 68 bp, Homo sapiens; identical to SEQ ID NO: 34165
  misc_feature 1..68: note = chr11:130318554-130318622
  misc_feature 1..68: note = hyper
  source 1..68: mol_type = genomic DNA

SEQ ID NO: 54842 - DNA, 30 bp, Homo sapiens; identical to SEQ ID NO: 34166
  misc_feature 1..30: note = chr11:130319107-130319137
  misc_feature 1..30: note = hyper
  source 1..30: mol_type = genomic DNA

SEQ ID NO: 54843 - DNA, 37 bp, Homo sapiens; identical to SEQ ID NO: 34167
  misc_feature 1..37: note = chr11:131558038-131558075
  misc_feature 1..37: note = hyper
  source 1..37: mol_type = genomic DNA

SEQ ID NO: 54844 - DNA, 69 bp, Homo sapiens; identical to SEQ ID NO: 34168
  misc_feature 1..69: note = chr11:131780262-131780331
  misc_feature 1..69: note = hyper
  source 1..69: mol_type = genomic DNA

SEQ ID NO: 54845 - DNA, 15 bp, Homo sapiens
  misc_feature 1..15: note = chr11:131781572-131781587
  misc_feature 1..15: note = hyper
  source 1..15: mol_type = genomic DNA
tggtttgtatggggt

SEQ ID NO: 54846 - DNA, 252 bp, Homo sapiens
  misc_feature 1..252: note = chr11:132813949-132814201
  misc_feature 1..252: note = hyper
  source 1..252: mol_type = genomic DNA
acctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaa

SEQ ID NO: 54847 - DNA, 34 bp, Homo sapiens
  misc_feature 1..34: note = chr11:132864175-132864209
  misc_feature 1..34: note = hyper
  source 1..34: mol_type = genomic DNA
ctattaaaaagcccaggcgcgattttctaattaa

SEQ ID NO: 54848 - DNA, 79 bp, Homo sapiens
  misc_feature 1..79: note = chr11:132934044-132934123
  misc_feature 1..79: note = hyper
  source 1..79: mol_type = genomic DNA
gagtgaggggtggagcggagcccagccgagggagggaaggagaggaacgccggcccactagccgaccccagcgcaaccc

SEQ ID NO: 54849 - DNA, 185 bp, Homo sapiens; identical to SEQ ID NO: 34175
  misc_feature 1..185: note = chr11:132934388-132934573
  misc_feature 1..185: note = hyper
  source 1..185: mol_type = genomic DNA

SEQ ID NO: 54850 - DNA, 226 bp, Homo sapiens
  misc_feature 1..226: note = chr11:132952542-132952768
  misc_feature 1..226: note = hyper
  source 1..226: mol_type = genomic DNA
gagtggcacagccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgac

SEQ ID NO: 54851 - DNA, 38 bp, Homo sapiens; identical to SEQ ID NO: 21251
  misc_feature 1..38: note = chr11:133402168-133402206
  misc_feature 1..38: note = hyper
  source 1..38: mol_type = genomic DNA

SEQ ID NO: 54852 - DNA, 30 bp, Homo sapiens; identical to SEQ ID NO: 21252
  misc_feature 1..30: note = chr11:133402260-133402290
  misc_feature 1..30: note = hyper
  source 1..30: mol_type = genomic DNA

SEQ ID NO: 54853 - DNA, 37 bp, Homo sapiens
  misc_feature 1..37: note = chr11:133825189-133825226
  misc_feature 1..37: note = hyper
  source 1..37: mol_type = genomic DNA
gaagagttttaaaaccgtccggaccaacatgtcagtt

SEQ ID NO: 54854 - DNA, 160 bp, Homo sapiens
  misc_feature 1..160: note = chr11:133825543-133825703
  misc_feature 1..160: note = hyper
  source 1..160: mol_type = genomic DNA
gctcacagtcctggcaccctccaggctccgctcccacttccatacaagggccgagagccgggggtgccacccagaggcttgtaggtcgctctgcccatctccaaagcaaaagcccgcgcgctcacgcacgcatcacccaactcggtggctccccccttgc

SEQ ID NO: 54855 - DNA, 622 bp, Homo sapiens; identical to SEQ ID NO: 34181
  misc_feature 1..622: note = chr11:133825704-133826326
  misc_feature 1..622: note = hyper
  source 1..622: mol_type = genomic DNA

SEQ ID NO: 54856 - DNA, 619 bp, Homo sapiens; identical to SEQ ID NO: 34182
  misc_feature 1..619: note = chr11:133826744-133827363
  misc_feature 1..619: note = hyper
  source 1..619: mol_type = genomic DNA

SEQ ID NO: 54857 - DNA, 38 bp, Homo sapiens
  misc_feature 1..38: note = chr11:133906745-133906783
  misc_feature 1..38: note = hyper
  source 1..38: mol_type = genomic DNA
cgcccccacccccaccgccaagccgaaaacccaatcct

SEQ ID NO: 54858 - DNA, 50 bp, Homo sapiens
  misc_feature 1..50: note = chr11:133906918-133906968
  misc_feature 1..50: note = hyper
  source 1..50: mol_type = genomic DNA
cctcgctgcagacggttcgccttgtccactcttctcgactcttctcgact

SEQ ID NO: 54859 - DNA, 16 bp, Homo sapiens
  misc_feature 1..16: note = chr11:133938772-133938788
  misc_feature 1..16: note = hyper
  source 1..16: mol_type = genomic DNA
agagaacccatgtgcc

SEQ ID NO: 54860 - DNA, 213 bp, Homo sapiens; identical to SEQ ID NO: 21257
  misc_feature 1..213: note = chr11:133938789-133939002
  misc_feature 1..213: note = hyper
  source 1..213: mol_type = genomic DNA

SEQ ID NO: 54861 - DNA, 260 bp, Homo sapiens
  misc_feature 1..260: note = chr11:133939177-133939437
  misc_feature 1..260: note = hyper
  source 1..260: mol_type = genomic DNA
tcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctg

SEQ ID NO: 54862 - DNA, 50 bp, Homo sapiens; identical to SEQ ID NO: 34187
  misc_feature 1..50: note = chr11:133994694-133994744
  misc_feature 1..50: note = hyper
  source 1..50: mol_type = genomic DNA

SEQ ID NO: 54863 - DNA, 229 bp, Homo sapiens
  misc_feature 1..229: note = chr11:134145474-134145703
  misc_feature 1..229: note = hyper
  source 1..229: mol_type = genomic DNA
ctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctc

SEQ ID NO: 54864 - DNA, 34 bp, Homo sapiens; identical to SEQ ID NO: 21261
  misc_feature 1..34: note = chr11:134146393-134146427
  misc_feature 1..34: note = hyper
  source 1..34: mol_type = genomic DNA

SEQ ID NO: 54865 - DNA, 232 bp, Homo sapiens; identical to SEQ ID NO: 1015
  misc_feature 1..232: note = chr11:134146444-134146676
  misc_feature 1..232: note = hyper
  source 1..232: mol_type = genomic DNA

SEQ ID NO: 54866 - skipped

SEQ ID NO: 54867 - DNA, 19 bp, Homo sapiens
  misc_feature 1..19: note = chr11:134146894-134146913
  misc_feature 1..19: note = hyper
  source 1..19: mol_type = genomic DNA
ccagcggctgggcaccgtg

SEQ ID NO: 54868 - DNA, 23 bp, Homo sapiens
  misc_feature 1..23: note = chr11:134201818-134201841
  misc_feature 1..23: note = hyper
  source 1..23: mol_type = genomic DNA
gccccagccaatgagcgccggcg

SEQ ID NO: 54869 - DNA, 70 bp, Homo sapiens
  misc_feature 1..70: note = chr11:134202084-134202154
  misc_feature 1..70: note = hyper
  source 1..70: mol_type = genomic DNA
ccagccctccgcacctcgggttctctcctcccgcgacccgcgaatcccgagttcccggggggagcagccc

SEQ ID NO: 54870 - DNA, 134 bp, Homo sapiens
  misc_feature 1..134: note = chr11:134281509-134281643
  misc_feature 1..134: note = hyper
  source 1..134: mol_type = genomic DNA
ccagcccgagctcggttctcggccccctttccagctgcccccagcgcgcgcagcgcacacacacacacacacacacacacacacacacaccccagcgcgcgcccgggaggacatggcgtgggcaccgatgggga

SEQ ID NO: 54871 - DNA, 71 bp, Homo sapiens; identical to SEQ ID NO: 34193
  misc_feature 1..71: note = chr11:134281706-134281777
  misc_feature 1..71: note = hyper
  source 1..71: mol_type = genomic DNA

SEQ ID NO: 54872 - DNA, 70 bp, Homo sapiens; identical to SEQ ID NO: 11103
  misc_feature 1..70: note = chr11:134282862-134282932
  misc_feature 1..70: note = hyper
  source 1..70: mol_type = genomic DNA

SEQ ID NO: 54873 - DNA, 221 bp, Homo sapiens; identical to SEQ ID NO: 34195
  misc_feature 1..221: note = chr12:298173-298394
  misc_feature 1..221: note = hyper
  source 1..221: mol_type = genomic DNA

SEQ ID NO: 54874 - DNA, 75 bp, Homo sapiens
  misc_feature 1..75: note = chr12:570015-570090
  misc_feature 1..75: note = hyper
  source 1..75: mol_type = genomic DNA
gacgctggcggagaccgggcccctccagccgctccgggcttgcggttcccggggaggaggtccgtggggtccacg

SEQ ID NO: 54875 - DNA, 42 bp, Homo sapiens
  misc_feature 1..42: note = chr12:570171-570213
  misc_feature 1..42: note = hyper
  source 1..42: mol_type = genomic DNA
gcccaccgccttctgtttggctcactccgtttcctctcctgc

SEQ ID NO: 54876 - DNA, 68 bp, Homo sapiens; identical to SEQ ID NO: 34197
  misc_feature 1..68: note = chr12:1059279-1059347
  misc_feature 1..68: note = hyper
  source 1..68: mol_type = genomic DNA

SEQ ID NO: 54877 - DNA, 102 bp, Homo sapiens
  misc_feature 1..102: note = chr12:1639033-1639135
  misc_feature 1..102: note = hyper
  source 1..102: mol_type = genomic DNA
cgcgtagcaagaaagcggaggacataactctcttcccctctcagagcctcgggccccgcagacgccgaggtgggcgctcgtgccaggatcgcggggcgcggg

SEQ ID NO: 54878 - DNA, 160 bp, Homo sapiens
  misc_feature 1..160: note = chr12:1639222-1639382
  misc_feature 1..160: note = hyper
  source 1..160: mol_type = genomic DNA
gggggcagcaggcgtgcggcgccgggagaagggggccgggcggcggagactccccgtccgcacccccgcggcgaggcccccgggccgctctgcttaggggccgagggagccgggcgggaggcaggtgcggaggtcgcggtcccagcgcctgggaggagcc

SEQ ID NO: 54879 - DNA, 30 bp, Homo sapiens; identical to SEQ ID NO: 34199
  misc_feature 1..30: note = chr12:1906030-1906060
  misc_feature 1..30: note = hyper
  source 1..30: mol_type = genomic DNA

SEQ ID NO: 54880 - DNA, 556 bp, Homo sapiens; identical to SEQ ID NO: 34200
  misc_feature 1..556: note = chr12:2161498-2162054
  misc_feature 1..556: note = hyper
  source 1..556: mol_type = genomic DNA

SEQ ID NO: 54881 - DNA, 487 bp, Homo sapiens
  misc_feature 1..487: note = chr12:2162067-2162554
  misc_feature 1..487: note = hyper
  source 1..487: mol_type = genomic DNA
cgggcgggcggcgcgggcaggggcgggcgcgggcgcggcggggctgggccggggggagtgagcgcggcgctctcgcgcgcccggtgtctccctctcgctgcctctgcagaaacagctcctgccagagcggcgctcggcgcggcgcggcgggcccggagcggcggcggcggctcttcctgcctccgcgcccaggagttgccggctccctttgacagcagagagccgggcaggggcctcaggaggactcgctgggagtgggcagaggcgcctcggcccctgccggcccaggcgggccccgcgcgccccccgcccctcctctccgcctcttctcgccctgcctctcccgatttattttttcaaatggtgtagccgccggaggtgcggtgctcagttcttggaaggggcccggatgtactgaggatgcgttacagtttcactcgaggaggcagtagtggaaaggagcagtttttggggtttgatgccataa

SEQ ID NO: 54882 - DNA, 347 bp, Homo sapiens
  misc_feature 1..347: note = chr12:2162817-2163164
  misc_feature 1..347: note = hyper
  source 1..347: mol_type = genomic DNA
tttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccag

SEQ ID NO: 54883 - DNA, 234 bp, Homo sapiens; identical to SEQ ID NO: 21275
  misc_feature 1..234: note = chr12:2163276-2163510
  misc_feature 1..234: note = hyper
  source 1..234: mol_type = genomic DNA

SEQ ID NO: 54884 - DNA, 63 bp, Homo sapiens; identical to SEQ ID NO: 34202
  misc_feature 1..63: note = chr12:2800100-2800163
  misc_feature 1..63: note = hyper
  source 1..63: mol_type = genomic DNA

SEQ ID NO: 54885 - DNA, 327 bp, Homo sapiens
  misc_feature 1..327: note = chr12:2861741-2862068
  misc_feature 1..327: note = hyper
  source 1..327: mol_type = genomic DNA
ccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaa

SEQ ID NO: 54886 - DNA, 324 bp, Homo sapiens; identical to SEQ ID NO: 34204
  misc_feature 1..324: note = chr12:2862267-2862591
  misc_feature 1..324: note = hyper
  source 1..324: mol_type = genomic DNA

SEQ ID NO: 54887 - DNA, 405 bp, Homo sapiens; identical to SEQ ID NO: 34205
  misc_feature 1..405: note = chr12:3474894-3475299
  misc_feature 1..405: note = hyper
  source 1..405: mol_type = genomic DNA

SEQ ID NO: 54888 - DNA, 62 bp, Homo sapiens; identical to SEQ ID NO: 34206
  misc_feature 1..62: note = chr12:3475605-3475667
  misc_feature 1..62: note = hyper
  source 1..62: mol_type = genomic DNA

SEQ ID NO: 54889 - DNA, 256 bp, Homo sapiens; identical to SEQ ID NO: 34207
  misc_feature 1..256: note = chr12:3599973-3600229
  misc_feature 1..256: note = hyper
  source 1..256: mol_type = genomic DNA

SEQ ID NO: 54890 - DNA, 85 bp, Homo sapiens; identical to SEQ ID NO: 21281
  misc_feature 1..85: note = chr12:3600230-3600315
  misc_feature 1..85: note = hyper
  source 1..85: mol_type = genomic DNA

SEQ ID NO: 54891 - DNA, 15 bp, Homo sapiens
  misc_feature 1..15: note = chr12:3600768-3600783
  misc_feature 1..15: note = hyper
  source 1..15: mol_type = genomic DNA
tcaccaaacccttgc

SEQ ID NO: 54892 - skipped

SEQ ID NO: 54893 - DNA, 214 bp, Homo sapiens; identical to SEQ ID NO: 34211
  misc_feature 1..214: note = chr12:3601042-3601256
  misc_feature 1..214: note = hyper
  source 1..214: mol_type = genomic DNA

SEQ ID NO: 54894 - DNA, 62 bp, Homo sapiens; identical to SEQ ID NO: 34212
  misc_feature 1..62: note = chr12:3601510-3601572
  misc_feature 1..62: note = hyper
  source 1..62: mol_type = genomic DNA

SEQ ID NO: 54895 - DNA, 249 bp, Homo sapiens
  misc_feature 1..249: note = chr12:3602021-3602270
  misc_feature 1..249: note = hyper
  source 1..249: mol_type = genomic DNA
gtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtca

SEQ ID NO: 54896 - DNA, 329 bp, Homo sapiens; identical to SEQ ID NO: 34215
  misc_feature 1..329: note = chr12:4140405-4140734
  misc_feature 1..329: note = hyper
  source 1..329: mol_type = genomic DNA

SEQ ID NO: 54897 - DNA, 53 bp, Homo sapiens
  misc_feature 1..53: note = chr12:4274001-4274054
  misc_feature 1..53: note = hyper
  source 1..53: mol_type = genomic DNA
cgtccgccccggggagagctggaaggtgggcccggatctcccacatcactatg

SEQ ID NO: 54898 - DNA, 83 bp, Homo sapiens; identical to SEQ ID NO: 21285
  misc_feature 1..83: note = chr12:4274188-4274271
  misc_feature 1..83: note = hyper
  source 1..83: mol_type = genomic DNA

SEQ ID NO: 54899 - DNA, 11 bp, Homo sapiens
  misc_feature 1..11: note = chr12:4274409-4274420
  misc_feature 1..11: note = hyper
  source 1..11: mol_type = genomic DNA
acacatacact

SEQ ID NO: 54900 - DNA, 271 bp, Homo sapiens; identical to SEQ ID NO: 21286
  misc_feature 1..271: note = chr12:4377981-4378252
  misc_feature 1..271: note = hyper
  source 1..271: mol_type = genomic DNA

SEQ ID NO: 54901 - DNA, 228 bp, Homo sapiens
  misc_feature 1..228: note = chr12:4378330-4378558
  misc_feature 1..228: note = hyper
  source 1..228: mol_type = genomic DNA
agtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctc

SEQ ID NO: 54902 - DNA, 555 bp, Homo sapiens
  misc_feature 1..555: note = chr12:4378802-4379357
  misc_feature 1..555: note = hyper
  source 1..555: mol_type = genomic DNA
ttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctcc

SEQ ID NO: 54903 - DNA, 429 bp, Homo sapiens
  misc_feature 1..429: note = chr12:4379491-4379920
  misc_feature 1..429: note = hyper
  source 1..429: mol_type = genomic DNA
ttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgccccccacccccgcgccacggtgatcagtttggacttcaaagccagagcacaggctcttgcgctttttcttgaaaccgaagtctacactga

SEQ ID NO: 54904 - DNA, 30 bp, Homo sapiens; identical to SEQ ID NO: 34219
  misc_feature 1..30: note = chr12:4380166-4380196
  misc_feature 1..30: note = hyper
  source 1..30: mol_type = genomic DNA

SEQ ID NO: 54905 - DNA, 139 bp, Homo sapiens; identical to SEQ ID NO: 34220
  misc_feature 1..139: note = chr12:4380525-4380664
  misc_feature 1..139: note = hyper
  source 1..139: mol_type = genomic DNA

SEQ ID NO: 54906 - DNA, 41 bp, Homo sapiens; identical to SEQ ID NO: 34221
  misc_feature 1..41: note = chr12:4380888-4380929
  misc_feature 1..41: note = hyper
  source 1..41: mol_type = genomic DNA

SEQ ID NO: 54907 - DNA, 268 bp, Homo sapiens
  misc_feature 1..268: note = chr12:4383224-4383492
  misc_feature 1..268: note = hyper
  source 1..268: mol_type = genomic DNA
gaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatcc

SEQ ID NO: 54908 - DNA, 242 bp, Homo sapiens
  misc_feature 1..242: note = chr12:4383784-4384026
  misc_feature 1..242: note = hyper
  source 1..242: mol_type = genomic DNA
aaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtat

SEQ ID NO: 54909 - DNA, 83 bp, Homo sapiens; identical to SEQ ID NO: 21291
  misc_feature 1..83: note = chr12:5017990-5018073
  misc_feature 1..83: note = hyper
  source 1..83: mol_type = genomic DNA

SEQ ID NO: 54910 - DNA, 106 bp, Homo sapiens; identical to SEQ ID NO: 21292
  misc_feature 1..106: note = chr12:5018692-5018798
  misc_feature 1..106: note = hyper
  source 1..106: mol_type = genomic DNA

SEQ ID NO: 54911 - skipped

SEQ ID NO: 54912 - DNA, 229 bp, Homo sapiens; identical to SEQ ID NO: 1020
  misc_feature 1..229: note = chr12:5018806-5019035
  misc_feature 1..229: note = hyper
  source 1..229: mol_type = genomic DNA

SEQ ID NO: 54913 - DNA, 124 bp, Homo sapiens
  misc_feature 1..124: note = chr12:5152915-5153039
  misc_feature 1..124: note = hyper
  source 1..124: mol_type = genomic DNA
taggggccccagctgcgccctccggggagacacccgctgccacgagacccgggaggggaagcgggaggagggggagaggaggggaaggcgggggaggcgccgagggtggaggccaagcgcggcg

SEQ ID NO: 54914 - DNA, 12 bp, Homo sapiens
  misc_feature 1..12: note = chr12:5541088-5541100
  misc_feature 1..12: note = hyper
  source 1..12: mol_type = genomic DNA
aaatgacccctt

SEQ ID NO: 54915 - DNA, 13 bp, Homo sapiens
  misc_feature 1..13: note = chr12:5541177-5541190
  misc_feature 1..13: note = hyper
  source 1..13: mol_type = genomic DNA
ggggagggcggcg

SEQ ID NO: 54916 - DNA, 205 bp, Homo sapiens; identical to SEQ ID NO: 34232
  misc_feature 1..205: note = chr12:5541504-5541709
  misc_feature 1..205: note = hyper
  source 1..205: mol_type = genomic DNA

SEQ ID NO: 54917 - DNA, 310 bp, Homo sapiens
  misc_feature 1..310: note = chr12:5542015-5542325
  misc_feature 1..310: note = hyper
  source 1..310: mol_type = genomic DNA
tggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcg

SEQ ID NO: 54918 - DNA, 320 bp, Homo sapiens; identical to SEQ ID NO: 21298
  misc_feature 1..320: note = chr12:5542439-5542759
  misc_feature 1..320: note = hyper
  source 1..320: mol_type = genomic DNA

SEQ ID NO: 54919 - DNA, 116 bp, Homo sapiens; identical to SEQ ID NO: 34234
  misc_feature 1..116: note = chr12:6444922-6445038
  misc_feature 1..116: note = hyper
  source 1..116: mol_type = genomic DNA

SEQ ID NO: 54920 - DNA, 30 bp, Homo sapiens; identical to SEQ ID NO: 34235
  misc_feature 1..30: note = chr12:6450544-6450574
  misc_feature 1..30: note = hyper
  source 1..30: mol_type = genomic DNA

SEQ ID NO: 54921 - DNA, 90 bp, Homo sapiens; identical to SEQ ID NO: 34236
  misc_feature 1..90: note = chr12:6472461-6472551
  misc_feature 1..90: note = hyper
  source 1..90: mol_type = genomic DNA

SEQ ID NO: 54922 - DNA, 46 bp, Homo sapiens; identical to SEQ ID NO: 34237
  misc_feature 1..46: note = chr12:6472854-6472900
  misc_feature 1..46: note = hyper
  source 1..46: mol_type = genomic DNA

SEQ ID NO: 54923 - DNA, 138 bp, Homo sapiens; identical to SEQ ID NO: 21299
  misc_feature 1..138: note = chr12:6664370-6664508
  misc_feature 1..138: note = hyper
  source 1..138: mol_type = genomic DNA

SEQ ID NO: 54924 - DNA, 65 bp, Homo sapiens; identical to SEQ ID NO: 34239
  misc_feature 1..65: note = chr12:6809448-6809513
  misc_feature 1..65: note = hyper
  source 1..65: mol_type = genomic DNA

SEQ ID NO: 54925 - DNA, 30 bp, Homo sapiens; identical to SEQ ID NO: 34240
  misc_feature 1..30: note = chr12:8088887-8088917
  misc_feature 1..30: note = hyper
  source 1..30: mol_type = genomic DNA

SEQ ID NO: 54926 - DNA, 386 bp, Homo sapiens; identical to SEQ ID NO: 34241
  misc_feature 1..386: note = chr12:8123142-8123528
  misc_feature 1..386: note = hyper
  source 1..386: mol_type = genomic DNA

SEQ ID NO: 54927 - DNA, 66 bp, Homo sapiens
  misc_feature 1..66: note = chr12:8171294-8171360
  misc_feature 1..66: note = hyper
  source 1..66: mol_type = genomic DNA
aatctggccccaggccgccgccgccgcgcccggcagtgacagcgaccgcgccgctgcgctcccgcc

SEQ ID NO: 54928 - DNA, 141 bp, Homo sapiens
  misc_feature 1..141: note = chr12:8171745-8171886
  misc_feature 1..141: note = hyper
  source 1..141: mol_type = genomic DNA
ctgcggcagggaggtggtgccccggctatcgccgcgggctggccggctgggctgggaagaaggctcagggtgagatcaggcaaagagttctttcggactcacgagctctttttggatgaaaagccccgcagttctctccac

SEQ ID NO: 54929 - DNA, 92 bp, Homo sapiens; identical to SEQ ID NO: 34243
  misc_feature 1..92: note = chr12:8548890-8548982
  misc_feature 1..92: note = hyper
  source 1..92: mol_type = genomic DNA

SEQ ID NO: 54930 - DNA, 160 bp, Homo sapiens; identical to SEQ ID NO: 34244
  misc_feature 1..160: note = chr12:10306356-10306516
  misc_feature 1..160: note = hyper
  source 1..160: mol_type = genomic DNA

SEQ ID NO: 54931 - DNA, 279 bp, Homo sapiens; identical to SEQ ID NO: 34245
  misc_feature 1..279: note = chr12:11653509-11653788
  misc_feature 1..279: note = hyper
  source 1..279: mol_type = genomic DNA

SEQ ID NO: 54932 - DNA, 30 bp, Homo sapiens; identical to SEQ ID NO: 11139
  misc_feature 1..30: note = chr12:12869188-12869218
  misc_feature 1..30: note = hyper
  source 1..30: mol_type = genomic DNA

SEQ ID NO: 54933 - DNA, 43 bp, Homo sapiens; identical to SEQ ID NO: 34247
  misc_feature 1..43: note = chr12:13069440-13069483
  misc_feature 1..43: note = hyper
  source 1..43: mol_type = genomic DNA

SEQ ID NO: 54934 - DNA, 208 bp, Homo sapiens; identical to SEQ ID NO: 34248
  misc_feature 1..208: note = chr12:13154576-13154784
  misc_feature 1..208: note = hyper
  source 1..208: mol_type = genomic DNA

SEQ ID NO: 54935 - DNA, 51 bp, Homo sapiens; identical to SEQ ID NO: 34249
  misc_feature 1..51: note = chr12:13431314-13431365
  misc_feature 1..51: note = hyper
  source 1..51: mol_type = genomic DNA

SEQ ID NO: 54936 - DNA, 30 bp, Homo sapiens; identical to SEQ ID NO: 34250
  misc_feature 1..30: note = chr12:14133113-14133143
  misc_feature 1..30: note = hyper
  source 1..30: mol_type = genomic DNA

SEQ ID NO: 54937 - DNA, 30 bp, Homo sapiens; identical to SEQ ID NO: 34251
  misc_feature 1..30: note = chr12:14133343-14133373
  misc_feature 1..30: note = hyper
  source 1..30: mol_type = genomic DNA

SEQ ID NO: 54938 - DNA, 32 bp, Homo sapiens
  misc_feature 1..32: note = chr12:14133587-14133619
  misc_feature 1..32: note = hyper
  source 1..32: mol_type = genomic DNA
gaagggggggagaagcggcaccatacagcaac

SEQ ID NO: 54939 - DNA, 1230 bp, Homo sapiens
  misc_feature 1..1230: note = chr12:14133881-14135111
  misc_feature 1..1230: note = hyper
  source 1..1230: mol_type = genomic DNA
ccccgcgcacactcacccccgcgcacactcacgctgccgccgcgctgaggtgcagcgcacggggcttcacctgcaacgtgtcgattggacggatgggctcggcgcgtgggtccggcccggggcgccgctgccctgcccctctgctaggtgaagggatgaaaccccccaaaagaccagagacagccctacccagtcacagcaccccctcccccacaaaaaaaaaaaacctttaaaaaagccacgtccaaattagcaagtgccgggttctgctggatttcagagctttacctcatgccagattcgttcacgatttcacggcttcgaccctttatctgcctgacacccccaaacccctacattcaaaggagagactccaaagcccatctttacgtaccggctccgagcgcctccgcggttgcagtctgcggagaggggtggccggtggctgggaatggagggttttcctttcctgcaaagcaggattaatgatccgtctcgggggttttgaagttcatgactcttctttgcaaggcaaaaggatatgcattcggacgccagcactactggatggtggtgatcaagaatcacccttgacgagcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtg

SEQ ID NO: 54940 - DNA, 333 bp, Homo sapiens; identical to SEQ ID NO: 34253
  misc_feature 1..333: note = chr12:14927056-14927389
  misc_feature 1..333: note = hyper
  source 1..333: mol_type = genomic DNA

SEQ ID NO: 54941 - DNA, 83 bp, Homo sapiens; identical to SEQ ID NO: 34254
  misc_feature 1..83: note = chr12:14927697-14927780
  misc_feature 1..83: note = hyper
  source 1..83: mol_type = genomic DNA

SEQ ID NO: 54942 - DNA, 30 bp, Homo sapiens; identical to SEQ ID NO: 34255
  misc_feature 1..30: note = chr12:14928130-14928160
  misc_feature 1..30: note = hyper
  source 1..30: mol_type = genomic DNA

SEQ ID NO: 54943 - DNA, 59 bp, Homo sapiens
  misc_feature 1..59: note = chr12:15374199-15374258
  misc_feature 1..59: note = hyper
  source 1..59: mol_type = genomic DNA
agccctcccacactgcgcagcccaggcttcaggttgcgtttgcgagttgctgggctgcg

SEQ ID NO: 54944 - DNA, 236 bp, Homo sapiens
  misc_feature 1..236: note = chr12:15374291-15374527
  misc_feature 1..236: note = hyper
  source 1..236: mol_type = genomic DNA
cagtggcccggcgggggtctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttcccttttt

SEQ ID NO: 54945 - DNA, 70 bp, Homo sapiens; identical to SEQ ID NO: 34257
  misc_feature 1..70: note = chr12:15475751-15475821
  misc_feature 1..70: note = hyper
  source 1..70: mol_type = genomic DNA

SEQ ID NO: 54946 - DNA, 41 bp, Homo sapiens; identical to SEQ ID NO: 34258
  misc_feature 1..41: note = chr12:16500483-16500524
  misc_feature 1..41: note = hyper
  source 1..41: mol_type = genomic DNA

SEQ ID NO: 54947 - DNA, 119 bp, Homo sapiens; identical to SEQ ID NO: 34259
  misc_feature 1..119: note = chr12:16757916-16758035
  misc_feature 1..119: note = hyper
  source 1..119: mol_type = genomic DNA

SEQ ID NO: 54948 - DNA, 30 bp, Homo sapiens; identical to SEQ ID NO: 34260
  misc_feature 1..30: note = chr12:16758398-16758428
  misc_feature 1..30: note = hyper
  source 1..30: mol_type = genomic DNA

SEQ ID NO: 54949 - DNA, 89 bp, Homo sapiens; identical to SEQ ID NO: 34261
  misc_feature 1..89: note = chr12:20521231-20521320
  misc_feature 1..89: note = hyper
  source 1..89: mol_type = genomic DNA

SEQ ID NO: 54950 - DNA, 110 bp, Homo sapiens
  misc_feature 1..110: note = chr12:20522347-20522457
  misc_feature 1..110: note = hyper
  source 1..110: mol_type = genomic DNA
cgtggctgctggggagacctggtgctgcagccgctccggagctctcggaaactttcctccgcgctgtgcgcgggctccctgtcctttctgctggcgctgctggtgaggct

SEQ ID NO: 54951 - DNA, 282 bp, Homo sapiens
  misc_feature 1..282: note = chr12:20522487-20522769
  misc_feature 1..282: note = hyper
  source 1..282: mol_type = genomic DNA
gcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatca

SEQ ID NO: 54952 - DNA, 337 bp, Homo sapiens; identical to SEQ ID NO: 21315
  misc_feature 1..337: note = chr12:21680683-21681020
  misc_feature 1..337: note = hyper
  source 1..337: mol_type = genomic DNA

SEQ ID NO: 54953 - DNA, 106 bp, Homo sapiens
  misc_feature 1..106: note = chr12:21810868-21810974
  misc_feature 1..106: note = hyper
  source 1..106: mol_type = genomic DNA
ggctcgctcaatccccttcaaggacaagggctcaagtatgcacactccctcccccaccctccagatgaggaggtctccttccagaggcttccgctctcagctggtc

SEQ ID NO: 54954 - DNA, 208 bp, Homo sapiens; identical to SEQ ID NO: 34266
  misc_feature 1..208: note = chr12:21927174-21927382
  misc_feature 1..208: note = hyper
  source 1..208: mol_type = genomic DNA

SEQ ID NO: 54955 - DNA, 30 bp, Homo sapiens; identical to SEQ ID NO: 34267
  misc_feature 1..30: note = chr12:21927596-21927626
  misc_feature 1..30: note = hyper
  source 1..30: mol_type = genomic DNA

SEQ ID NO: 54956 - DNA, 45 bp, Homo sapiens; identical to SEQ ID NO: 34268
  misc_feature 1..45: note = chr12:21927907-21927952
  misc_feature 1..45: note = hyper
  source 1..45: mol_type = genomic DNA

SEQ ID NO: 54957 - DNA, 34 bp, Homo sapiens; identical to SEQ ID NO: 34269
  misc_feature 1..34: note = chr12:21928417-21928451
  misc_feature 1..34: note = hyper
  source 1..34: mol_type = genomic DNA

SEQ ID NO: 54958 - DNA, 238 bp, Homo sapiens; identical to SEQ ID NO: 21318
  misc_feature 1..238: note = chr12:22094810-22095048
  misc_feature 1..238: note = hyper
  source 1..238: mol_type = genomic DNA

SEQ ID NO: 54959 - DNA, 794 bp, Homo sapiens
  misc_feature 1..794: note = chr12:22487473-22488267
  misc_feature 1..794: note = hyper
  source 1..794: mol_type = genomic DNA
cggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgcgcgcc

SEQ ID NO: 54960 - DNA, 340 bp, Homo sapiens; identical to SEQ ID NO: 34276
  misc_feature 1..340: note = chr12:22488339-22488679
  misc_feature 1..340: note = hyper
  source 1..340: mol_type = genomic DNA

SEQ ID NO: 54961 - DNA, 273 bp, Homo sapiens
  misc_feature 1..273: note = chr12:24714636-24714909
  misc_feature 1..273: note = hyper
  source 1..273: mol_type = genomic DNA
ttgtttcagaaattccgggcgggagggagggggagtggtagggagaaggattgcagaaagcgaaacaaaaagacgaaagagtcgggaggtgggggtgactaaggttagggggtgggccaggggtcgctctgatatcctagaagggttaaggggctttgtccaacttttagggtctggccttggacattggccgcgatgcccagcacagcccagggttctccccgcactctcctctcgcatcaaccacctccaccgccaccacttacaaaacaa

SEQ ID NO: 54962 - DNA, 77 bp, Homo sapiens
  misc_feature 1..77: note = chr12:24715158-24715235
  misc_feature 1..77: note = hyper
  source 1..77: mol_type = genomic DNA
gctgagtggcgggcccggcgagcggcagaggggagctctgcgccttggaggtctgcccacaacaacatcgggacgaa

SEQ ID NO: 54963 - DNA, 119 bp, Homo sapiens
  misc_feature 1..119: note = chr12:24715264-24715383
  misc_feature 1..119: note = hyper
  source 1..119: mol_type = genomic DNA
accttacccggtctcgttaatgcctcctccggcgtgggatgcaaagtggcacagaggcgggctgggggcccccgggaggagactggagatgggttttggtggctcgcctttttcactct

SEQ ID NO: 54964 - DNA, 276 bp, Homo sapiens
  misc_feature 1..276: note = chr12:24715757-24716033
  misc_feature 1..276: note = hyper
  source 1..276: mol_type = genomic DNA
ctccttcttgcagctcgccgcccggccgccctctctatccatccgaagggaaggagccccagagttttcttccccgtctgctgcagagtaactagattgtaaataacgcggcgattacccacaccgtgcaggaattttttttttatctgccctccacttaaaggagcgataaaaatgaaatggcaggagtggaaggagccagggagagcgggatatctctagatctcgatggagctcgcatctataaatacgcattcatgtttagtcaagtccctt

SEQ ID NO: 54965 - DNA, 199 bp, Homo sapiens; identical to SEQ ID NO: 21324
  misc_feature 1..199: note = chr12:24716218-24716417
  misc_feature 1..199: note = hyper
  source 1..199: mol_type = genomic DNA

SEQ ID NO: 54966 - DNA, 51 bp, Homo sapiens
  misc_feature 1..51: note = chr12:25056436-25056487
  misc_feature 1..51: note = hyper
  source 1..51: mol_type = genomic DNA
gccactgaccgctatgtgcaaactgaagggggagaacgtgaatccagcttt

SEQ ID NO: 54967 - DNA, 217 bp, Homo sapiens
  misc_feature 1..217: note = chr12:25101375-25101592
  misc_feature 1..217: note = hyper
  source 1..217: mol_type = genomic DNA
taacagtgaaaagatcgttctccctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgta

SEQ ID NO: 54968 - DNA, 259 bp, Homo sapiens; identical to SEQ ID NO: 21326
  misc_feature 1..259: note = chr12:25101660-25101919
  misc_feature 1..259: note = hyper
  source 1..259: mol_type = genomic DNA

SEQ ID NO: 54969 - DNA, 57 bp, Homo sapiens; identical to SEQ ID NO: 34284
  misc_feature 1..57: note = chr12:26348245-26348302
  misc_feature 1..57: note = hyper
  source 1..57: mol_type = genomic DNA

SEQ ID NO: 54970 - DNA, 219 bp, Homo sapiens; identical to SEQ ID NO: 11168
  misc_feature 1..219: note = chr12:28122168-28122387
  misc_feature 1..219: note = hyper
  source 1..219: mol_type = genomic DNA

SEQ ID NO: 54971 - DNA, 35 bp, Homo sapiens; identical to SEQ ID NO: 34286
  misc_feature 1..35: note = chr12:28123589-28123624
  misc_feature 1..35: note = hyper
  source 1..35: mol_type = genomic DNA

SEQ ID NO: 54972 - DNA, 119 bp, Homo sapiens
  misc_feature 1..119: note = chr12:28127648-28127767
  misc_feature 1..119: note = hyper
  source 1..119: mol_type = genomic DNA
ctgccctggtgtttgcgctcccactgcagcaagggaggcctgagtctcttagggcaggggtccagggtcttgggagaggccttagggcaagggggatgatctttttcagcctcccctcc

SEQ ID NO: 54973 - skipped

SEQ ID NO: 54974 - DNA, 114 bp, Homo sapiens
  misc_feature 1..114: note = chr12:29935902-29936016
  misc_feature 1..114: note = hyper
  source 1..114: mol_type = genomic DNA
cgtctcatctgaacgaaacccttaaggggctgatacacttctcatctgcaaagctgcccaacagcctccgagaaattctctacttggaagcatcgccaccaccgccacccctcc

SEQ ID NO: 54975 - DNA, 275 bp, Homo sapiens
  misc_feature 1..275: note = chr12:29936048-29936323
  misc_feature 1..275: note = hyper
  source 1..275: mol_type = genomic DNA
gtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtc

SEQ ID NO: 54976 - DNA, 336 bp, Homo sapiens
  misc_feature 1..336: note = chr12:29936995-29937331
  misc_feature 1..336: note = hyper
  source 1..336: mol_type = genomic DNA
ggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctc

SEQ ID NO: 54977 - DNA, 28 bp, Homo sapiens
  misc_feature 1..28: note = chr12:29937374-29937402
  misc_feature 1..28: note = hyper
  source 1..28: mol_type = genomic DNA
ctgcccgggctttctctcacccgcccgg

SEQ ID NO: 54978-54979 - skipped (2 entries)

SEQ ID NO: 54980 - DNA, 68 bp, Homo sapiens; identical to SEQ ID NO: 34295
  misc_feature 1..68: note = chr12:30354049-30354117
  misc_feature 1..68: note = hyper
  source 1..68: mol_type = genomic DNA

SEQ ID NO: 54981 - DNA, 15 bp, Homo sapiens
  misc_feature 1..15: note = chr12:30975310-30975325
  misc_feature 1..15: note = hyper
  source 1..15: mol_type = genomic DNA
cacaaaacaaaagag

SEQ ID NO: 54982 - DNA, 184 bp, Homo sapiens; identical to SEQ ID NO: 21331
  misc_feature 1..184: note = chr12:30975388-30975572
  misc_feature 1..184: note = hyper
  source 1..184: mol_type = genomic DNA

SEQ ID NO: 54983 - DNA, 10 bp, Homo sapiens
  misc_feature 1..10: note = chr12:31079258-31079268
  misc_feature 1..10: note = hyper
  source 1..10: mol_type = genomic DNA
gcagggagac

SEQ ID NO: 54984 - DNA, 165 bp, Homo sapiens; identical to SEQ ID NO: 21332
  misc_feature 1..165: note = chr12:31079499-31079664
  misc_feature 1..165: note = hyper
  source 1..165: mol_type = genomic DNA

SEQ ID NO: 54985 - DNA, 117 bp, Homo sapiens; identical to SEQ ID NO: 3868
  misc_feature 1..117: note = chr12:31079693-31079810
  misc_feature 1..117: note = hyper
  source 1..117: mol_type = genomic DNA

SEQ ID NO: 54986 - DNA, 30 bp, Homo sapiens; identical to SEQ ID NO: 34301
  misc_feature 1..30: note = chr12:33048755-33048785
  misc_feature 1..30: note = hyper
  source 1..30: mol_type = genomic DNA

SEQ ID NO: 54987 - DNA, 64 bp, Homo sapiens; identical to SEQ ID NO: 34302
  misc_feature 1..64: note = chr12:33049326-33049390
  misc_feature 1..64: note = hyper
  source 1..64: mol_type = genomic DNA

SEQ ID NO: 54988 - DNA, 209 bp, Homo sapiens
  misc_feature 1..209: note = chr12:33591804-33592013
  misc_feature 1..209: note = hyper
  source 1..209: mol_type = genomic DNA
ccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggagg

SEQ ID NO: 54989 - DNA, 28 bp, Homo sapiens
  misc_feature 1..28: note = chr12:33592057-33592085
  misc_feature 1..28: note = hyper
  source 1..28: mol_type = genomic DNA
cggcgccgggaggcgggaagcggaccag

SEQ ID NO: 54990 - DNA, 35 bp, Homo sapiens
  misc_feature 1..35: note = chr12:33592578-33592613
  misc_feature 1..35: note = hyper
  source 1..35: mol_type = genomic DNA
tgcgccgctgagagccggcaactcttaggagcccc

SEQ ID NO: 54991 - DNA, 102 bp, Homo sapiens; identical to SEQ ID NO: 34307
  misc_feature 1..102: note = chr12:33592932-33593034
  misc_feature 1..102: note = hyper
  source 1..102: mol_type = genomic DNA

SEQ ID NO: 54992 - DNA, 40 bp, Homo sapiens; identical to SEQ ID NO: 11185
  misc_feature 1..40: note = chr12:33593092-33593132
  misc_feature 1..40: note = hyper
  source 1..40: mol_type = genomic DNA

SEQ ID NO: 54993 - DNA, 66 bp, Homo sapiens; identical to SEQ ID NO: 34309
  misc_feature 1..66: note = chr12:39298564-39298630
  misc_feature 1..66: note = hyper
  source 1..66: mol_type = genomic DNA

SEQ ID NO: 54994 - DNA, 82 bp, Homo sapiens; identical to SEQ ID NO: 21338
  misc_feature 1..82: note = chr12:39299560-39299642
  misc_feature 1..82: note = hyper
  source 1..82: mol_type = genomic DNA

SEQ ID NO: 54995 - DNA, 111 bp, Homo sapiens; identical to SEQ ID NO: 34311
  misc_feature 1..111: note = chr12:39299877-39299988
  misc_feature 1..111: note = hyper
  source 1..111: mol_type = genomic DNA

SEQ ID NO: 54996 - DNA, 30 bp, Homo sapiens; identical to SEQ ID NO: 11188
  misc_feature 1..30: note = chr12:39300375-39300405
  misc_feature 1..30: note = hyper
  source 1..30: mol_type = genomic DNA

SEQ ID NO: 54997 - DNA, 32 bp, Homo sapiens; identical to SEQ ID NO: 34313
  misc_feature 1..32: note = chr12:39539440-39539472
  misc_feature 1..32: note = hyper
  source 1..32: mol_type = genomic DNA

SEQ ID NO: 54998 - DNA, 225 bp, Homo sapiens
  misc_feature 1..225: note = chr12:40618470-40618695
  misc_feature 1..225: note = hyper
  source 1..225: mol_type = genomic DNA
cagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctg

SEQ ID NO: 54999 - DNA, 30 bp, Homo sapiens; identical to SEQ ID NO: 34315
  misc_feature 1..30: note = chr12:40619018-40619048
  misc_feature 1..30: note = hyper
  source 1..30: mol_type = genomic DNA

SEQ ID NO: 55000 - skipped

SEQ ID NO: 55001 - DNA, 86 bp, Homo sapiens
  misc_feature 1..86: note = chr12:41582427-41582513
  misc_feature 1..86: note = hyper
  source 1..86: mol_type = genomic DNA
gcccttggcgcccggcgagctgtaccgggtgctgccgctgcgcagcctcatccagaagctgcgagtccagtgcgactaccgcgccc

SEQ ID NO: 55002 - DNA, 241 bp, Homo sapiens; identical to SEQ ID NO: 11193
  misc_feature 1..241: note = chr12:41583049-41583290
  misc_feature 1..241: note = hyper
  source 1..241: mol_type = genomic DNA

SEQ ID NO: 55003 - DNA, 35 bp, Homo sapiens; identical to SEQ ID NO: 34320
  misc_feature 1..35: note = chr12:42326337-42326372
  misc_feature 1..35: note = hyper
  source 1..35: mol_type = genomic DNA

SEQ ID NO: 55004 - DNA, 74 bp, Homo sapiens; identical to SEQ ID NO: 34321
  misc_feature 1..74: note = chr12:42326647-42326721
  misc_feature 1..74: note = hyper
  source 1..74: mol_type = genomic DNA

SEQ ID NO: 55005 - DNA, 559 bp, Homo sapiens; identical to SEQ ID NO: 34322
  misc_feature 1..559: note = chr12:42983315-42983874
  misc_feature 1..559: note = hyper
  source 1..559: mol_type = genomic DNA

SEQ ID NO: 55006 - DNA, 42 bp, Homo sapiens; identical to SEQ ID NO: 34323
  misc_feature 1..42: note = chr12:42984438-42984480
  misc_feature 1..42: note = hyper
  source 1..42: mol_type = genomic DNA

SEQ ID NO: 55007 - DNA, 255 bp, Homo sapiens
  misc_feature 1..255: note = chr12:43945526-43945781
  misc_feature 1..255: note = hyper
  source 1..255: mol_type = genomic DNA
ggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacatggttccaccctggggaccccgatcggggaggcccaccagagccgccggcagccaagc

SEQ ID NO: 55008 - DNA, 121 bp, Homo sapiens; identical to SEQ ID NO: 21346
  misc_feature 1..121: note = chr12:43946298-43946419
  misc_feature 1..121: note = hyper
  source 1..121: mol_type = genomic DNA

SEQ ID NO: 55009 - DNA, 376 bp, Homo sapiens; identical to SEQ ID NO: 34328
  misc_feature 1..376: note = chr12:45269011-45269387
  misc_feature 1..376: note = hyper
  source 1..376: mol_type = genomic DNA

SEQ ID NO: 55010 - DNA, 88 bp, Homo sapiens
  misc_feature 1..88: note = chr12:45269416-45269504
  misc_feature 1..88: note = hyper
  source 1..88: mol_type = genomic DNA
cgcggtctccaaggcaagcacagaaaaaaaaaaaatccatatccaaacccgcccccttactccaagcttcccactccagacctacttt

SEQ ID NO: 55011 - DNA, 278 bp, Homo sapiens
  misc_feature 1..278: note = chr12:45269624-45269902
  misc_feature 1..278: note = hyper
  source 1..278: mol_type = genomic DNA
atgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccg

SEQ ID NO: 55012 - DNA, 233 bp, Homo sapiens; identical to SEQ ID NO: 34330
  misc_feature 1..233: note = chr12:45270680-45270913
  misc_feature 1..233: note = hyper
  source 1..233: mol_type = genomic DNA

SEQ ID NO: 55013 - DNA, 32 bp, Homo sapiens; identical to SEQ ID NO: 34331
  misc_feature 1..32: note = chr12:45443857-45443889
  misc_feature 1..32: note = hyper
  source 1..32: mol_type = genomic DNA

SEQ ID NO: 55014 - DNA, 141 bp, Homo sapiens; identical to SEQ ID NO: 21351
  misc_feature 1..141: note = chr12:45445258-45445399
  misc_feature 1..141: note = hyper
  source 1..141: mol_type = genomic DNA

SEQ ID NO: 55015 - DNA, 86 bp, Homo sapiens; identical to SEQ ID NO: 34335
  misc_feature 1..86: note = chr12:46767304-46767390
  misc_feature 1..86: note = hyper
  source 1..86: mol_type = genomic DNA

SEQ ID NO: 55016 - DNA, 276 bp, Homo sapiens; identical to SEQ ID NO: 34336
  misc_feature 1..276: note = chr12:47225027-47225303
  misc_feature 1..276: note = hyper
  source 1..276: mol_type = genomic DNA

SEQ ID NO: 55017 - DNA, 62 bp, Homo sapiens
  misc_feature 1..62: note = chr12:47225319-47225381
  misc_feature 1..62: note = hyper
  source 1..62: mol_type = genomic DNA
cgccctcggaaccgctggcgcagttttcagactcgcccaccgcccagagaccaggggcccac

SEQ ID NO: 55018 - DNA, 61 bp, Homo sapiens
  misc_feature 1..61: note = chr12:47225579-47225640
  misc_feature 1..61: note = hyper
  source 1..61: mol_type = genomic DNA
cagcaggatcccgggcggtcgcggagccagctcccgcgggggaagtcgggcctctcagcca

SEQ ID NO: 55019 - DNA, 30 bp, Homo sapiens; identical to SEQ ID NO: 34339
  misc_feature 1..30: note = chr12:48395941-48395971
  misc_feature 1..30: note = hyper
  source 1..30: mol_type = genomic DNA

SEQ ID NO: 55020 - DNA, 327 bp, Homo sapiens; identical to SEQ ID NO: 34340
  misc_feature 1..327: note = chr12:48396748-48397075
  misc_feature 1..327: note = hyper
  source 1..327: mol_type = genomic DNA

SEQ ID NO: 55021 - DNA, 60 bp, Homo sapiens
  misc_feature 1..60: note = chr12:48397135-48397195
  misc_feature 1..60: note = hyper
  source 1..60: mol_type = genomic DNA
ctggctcggtgagttccagaatttagaaaagtaactcattgtagtacctcggggcggcgg

SEQ ID NO: 55022 - DNA, 531 bp, Homo sapiens
  misc_feature 1..531: note = chr12:48398070-48398601
  misc_feature 1..531: note = hyper
  source 1..531: mol_type = genomic DNA
gcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgccccccgctgggctgtaacctgaaccgcccgcccccggagcccgcctgggccctgccagtgcccgcacctgcccaagccggacccccctctctgggagtcacgcttcccgccctccacccctagtgcgccgagtggcctgatcgggcggggcgcagagatggcccctgccccccaaacccggggctgcggcgctgcccccctctgaccacaggcgggaagggtggcctccggcccctcccctcggagttctgccgga

SEQ ID NO: 55023 - DNA, 188 bp, Homo sapiens; identical to SEQ ID NO: 34342
  misc_feature 1..188: note = chr12:48576788-48576976
  misc_feature 1..188: note = hyper
  source 1..188: mol_type = genomic DNA

SEQ ID NO: 55024 - DNA, 44 bp, Homo sapiens; identical to SEQ ID NO: 34343
  misc_feature 1..44: note = chr12:48577469-48577513
  misc_feature 1..44: note = hyper
  source 1..44: mol_type = genomic DNA

SEQ ID NO: 55025 - DNA, 432 bp, Homo sapiens; identical to SEQ ID NO: 34344
  misc_feature 1..432: note = chr12:48577898-48578330
  misc_feature 1..432: note = hyper
  source 1..432: mol_type = genomic DNA

SEQ ID NO: 55026 - DNA, 64 bp, Homo sapiens
  misc_feature 1..64: note = chr12:49297738-49297802
  misc_feature 1..64: note = hyper
  source 1..64: mol_type = genomic DNA
ataaataaataaataaataaataaataaaatgcactgaggagacagatttttgagagttaaaag

SEQ ID NO: 55027 - DNA, 20 bp, Homo sapiens
  misc_feature 1..20: note = chr12:49297915-49297935
  misc_feature 1..20: note = hyper
  source 1..20: mol_type = genomic DNA
agacgcgtcttacagtggga

SEQ ID NO: 55028 - DNA, 95 bp, Homo sapiens; identical to SEQ ID NO: 34346
  misc_feature 1..95: note = chr12:49363823-49363918
  misc_feature 1..95: note = hyper
  source 1..95: mol_type = genomic DNA

SEQ ID NO: 55029 - DNA, 30 bp, Homo sapiens; identical to SEQ ID NO: 34347
  misc_feature 1..30: note = chr12:49364135-49364165
  misc_feature 1..30: note = hyper
  source 1..30: mol_type = genomic DNA

SEQ ID NO: 55030 - DNA, 101 bp, Homo sapiens
  misc_feature 1..101: note = chr12:49366423-49366524
  misc_feature 1..101: note = hyper
  source 1..101: mol_type = genomic DNA
ctcaccctcgaagctctaaccactgtgggctatttttgccagagaggggccccaggctttccagccgccccccgcccctgccagaccgcagcccaaggcac

SEQ ID NO: 55031 - DNA, 39 bp, Homo sapiens; identical to SEQ ID NO: 34349
  misc_feature 1..39: note = chr12:49367954-49367993
  misc_feature 1..39: note = hyper
  source 1..39: mol_type = genomic DNA

SEQ ID NO: 55032 - DNA, 30 bp, Homo sapiens; identical to SEQ ID NO: 34350
  misc_feature 1..30: note = chr12:49373373-49373403
  misc_feature 1..30: note = hyper
  source 1..30: mol_type = genomic DNA

SEQ ID NO: 55033 - DNA, 693 bp, Homo sapiens; identical to SEQ ID NO: 34351
  misc_feature 1..693: note = chr12:49373730-49374423
  misc_feature 1..693: note = hyper
  source 1..693: mol_type = genomic DNA

SEQ ID NO: 55034 - DNA, 233 bp, Homo sapiens
  misc_feature 1..233: note = chr12:49374681-49374914
  misc_feature 1..233: note = hyper
  source 1..233: mol_type = genomic DNA
caagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactct

SEQ ID NO: 55035 - DNA, 206 bp, Homo sapiens
  misc_feature 1..206: note = chr12:49375119-49375325
  misc_feature 1..206: note = hyper
  source 1..206: mol_type = genomic DNA
gctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgc

SEQ ID NO: 55036 - DNA, 241 bp, Homo sapiens; identical to SEQ ID NO: 34354
  misc_feature 1..241: note = chr12:49388730-49388971
  misc_feature 1..241: note = hyper
  source 1..241: mol_type = genomic DNA

SEQ ID NO: 55037 - DNA, 35 bp, Homo sapiens
  misc_feature 1..35: note = chr12:49390838-49390873
  misc_feature 1..35: note = hyper
  source 1..35: mol_type = genomic DNA
tagggccctggggtccgcgcccagccccggccggc

SEQ ID NO: 55038 - DNA, 209 bp, Homo sapiens
  misc_feature 1..209: note = chr12:49391877-49392086
  misc_feature 1..209: note = hyper
  source 1..209: mol_type = genomic DNA
gagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggc

SEQ ID NO: 55039 - DNA, 44 bp, Homo sapiens; identical to SEQ ID NO: 34357
  misc_feature 1..44: note = chr12:49392556-49392600
  misc_feature 1..44: note = hyper
  source 1..44: mol_type = genomic DNA

SEQ ID NO: 55040 - DNA, 530 bp, Homo sapiens; identical to SEQ ID NO: 34358
  misc_feature 1..530: note = chr12:49483686-49484216
  misc_feature 1..530: note = hyper
  source 1..530: mol_type = genomic DNA

SEQ ID NO: 55041 - DNA, 170 bp, Homo sapiens; identical to SEQ ID NO: 34359
  misc_feature 1..170: note = chr12:49485716-49485886
  misc_feature 1..170: note = hyper
  source 1..170: mol_type = genomic DNA

SEQ ID NO: 55042 - DNA, 30 bp, Homo sapiens; identical to SEQ ID NO: 34360
  misc_feature 1..30: note = chr12:49487666-49487696
  misc_feature 1..30: note = hyper
  source 1..30: mol_type = genomic DNA

SEQ ID NO: 55043 - DNA, 30 bp, Homo sapiens; identical to SEQ ID NO: 34361
  misc_feature 1..30: note = chr12:49688858-49688888
  misc_feature 1..30: note = hyper
  source 1..30: mol_type = genomic DNA

SEQ ID NO: 55044 - DNA, 66 bp, Homo sapiens
  misc_feature 1..66: note = chr12:49690983-49691049
  misc_feature 1..66: note = hyper
  source 1..66: mol_type = genomic DNA
caagcaggagatgaacgagtcccgacgccagatccagagtctaacgtgcgaggtggacgggctgcg

SEQ ID NO: 55045 - DNA, 15 bp, Homo sapiens
  misc_feature 1..15: note = chr12:49729713-49729728
  misc_feature 1..15: note = hyper
  source 1..15: mol_type = genomic DNA
ggcatctcacctgtc

SEQ ID NO: 55046 - DNA, 272 bp, Homo sapiens; identical to SEQ ID NO: 21363
  misc_feature 1..272: note = chr12:49730090-49730362
  misc_feature 1..272: note = hyper
  source 1..272: mol_type = genomic DNA

SEQ ID NO: 55047 - DNA, 55 bp, Homo sapiens; identical to SEQ ID NO: 34365
  misc_feature 1..55: note = chr12:49735987-49736042
  misc_feature 1..55: note = hyper
  source 1..55: mol_type = genomic DNA

SEQ ID NO: 55048 - DNA, 36 bp, Homo sapiens; identical to SEQ ID NO: 34366
  misc_feature 1..36: note = chr12:49736792-49736828
  misc_feature 1..36: note = hyper
  source 1..36: mol_type = genomic DNA

SEQ ID NO: 55049 - DNA, 36 bp, Homo sapiens; identical to SEQ ID NO: 21364
  misc_feature 1..36: note = chr12:50297461-50297497
  misc_feature 1..36: note = hyper
  source 1..36: mol_type = genomic DNA

SEQ ID NO: 55050 - DNA, 33 bp, Homo sapiens; identical to SEQ ID NO: 21365
  misc_feature 1..33: note = chr12:50298055-50298088
  misc_feature 1..33: note = hyper
  source 1..33: mol_type = genomic DNA

SEQ ID NO: 55051 - DNA, 186 bp, Homo sapiens; identical to SEQ ID NO: 11223
  misc_feature 1..186: note = chr12:50355598-50355784
  misc_feature 1..186: note = hyper
  source 1..186: mol_type = genomic DNA

SEQ ID NO: 55052 - DNA, 80 bp, Homo sapiens
  misc_feature 1..80: note = chr12:50426799-50426879
  misc_feature 1..80: note = hyper
  source 1..80: mol_type = genomic DNA
catcgacgatccctggacgcgggcgtcgggggcagggaggcttggctaggtccctggctgccaaccgtctggccacagcc

SEQ ID NO: 55053 - DNA, 241 bp, Homo sapiens; identical to SEQ ID NO: 34371
  misc_feature 1..241: note = chr12:50444182-50444423
  misc_feature 1..241: note = hyper
  source 1..241: mol_type = genomic DNA

SEQ ID NO: 55054 - DNA, 85 bp, Homo sapiens; identical to SEQ ID NO: 34372
  misc_feature 1..85: note = chr12:52208668-52208753
  misc_feature 1..85: note = hyper
  source 1..85: mol_type = genomic DNA

SEQ ID NO: 55055 - DNA, 109 bp, Homo sapiens; identical to SEQ ID NO: 34373
  misc_feature 1..109: note = chr12:52241703-52241812
  misc_feature 1..109: note = hyper
  source 1..109: mol_type = genomic DNA

SEQ ID NO: 55056 - DNA, 133 bp, Homo sapiens; identical to SEQ ID NO: 34374
  misc_feature 1..133: note = chr12:52242262-52242395
  misc_feature 1..133: note = hyper
  source 1..133: mol_type = genomic DNA

SEQ ID NO: 55057 - DNA, 180 bp, Homo sapiens
  misc_feature 1..180: note = chr12:52262803-52262983
  misc_feature 1..180: note = hyper
  source 1..180: mol_type = genomic DNA
cgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcg

SEQ ID NO: 55058 - DNA, 307 bp, Homo sapiens
  misc_feature 1..307: note = chr12:52263106-52263413
  misc_feature 1..307: note = hyper
  source 1..307: mol_type = genomic DNA
gctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccag

SEQ ID NO: 55059 - DNA, 133 bp, Homo sapiens
  misc_feature 1..133: note = chr12:52301147-52301280
  misc_feature 1..133: note = hyper
  source 1..133: mol_type = genomic DNA
gtcctgcagccccagcgaggggcgagcggcggccagtcggcgagctgggcaataaggaaacggtttattaggagggagtggtggagctgggccaggcaggaagacgctggaataagaaacatttttgctccag

SEQ ID NO: 55060 - DNA, 32 bp, Homo sapiens; identical to SEQ ID NO: 34377
  misc_feature 1..32: note = chr12:52317406-52317438
  misc_feature 1..32: note = hyper
  source 1..32: mol_type = genomic DNA

SEQ ID NO: 55061 - DNA, 37 bp, Homo sapiens; identical to SEQ ID NO: 34378
  misc_feature 1..37: note = chr12:52400452-52400489
  misc_feature 1..37: note = hyper
  source 1..37: mol_type = genomic DNA

SEQ ID NO: 55062 - DNA, 315 bp, Homo sapiens
  misc_feature 1..315: note = chr12:52400516-52400831
  misc_feature 1..315: note = hyper
  source 1..315: mol_type = genomic DNA
cgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgc

SEQ ID NO: 55063 - DNA, 30 bp, Homo sapiens; identical to SEQ ID NO: 34381
  misc_feature 1..30: note = chr12:52615930-52615960
  misc_feature 1..30: note = hyper
  source 1..30: mol_type = genomic DNA

SEQ ID NO: 55064 - DNA, 182 bp, Homo sapiens; identical to SEQ ID NO: 34382
  misc_feature 1..182: note = chr12:52626865-52627047
  misc_feature 1..182: note = hyper
  source 1..182: mol_type = genomic DNA

SEQ ID NO: 55065 - DNA, 15 bp, Homo sapiens
  misc_feature 1..15: note = chr12:52652138-52652153
  misc_feature 1..15: note = hyper
  source 1..15: mol_type = genomic DNA
tgcgtccgcaggagc

SEQ ID NO: 55066 - DNA, 23 bp, Homo sapiens
  misc_feature 1..23: note = chr12:52652613-52652636
  misc_feature 1..23: note = hyper
  source 1..23: mol_type = genomic DNA
cacctgtccgcccctccgccggg

SEQ ID NO: 55067 - DNA, 30 bp, Homo sapiens; identical to SEQ ID NO: 34386
  misc_feature 1..30: note = chr12:52701983-52702013
  misc_feature 1..30: note = hyper
  source 1..30: mol_type = genomic DNA

SEQ ID NO: 55068 - DNA, 211 bp, Homo sapiens; identical to SEQ ID NO: 11234
  misc_feature 1..211: note = chr12:52702362-52702573
  misc_feature 1..211: note = hyper
  source 1..211: mol_type = genomic DNA

SEQ ID NO: 55069 - DNA, 30 bp, Homo sapiens; identical to SEQ ID NO: 34388
  misc_feature 1..30: note = chr12:53084893-53084923
  misc_feature 1..30: note = hyper
  source 1..30: mol_type = genomic DNA

SEQ ID NO: 55070 - DNA, 15 bp, Homo sapiens
  misc_feature 1..15: note = chr12:53108074-53108089
  misc_feature 1..15: note = hyper
  source 1..15: mol_type = genomic DNA
aaggggactggggtc

SEQ ID NO: 55071 - DNA, 258 bp, Homo sapiens
  misc_feature 1..258: note = chr12:53108218-53108476
  misc_feature 1..258: note = hyper
  source 1..258: mol_type = genomic DNA
gccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggcaaggcgtgggg

SEQ ID NO: 55072 - DNA, 41 bp, Homo sapiens; identical to SEQ ID NO: 34390
  misc_feature 1..41: note = chr12:53359275-53359316
  misc_feature 1..41: note = hyper
  source 1..41: mol_type = genomic DNA

SEQ ID NO: 55073 - DNA, 32 bp, Homo sapiens
  misc_feature 1..32: note = chr12:53359563-53359595
  misc_feature 1..32: note = hyper
  source 1..32: mol_type = genomic DNA
ctcctgggagagcccaccgagagttctggggc

SEQ ID NO: 55074 - DNA, 183 bp, Homo sapiens; identical to SEQ ID NO: 34392
  misc_feature 1..183: note = chr12:53719608-53719791
  misc_feature 1..183: note = hyper
  source 1..183: mol_type = genomic DNA

SEQ ID NO: 55075 - DNA, 12 bp, Homo sapiens
  misc_feature 1..12: note = chr12:54089081-54089093
  misc_feature 1..12: note = hyper
  source 1..12: mol_type = genomic DNA
ttttttttttat

SEQ ID NO: 55076 - DNA, 134 bp, Homo sapiens
  misc_feature 1..134: note = chr12:54089511-54089645
  misc_feature 1..134: note = hyper
  source 1..134: mol_type = genomic DNA
aagaggaaccgcagatgccgggtggcgggagaggggctggggctgcagggagacaggtgggtttggtcggggttgggggttaggaggggaggacatgctctctgcaaattaggtgcaaacgaaggctcagaatg

SEQ ID NO: 55077 - DNA, 29 bp, Homo sapiens
  misc_feature 1..29: note = chr12:54132329-54132358
  misc_feature 1..29: note = hyper
  source 1..29: mol_type = genomic DNA
ccctccggcaaaggcggagggacggcctg

SEQ ID NO: 55078 - DNA, 763 bp, Homo sapiens; identical to SEQ ID NO: 34395
  misc_feature 1..763: note = chr12:54144857-54145620
  misc_feature 1..763: note = hyper
  source 1..763: mol_type = genomic DNA

SEQ ID NO: 55079 - DNA, 77 bp, Homo sapiens
  misc_feature 1..77: note = chr12:54145895-54145972
  misc_feature 1..77: note = hyper
  source 1..77: mol_type = genomic DNA
cttgggctcccctccaaggtcccctccgctcgcccctctctgcccgctgccgccgccgccgccgccttccaggcctc

SEQ ID NO: 55080 - DNA, 278 bp, Homo sapiens
  misc_feature 1..278: note = chr12:54321628-54321906
  misc_feature 1..278: note = hyper
  source 1..278: mol_type = genomic DNA
acttgccgcggcttcgagtagagacgttggtgcgggacccaactcctggggaaggcggggagcgctgggcggatgcctggccctagtgcggcgccaacacatacaagttccgctgtgaatgtttgaaagtgtaagtttctctcggattgatttttttttcctttaaatgtatccccttcaaaaaaaaaaaaaaacaaacaaacaaaaaaaaaaaaaacaaagacgtggacaggcaggcgccacccggtctgggagctgaggttcgtgactgctgccga

SEQ ID NO: 55081 - DNA, 70 bp, Homo sapiens
  misc_feature 1..70: note = chr12:54322131-54322201
  misc_feature 1..70: note = hyper
  source 1..70: mol_type = genomic DNA
agtcgggagcccccacgcgccagtcgagcctacgcagctgtggggtgggaaggagaagacaagtcctccg

SEQ ID NO: 55082 - DNA, 255 bp, Homo sapiens
  misc_feature 1..255: note = chr12:54324544-54324799
  misc_feature 1..255: note = hyper
  source 1..255: mol_type = genomic DNA
gggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtg

SEQ ID NO: 55083 - DNA, 28 bp, Homo sapiens
  misc_feature 1..28: note = chr12:54324937-54324965
  misc_feature 1..28: note = hyper
  source 1..28: mol_type = genomic DNA
aggagcacaatgccgctaaatgatgcct

SEQ ID NO: 55084 - DNA, 82 bp, Homo sapiens
  misc_feature 1..82: note = chr12:54329276-54329358
  misc_feature 1..82: note = hyper
  source 1..82: mol_type = genomic DNA
acgcacatacacagacgcttcccgtgaaaaagcatattaaatatctcctttctgtgttggatcatttaaaagaaaacatttc

SEQ ID NO: 55085 - DNA, 144 bp, Homo sapiens; identical to SEQ ID NO: 34403
  misc_feature 1..144: note = chr12:54330304-54330448
  misc_feature 1..144: note = hyper
  source 1..144: mol_type = genomic DNA

SEQ ID NO: 55086 - DNA, 206 bp, Homo sapiens
  misc_feature 1..206: note = chr12:54330856-54331062
  misc_feature 1..206: note = hyper
  source 1..206: mol_type = genomic DNA
aatgccagcccagcccgcagcctgctttctgaactctgagctgacccttctggatgaagatcacgcagataagaattactatcctaactcaccgatgtccgggtgctctcaaccgtcaaacaccaccttctccccacaaagaggagggaggtggcccgaaggggtttctgcagacctgtccatttgctctccacttgaggggtgca

SEQ ID NO: 55087 - DNA, 377 bp, Homo sapiens
  misc_feature 1..377: note = chr12:54333337-54333714
  misc_feature 1..377: note = hyper
  source 1..377: mol_type = genomic DNA
ctgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcag

SEQ ID NO: 55088 - DNA, 243 bp, Homo sapiens
  misc_feature 1..243: note = chr12:54343569-54343812
  misc_feature 1..243: note = hyper
  source 1..243: mol_type = genomic DNA
aaggccttgatcttccggtggccagcgaaggggagggctgcttgcccccttgacgcgccatcccccttcccgcaggagcccgccgcctctgtttacacacagaggaggtgtcgtctccagtctagacaagggcgctaataacgcccataaaaggcggcctctccagagatgctctggcaactccgctcccgcgcgcctgccgctggccgctttctccacctccccccgccccgcccttctctg

SEQ ID NO: 55089 - DNA, 40 bp, Homo sapiens; identical to SEQ ID NO: 34409
  misc_feature 1..40: note = chr12:54345186-54345226
  misc_feature 1..40: note = hyper
  source 1..40: mol_type = genomic DNA

SEQ ID NO: 55090 - DNA, 37 bp, Homo sapiens
  misc_feature 1..37: note = chr12:54345574-54345611
  misc_feature 1..37: note = hyper
  source 1..37: mol_type = genomic DNA
gcaccaatcgctccacggtttgggtgcctcggcctga

SEQ ID NO: 55091 - DNA, 57 bp, Homo sapiens
  misc_feature 1..57: note = chr12:54348787-54348844
  misc_feature 1..57: note = hyper
  source 1..57: mol_type = genomic DNA
cttccccaacttccgcgcgtccggggcgcagcttcccgggctgccttcgctgtccta

SEQ ID NO: 55092 - DNA, 39 bp, Homo sapiens
  misc_feature 1..39: note = chr12:54349336-54349375
  misc_feature 1..39: note = hyper
  source 1..39: mol_type = genomic DNA
ccactcaagcggcggattcaaacccgacctcttaccagg

SEQ ID NO: 55093 - DNA, 73 bp, Homo sapiens; identical to SEQ ID NO: 21383
  misc_feature 1..73: note = chr12:54354621-54354694
  misc_feature 1..73: note = hyper
  source 1..73: mol_type = genomic DNA

SEQ ID NO: 55094 - DNA, 91 bp, Homo sapiens
  misc_feature 1..91: note = chr12:54354814-54354905
  misc_feature 1..91: note = hyper
  source 1..91: mol_type = genomic DNA
cggaaggttccggtgtaattcagcgggaggtggaaggcaggccccgatcccacagcgcgcctatgctcagcctttggtccgagcggccgcc

SEQ ID NO: 55095 - DNA, 40 bp, Homo sapiens; identical to SEQ ID NO: 34416
  misc_feature 1..40: note = chr12:54359643-54359683
  misc_feature 1..40: note = hyper
  source 1..40: mol_type = genomic DNA

SEQ ID NO: 55096 - DNA, 218 bp, Homo sapiens
  misc_feature 1..218: note = chr12:54359742-54359960
  misc_feature 1..218: note = hyper
  source 1..218: mol_type = genomic DNA
cgtaccttataaggaaggcgccggtcctccatttcagccttttctctgccaggacgcggccgtggcatttctggtcttgtaaacatcagactctttggggccttaaaaaaataaagacgcccctccttcctttaccgggggtgagccggccggggaaagcggcggacagggaaatcaactaatgaagactccgggaaacttttctctctttttctctc

SEQ ID NO: 55097 - DNA, 30 bp, Homo sapiens; identical to SEQ ID NO: 34418
  misc_feature 1..30: note = chr12:54363641-54363671
  misc_feature 1..30: note = hyper
  source 1..30: mol_type = genomic DNA

SEQ ID NO: 55098 - DNA, 376 bp, Homo sapiens; identical to SEQ ID NO: 34419
  misc_feature 1..376: note = chr12:54366919-54367295
  misc_feature 1..376: note = hyper
  source 1..376: mol_type = genomic DNA

SEQ ID NO: 55099 - DNA, 105 bp, Homo sapiens; identical to SEQ ID NO: 34420
  misc_feature 1..105: note = chr12:54367525-54367630
  misc_feature 1..105: note = hyper
  source 1..105: mol_type = genomic DNA

SEQ ID NO: 55100 - DNA, 72 bp, Homo sapiens; identical to SEQ ID NO: 34421
  misc_feature 1..72: note = chr12:54368360-54368432
  misc_feature 1..72: note = hyper
  source 1..72: mol_type = genomic DNA

SEQ ID NO: 55101 - DNA, 355 bp, Homo sapiens; identical to SEQ ID NO: 34422
  misc_feature 1..355: note = chr12:54368647-54369002
  misc_feature 1..355: note = hyper
  source 1..355: mol_type = genomic DNA

SEQ ID NO: 55102 - DNA, 75 bp, Homo sapiens; identical to SEQ ID NO: 34423
  misc_feature 1..75: note = chr12:54377164-54377239
  misc_feature 1..75: note = hyper
  source 1..75: mol_type = genomic DNA

SEQ ID NO: 55103 - DNA, 83 bp, Homo sapiens
  misc_feature 1..83: note = chr12:54378115-54378198
  misc_feature 1..83: note = hyper
  source 1..83: mol_type = genomic DNA
tctggcttcctctttcccctaccccgcgtccattcggaacctccttttccgagcagccatgaagtgaccgtgaccccctccct

SEQ ID NO: 55104 - DNA, 360 bp, Homo sapiens
  misc_feature 1..360: note = chr12:54378814-54379174
  misc_feature 1..360: note = hyper
  source 1..360: mol_type = genomic DNA
cgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgat

SEQ ID NO: 55105 - DNA, 265 bp, Homo sapiens
  misc_feature 1..265: note = chr12:54379623-54379888
  misc_feature 1..265: note = hyper
  source 1..265: mol_type = genomic DNA
gcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccagga

SEQ ID NO: 55106 - DNA, 256 bp, Homo sapiens; identical to SEQ ID NO: 21390
  misc_feature 1..256: note = chr12:54387959-54388215
  misc_feature 1..256: note = hyper
  source 1..256: mol_type = genomic DNA

SEQ ID NO: 55107 - DNA, 102 bp, Homo sapiens
  misc_feature 1..102: note = chr12:54388245-54388347
  misc_feature 1..102: note = hyper
  source 1..102: mol_type = genomic DNA
tagaaaggaccttgaggtctgctgggtgtttgggctgccctgggggcggcggcccagagtgtggagcaagcggcgcgcggggcgcggcggtcagcgtgggag

SEQ ID NO: 55108 - DNA, 208 bp, Homo sapiens; identical to SEQ ID NO: 34428
  misc_feature 1..208: note = chr12:54388627-54388835
  misc_feature 1..208: note = hyper
  source 1..208: mol_type = genomic DNA

SEQ ID NO: 55109 - DNA, 95 bp, Homo sapiens; identical to SEQ ID NO: 34429
  misc_feature 1..95: note = chr12:54389157-54389252
  misc_feature 1..95: note = hyper
  source 1..95: mol_type = genomic DNA

SEQ ID NO: 55110 - DNA, 26 bp, Homo sapiens
  misc_feature 1..26: note = chr12:54391298-54391324
  misc_feature 1..26: note = hyper
  source 1..26: mol_type = genomic DNA
cccgcggcaaaggcccggcaagccag

SEQ ID NO: 55111 - DNA, 256 bp, Homo sapiens
  misc_feature 1..256: note = chr12:54391403-54391659
  misc_feature 1..256: note = hyper
  source 1..256: mol_type = genomic DNA
tccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcg

SEQ ID NO: 55112 - skipped

SEQ ID NO: 55113 - DNA, 18 bp, Homo sapiens
  misc_feature 1..18: note = chr12:54393461-54393479
  misc_feature 1..18: note = hyper
  source 1..18: mol_type = genomic DNA
gattacgtcaagaaatag

SEQ ID NO: 55114 - DNA, 40 bp, Homo sapiens; identical to SEQ ID NO: 21394
  misc_feature 1..40: note = chr12:54393684-54393724
  misc_feature 1..40: note = hyper
  source 1..40: mol_type = genomic DNA

SEQ ID NO: 55115 - DNA, 152 bp, Homo sapiens; identical to SEQ ID NO: 21395
  misc_feature 1..152: note = chr12:54393798-54393950
  misc_feature 1..152: note = hyper
  source 1..152: mol_type = genomic DNA

SEQ ID NO: 55116 - DNA, 248 bp, Homo sapiens; identical to SEQ ID NO: 21396
  misc_feature 1..248: note = chr12:54394162-54394410
  misc_feature 1..248: note = hyper
  source 1..248: mol_type = genomic DNA

SEQ ID NO: 55117 - DNA, 195 bp, Homo sapiens; identical to SEQ ID NO: 11269
  misc_feature 1..195: note = chr12:54394466-54394661
  misc_feature 1..195: note = hyper
  source 1..195: mol_type = genomic DNA

SEQ ID NO: 55118 - DNA, 77 bp, Homo sapiens; identical to SEQ ID NO: 34436
  misc_feature 1..77: note = chr12:54398709-54398786
  misc_feature 1..77: note = hyper
  source 1..77: mol_type = genomic DNA

SEQ ID NO: 55119 - DNA, 137 bp, Homo sapiens; identical to SEQ ID NO: 21398
  misc_feature 1..137: note = chr12:54398959-54399096
  misc_feature 1..137: note = hyper
  source 1..137: mol_type = genomic DNA

SEQ ID NO: 55120 - DNA, 261 bp, Homo sapiens
  misc_feature 1..261: note = chr12:54399355-54399616
  misc_feature 1..261: note = hyper
  source 1..261: mol_type = genomic DNA
tttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgtt

SEQ ID NO: 55121 - DNA, 21 bp, Homo sapiens
  misc_feature 1..21: note = chr12:54399646-54399667
  misc_feature 1..21: note = hyper
  source 1..21: mol_type = genomic DNA
agatcgcggcagttgctttgc

SEQ ID NO: 55122 - DNA, 14 bp, Homo sapiens
  misc_feature 1..14: note = chr12:54402676-54402690
  misc_feature 1..14: note = hyper
  source 1..14: mol_type = genomic DNA
tcatgtcgtggatt

SEQ ID NO: 55123 - DNA, 211 bp, Homo sapiens; identical to SEQ ID NO: 21401
  misc_feature 1..211: note = chr12:54402856-54403067
  misc_feature 1..211: note = hyper
  source 1..211: mol_type = genomic DNA

SEQ ID NO: 55124 - DNA, 120 bp, Homo sapiens
  misc_feature 1..120: note = chr12:54403360-54403480
  misc_feature 1..120: note = hyper
  source 1..120: mol_type = genomic DNA
ccctttatggggctcagcaagaggcgagcgtggtgcaatatcccgactgtaaatcctccgccaacactaacagtagcgaaggacaaggccacttaaatcaaaactcgtctcccagcctca

SEQ ID NO: 55125 - DNA, 95 bp, Homo sapiens
  misc_feature 1..95: note = chr12:54408316-54408411
  misc_feature 1..95: note = hyper
  source 1..95: mol_type = genomic DNA
ggcccagtagcctagcggaatgaacccagcattaaatggctccgaagggcctcgccgccttttccccacaccaaatgtgccatttatcccttgtc

SEQ ID NO: 55126 - DNA, 61 bp, Homo sapiens; identical to SEQ ID NO: 34442
  misc_feature 1..61: note = chr12:54422441-54422502
  misc_feature 1..61: note = hyper
  source 1..61: mol_type = genomic DNA

SEQ ID NO: 55127 - DNA, 22 bp, Homo sapiens
  misc_feature 1..22: note = chr12:54425119-54425141
  misc_feature 1..22: note = hyper
  source 1..22: mol_type = genomic DNA
gaccgcgggactggagccctgt

SEQ ID NO: 55128 - DNA, 300 bp, Homo sapiens; identical to SEQ ID NO: 34444
  misc_feature 1..300: note = chr12:54440853-54441153
  misc_feature 1..300: note = hyper
  source 1..300: mol_type = genomic DNA

SEQ ID NO: 55129 - DNA, 30 bp, Homo sapiens; identical to SEQ ID NO: 34445
  misc_feature 1..30: note = chr12:54446784-54446814
  misc_feature 1..30: note = hyper
  source 1..30: mol_type = genomic DNA

SEQ ID NO: 55130 - DNA, 45 bp, Homo sapiens
  misc_feature 1..45: note = chr12:54447977-54448022
  misc_feature 1..45: note = hyper
  source 1..45: mol_type = genomic DNA
ccgagaaatcacagtcgctctgcgagccggcgcctctctcaggcg

SEQ ID NO: 55131 - DNA, 68 bp, Homo sapiens; identical to SEQ ID NO: 34447
  misc_feature 1..68: note = chr12:54500146-54500214
  misc_feature 1..68: note = hyper
  source 1..68: mol_type = genomic DNA

SEQ ID NO: 55132 - DNA, 193 bp, Homo sapiens; identical to SEQ ID NO: 34448
  misc_feature 1..193: note = chr12:54520001-54520194
  misc_feature 1..193: note = hyper
  source 1..193: mol_type = genomic DNA

SEQ ID NO: 55133 - DNA, 524 bp, Homo sapiens
  misc_feature 1..524: note = chr12:54520221-54520745
  misc_feature 1..524: note = hyper
  source 1..524: mol_type = genomic DNA
cgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgagggg

SEQ ID NO: 55134 - DNA, 143 bp, Homo sapiens
  misc_feature 1..143: note = chr12:54520868-54521011
  misc_feature 1..143: note = hyper
  source 1..143: mol_type = genomic DNA
aaaaacccagccgcgtcccaaacccgctcaccccagcaggcccttagagacgcttggagatccccagacacgccccgcggaaagggaaggaaatgccagcccgagttgccgactctgccgggacggggcgggggatccgccca

SEQ ID NO: 55135 - DNA, 85 bp, Homo sapiens; identical to SEQ ID NO: 34450
  misc_feature 1..85: note = chr12:54611458-54611543
  misc_feature 1..85: note = hyper
  source 1..85: mol_type = genomic DNA

SEQ ID NO: 55136 - DNA, 204 bp, Homo sapiens
  misc_feature 1..204: note = chr12:54812034-54812238
  misc_feature 1..204: note = hyper
  source 1..204: mol_type = genomic DNA
gcccttggctgagttcgcccccagccccagggccccagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggc

SEQ ID NO: 55137 - DNA, 263 bp, Homo sapiens; identical to SEQ ID NO: 21410
  misc_feature 1..263: note = chr12:54812359-54812622
  misc_feature 1..263: note = hyper
  source 1..263: mol_type = genomic DNA

SEQ ID NO: 55138 - DNA, 52 bp, Homo sapiens; identical to SEQ ID NO: 34453
  misc_feature 1..52: note = chr12:54943371-54943423
  misc_feature 1..52: note = hyper
  source 1..52: mol_type = genomic DNA

SEQ ID NO: 55139 - DNA, 30 bp, Homo sapiens; identical to SEQ ID NO: 34454
  misc_feature 1..30: note = chr12:54982627-54982657
  misc_feature 1..30: note = hyper
  source 1..30: mol_type = genomic DNA

SEQ ID NO: 55140 - DNA, 166 bp, Homo sapiens; identical to SEQ ID NO: 34455
  misc_feature 1..166: note = chr12:57613840-57614006
  misc_feature 1..166: note = hyper
  source 1..166: mol_type = genomic DNA

SEQ ID NO: 55141 - DNA, 30 bp, Homo sapiens; identical to SEQ ID NO: 34456
  misc_feature 1..30: note = chr12:57614370-57614400
  misc_feature 1..30: note = hyper
  source 1..30: mol_type = genomic DNA

SEQ ID NO: 55142 - DNA, 47 bp, Homo sapiens; identical to SEQ ID NO: 34458
  misc_feature 1..47: note = chr12:57619110-57619157
  misc_feature 1..47: note = hyper
  source 1..47: mol_type = genomic DNA

SEQ ID NO: 55143 - DNA, 33 bp, Homo sapiens; identical to SEQ ID NO: 34459
  misc_feature 1..33: note = chr12:57632036-57632069
  misc_feature 1..33: note = hyper
  source 1..33: mol_type = genomic DNA

SEQ ID NO: 55144 - DNA, 64 bp, Homo sapiens; identical to SEQ ID NO: 34460
  misc_feature 1..64: note = chr12:57632479-57632543
  misc_feature 1..64: note = hyper
  source 1..64: mol_type = genomic DNA

SEQ ID NO: 55145 - DNA, 60 bp, Homo sapiens; identical to SEQ ID NO: 34461
  misc_feature 1..60: note = chr12:57635046-57635106
  misc_feature 1..60: note = hyper
  source 1..60: mol_type = genomic DNA

SEQ ID NO: 55146 - DNA, 256 bp, Homo sapiens; identical to SEQ ID NO: 34462
  misc_feature 1..256: note = chr12:57869962-57870218
  misc_feature 1..256: note = hyper
  source 1..256: mol_type = genomic DNA

SEQ ID NO: 55147 - DNA, 301 bp, Homo sapiens
  misc_feature 1..301: note = chr12:57943780-57944081
  misc_feature 1..301: note = hyper
  source 1..301: mol_type = genomic DNA
cgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagc

SEQ ID NO: 55148 - DNA, 68 bp, Homo sapiens; identical to SEQ ID NO: 21415
  misc_feature 1..68: note = chr12:57944117-57944185
  misc_feature 1..68: note = hyper
  source 1..68: mol_type = genomic DNA

SEQ ID NO: 55149 - DNA, 30 bp, Homo sapiens; identical to SEQ ID NO: 34464
  misc_feature 1..30: note = chr12:58004572-58004602
  misc_feature 1..30: note = hyper
  source 1..30: mol_type = genomic DNA

SEQ ID NO: 55150 - DNA, 133 bp, Homo sapiens; identical to SEQ ID NO: 34465
  misc_feature 1..133: note = chr12:58004814-58004947
  misc_feature 1..133: note = hyper
  source 1..133: mol_type = genomic DNA

SEQ ID NO: 55151 - DNA, 383 bp, Homo sapiens; identical to SEQ ID NO: 34466
  misc_feature 1..383: note = chr12:58014820-58015203
  misc_feature 1..383: note = hyper
  source 1..383: mol_type = genomic DNA

SEQ ID NO: 55152 - DNA, 27 bp, Homo sapiens
  misc_feature 1..27: note = chr12:58021293-58021320
  misc_feature 1..27: note = hyper
  source 1..27: mol_type = genomic DNA
ccgctggcggctgggcgcgggtgcagc

SEQ ID NO: 55153 - DNA, 203 bp, Homo sapiens
  misc_feature 1..203: note = chr12:58021713-58021916
  misc_feature 1..203: note = hyper
  source 1..203: mol_type = genomic DNA
ggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcgg

SEQ ID NO: 55154 - DNA, 66 bp, Homo sapiens
  misc_feature 1..66: note = chr12:58025580-58025646
  misc_feature 1..66: note = hyper
  source 1..66: mol_type = genomic DNA
tcactccacacagcccgttaggagaatgcaggcatctgagcccagcagtggagaaaacaaaagccc

SEQ ID NO: 55155 - DNA, 136 bp, Homo sapiens
  misc_feature 1..136: note = chr12:58025873-58026009
  misc_feature 1..136: note = hyper
  source 1..136: mol_type = genomic DNA
cagaaggaccagagcgcacagggcccggcggcccagccacatcctaggtgggggtagggtggggagtgagaaagggagggaagaagggagggcaagggatggggcccttggcccccgcgtcctcagaggctcctgc

SEQ ID NO: 55156 - DNA, 230 bp, Homo sapiens; identical to SEQ ID NO: 34471
  misc_feature 1..230: note = chr12:58026065-58026295
  misc_feature 1..230: note = hyper
  source 1..230: mol_type = genomic DNA

SEQ ID NO: 55157 - DNA, 97 bp, Homo sapiens; identical to SEQ ID NO: 34472
  misc_feature 1..97: note = chr12:58159773-58159870
  misc_feature 1..97: note = hyper
  source 1..97: mol_type = genomic DNA

SEQ ID NO: 55158 - DNA, 82 bp, Homo sapiens; identical to SEQ ID NO: 34473
  misc_feature 1..82: note = chr12:58160215-58160297
  misc_feature 1..82: note = hyper
  source 1..82: mol_type = genomic DNA

SEQ ID NO: 55159 - DNA, 48 bp, Homo sapiens; identical to SEQ ID NO: 34474
  misc_feature 1..48: note = chr12:59313895-59313943
  misc_feature 1..48: note = hyper
  source 1..48: mol_type = genomic DNA

SEQ ID NO: 55160 - DNA, 243 bp, Homo sapiens; identical to SEQ ID NO: 34475
  misc_feature 1..243: note = chr12:59990053-59990296
  misc_feature 1..243: note = hyper
  source 1..243: mol_type = genomic DNA

SEQ ID NO: 55161 - DNA, 30 bp, Homo sapiens; identical to SEQ ID NO: 34476
  misc_feature 1..30: note = chr12:62584322-62584352
  misc_feature 1..30: note = hyper
  source 1..30: mol_type = genomic DNA

SEQ ID NO: 55162 - DNA, 161 bp, Homo sapiens
  misc_feature 1..161: note = chr12:62584677-62584838
  misc_feature 1..161: note = hyper
  source 1..161: mol_type = genomic DNA
gtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgac

SEQ ID NO: 55163 - DNA, 185 bp, Homo sapiens
  misc_feature 1..185: note = chr12:62586017-62586202
  misc_feature 1..185: note = hyper
  source 1..185: mol_type = genomic DNA
gcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggcc

SEQ ID NO: 55164 - DNA, 140 bp, Homo sapiens; identical to SEQ ID NO: 34479
  misc_feature 1..140: note = chr12:62829159-62829299
  misc_feature 1..140: note = hyper
  source 1..140: mol_type = genomic DNA

SEQ ID NO: 55165 - DNA, 86 bp, Homo sapiens; identical to SEQ ID NO: 34481
  misc_feature 1..86: note = chr12:63327187-63327273
  misc_feature 1..86: note = hyper
  source 1..86: mol_type = genomic DNA

SEQ ID NO: 55166 - skipped

SEQ ID NO: 55167 - DNA, 152 bp, Homo sapiens; identical to SEQ ID NO: 34484
  misc_feature 1..152: note = chr12:63544728-63544880
  misc_feature 1..152: note = hyper
  source 1..152: mol_type = genomic DNA

SEQ ID NO: 55168 - DNA, 20 bp, Homo sapiens
  misc_feature 1..20: note = chr12:63545343-63545363
  misc_feature 1..20: note = hyper
  source 1..20: mol_type = genomic DNA
cagtccgggtttcttccttc

SEQ ID NO: 55169 - DNA, 43 bp, Homo sapiens
  misc_feature 1..43: note = chr12:64061778-64061821
  misc_feature 1..43: note = hyper
  source 1..43: mol_type = genomic DNA
aagactcaagaaaagcgccatgcggctccctcctagggctctc

SEQ ID NO: 55170 - DNA, 210 bp, Homo sapiens
  misc_feature 1..210: note = chr12:64062159-64062369
  misc_feature 1..210: note = hyper
  source 1..210: mol_type = genomic DNA
ccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccc

SEQ ID NO: 55171 - DNA, 343 bp, Homo sapiens; identical to SEQ ID NO: 21425
  misc_feature 1..343: note = chr12:64062578-64062921
  misc_feature 1..343: note = hyper
  source 1..343: mol_type = genomic DNA

SEQ ID NO: 55172 - DNA, 55 bp, Homo sapiens; identical to SEQ ID NO: 21426
  misc_feature 1..55: note = chr12:64063096-64063151
  misc_feature 1..55: note = hyper
  source 1..55: mol_type = genomic DNA

SEQ ID NO: 55173 - DNA, 282 bp, Homo sapiens
  misc_feature 1..282: note = chr12:64784252-64784534
  misc_feature 1..282: note = hyper
  source 1..282: mol_type = genomic DNA
gtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccag

SEQ ID NO: 55174 - DNA, 113 bp, Homo sapiens
  misc_feature 1..113: note = chr12:64784564-64784677
  misc_feature 1..113: note = hyper
  source 1..113: mol_type = genomic DNA
cctcagacggcgatgggcggggcaagacgctggtccttcaggcccgagttgatgggcacctcgggctcatcaccgtgaagtcccctgcggccgaagggcggtggatttttagg

SEQ ID NO: 55175 - DNA, 61 bp, Homo sapiens
  misc_feature 1..61: note = chr12:65219156-65219217
  misc_feature 1..61: note = hyper
  source 1..61: mol_type = genomic DNA
gttccaggctcgcaggaagccagaccttgcgagaggtgtgtgggggcggagagtggcacag

SEQ ID NO: 55176 - DNA, 109 bp, Homo sapiens
  misc_feature 1..109: note = chr12:65219784-65219893
  misc_feature 1..109: note = hyper
  source 1..109: mol_type = genomic DNA
gttctcccctaggaagtgtctagttgcagaggctgtagtatttattcaccatcttcctttacctcttttttttttcttttaaatctccttcccacgttaaaagtaagtg

SEQ ID NO: 55177 - DNA, 93 bp, Homo sapiens; identical to SEQ ID NO: 21429
  misc_feature 1..93: note = chr12:65220112-65220205
  misc_feature 1..93: note = hyper
  source 1..93: mol_type = genomic DNA

SEQ ID NO: 55178 - DNA, 89 bp, Homo sapiens; identical to SEQ ID NO: 21430
  misc_feature 1..89: note = chr12:65220350-65220439
  misc_feature 1..89: note = hyper
  source 1..89: mol_type = genomic DNA

SEQ ID NO: 55179 - DNA, 28 bp, Homo sapiens
  misc_feature 1..28: note = chr12:65514835-65514863
  misc_feature 1..28: note = hyper
  source 1..28: mol_type = genomic DNA
ttgcctggtgagcatcgatccataggta

SEQ ID NO: 55180 - DNA, 73 bp, Homo sapiens; identical to SEQ ID NO: 34496
  misc_feature 1..73: note = chr12:65673227-65673300
  misc_feature 1..73: note = hyper
  source 1..73: mol_type = genomic DNA

SEQ ID NO: 55181 - DNA, 151 bp, Homo sapiens; identical to SEQ ID NO: 11310
  misc_feature 1..151: note = chr12:66122419-66122570
  misc_feature 1..151: note = hyper
  source 1..151: mol_type = genomic DNA

SEQ ID NO: 55182 - DNA, 12 bp, Homo sapiens
  misc_feature 1..12: note = chr12:66122788-66122800
  misc_feature 1..12: note = hyper
  source 1..12: mol_type = genomic DNA
cgagaggtgtct

SEQ ID NO: 55183 - DNA, 196 bp, Homo sapiens; identical to SEQ ID NO: 34500
  misc_feature 1..196: note = chr12:66135151-66135347
  misc_feature 1..196: note = hyper
  source 1..196: mol_type = genomic DNA

SEQ ID NO: 55184 - DNA, 195 bp, Homo sapiens; identical to SEQ ID NO: 34501
  misc_feature 1..195: note = chr12:66135407-66135602
  misc_feature 1..195: note = hyper
  source 1..195: mol_type = genomic DNA

SEQ ID NO: 55185 - DNA, 121 bp, Homo sapiens
  misc_feature 1..121: note = chr12:66135863-66135984
  misc_feature 1..121: note = hyper
  source 1..121: mol_type = genomic DNA
cgcagggcgcacgcacgcatcccggccccctcacactcacactgcgtcttctgtcacaccccctgtcgcacacacactgttctctgactcccaccatctcctgtctcacacccactccagt

SEQ ID NO: 55186 - DNA, 179 bp, Homo sapiens
  misc_feature 1..179: note = chr12:66136014-66136193
  misc_feature 1..179: note = hyper
  source 1..179: mol_type = genomic DNA
ggtcgcgccggcgcacgctcgtccccttctgccccggagcccgcccgcgccgcacggtggccccttgcgctggcctgatcgtgggaaccaggcggggccccagcgtccctgcccctgcccggtcatccatctccctcccggtcggccagccgagacttcaaaggcgcctcctccggccg

SEQ ID NO: 55187 - DNA, 72 bp, Homo sapiens; identical to SEQ ID NO: 11316
  misc_feature 1..72: note = chr12:66217530-66217602
  misc_feature 1..72: note = hyper
  source 1..72: mol_type = genomic DNA

SEQ ID NO: 55188 - DNA, 410 bp, Homo sapiens; identical to SEQ ID NO: 34504
  misc_feature 1..410: note = chr12:66218917-66219327
  misc_feature 1..410: note = hyper
  source 1..410: mol_type = genomic DNA

SEQ ID NO: 55189 - DNA, 30 bp, Homo sapiens; identical to SEQ ID NO: 34505
  misc_feature 1..30: note = chr12:66219897-66219927
  misc_feature 1..30: note = hyper
  source 1..30: mol_type = genomic DNA

SEQ ID NO: 55190 - DNA, 11 bp, Homo sapiens
  misc_feature 1..11: note = chr12:66582816-66582827
  misc_feature 1..11: note = hyper
  source 1..11: mol_type = genomic DNA
agaggtgtgaa

SEQ ID NO: 55191 - DNA, 192 bp, Homo sapiens
  misc_feature 1..192: note = chr12:66583137-66583329
  misc_feature 1..192: note = hyper
  source 1..192: mol_type = genomic DNA
tgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagt

SEQ ID NO: 55192 - DNA, 144 bp, Homo sapiens; identical to SEQ ID NO: 34508
  misc_feature 1..144: note = chr12:66629273-66629417
  misc_feature 1..144: note = hyper
  source 1..144: mol_type = genomic DNA

SEQ ID NO: 55193 - DNA, 30 bp, Homo sapiens; identical to SEQ ID NO: 11320
  misc_feature 1..30: note = chr12:68759101-68759131
  misc_feature 1..30: note = hyper
  source 1..30: mol_type = genomic DNA

SEQ ID NO: 55194 - DNA, 61 bp, Homo sapiens; identical to SEQ ID NO: 11321
  misc_feature 1..61: note = chr12:69326653-69326714
  misc_feature 1..61: note = hyper
  source 1..61: mol_type = genomic DNA

SEQ ID NO: 55195 - DNA, 245 bp, Homo sapiens
  misc_feature 1..245: note = chr12:69327014-69327259
  misc_feature 1..245: note = hyper
  source 1..245: mol_type = genomic DNA
ccccggacgtccctccggcccactccggagccgcgcgggtgcctcccgggcggggcctcagccgccttcgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcc

SEQ ID NO: 55196 - DNA, 58 bp, Homo sapiens
  misc_feature 1..58: note = chr12:69327463-69327521
  misc_feature 1..58: note = hyper
  source 1..58: mol_type = genomic DNA
agctcccagcagtgccaagctgcccagcgaggctaagcaatcacggggcttcgagaaa

SEQ ID NO: 55197 - DNA, 55 bp, Homo sapiens; identical to SEQ ID NO: 34512
  misc_feature 1..55: note = chr12:70761007-70761062
  misc_feature 1..55: note = hyper
  source 1..55: mol_type = genomic DNA

SEQ ID NO: 55198 - DNA, 411 bp, Homo sapiens; identical to SEQ ID NO: 34513
  misc_feature 1..411: note = chr12:71003634-71004045
  misc_feature 1..411: note = hyper
  source 1..411: mol_type = genomic DNA

SEQ ID NO: 55199 - DNA, 176 bp, Homo sapiens; identical to SEQ ID NO: 11323
  misc_feature 1..176: note = chr12:71314436-71314612
  misc_feature 1..176: note = hyper
  source 1..176: mol_type = genomic DNA

SEQ ID NO: 55200 - DNA, 63 bp, Homo sapiens; identical to SEQ ID NO: 11324
  misc_feature 1..63: note = chr12:71314613-71314676
  misc_feature 1..63: note = hyper
  source 1..63: mol_type = genomic DNA

SEQ ID NO: 55201 - DNA, 30 bp, Homo sapiens; identical to SEQ ID NO: 34516
  misc_feature 1..30: note = chr12:71832897-71832927
  misc_feature 1..30: note = hyper
  source 1..30: mol_type = genomic DNA

SEQ ID NO: 55202 - DNA, 554 bp, Homo sapiens; identical to SEQ ID NO: 34517
  misc_feature 1..554: note = chr12:71833313-71833867
  misc_feature 1..554: note = hyper
  source 1..554: mol_type = genomic DNA

SEQ ID NO: 55203 - DNA, 30 bp, Homo sapiens; identical to SEQ ID NO: 34518
  misc_feature 1..30: note = chr12:71834228-71834258
  misc_feature 1..30: note = hyper
  source 1..30: mol_type = genomic DNA

SEQ ID NO: 55204 - DNA, 10 bp, Homo sapiens
  misc_feature 1..10: note = chr12:72665788-72665798
  misc_feature 1..10: note = hyper
  source 1..10: mol_type = genomic DNA
ctgggacttc

SEQ ID NO: 55205 - DNA, 52 bp, Homo sapiens; identical to SEQ ID NO: 34523
  misc_feature 1..52: note = chr12:72666342-72666394
  misc_feature 1..52: note = hyper
  source 1..52: mol_type = genomic DNA

SEQ ID NO: 55206 - DNA, 39 bp, Homo sapiens
  misc_feature 1..39: note = chr12:72666674-72666713
  misc_feature 1..39: note = hyper
  source 1..39: mol_type = genomic DNA
gcttgtgctggccttcgctgtgtccctcgtggcattgct

SEQ ID NO: 55207 - DNA, 41 bp, Homo sapiens; identical to SEQ ID NO: 34527
  misc_feature 1..41: note = chr12:75601190-75601231
  misc_feature 1..41: note = hyper
  source 1..41: mol_type = genomic DNA

SEQ ID NO: 55208 - DNA, 130 bp, Homo sapiens
  misc_feature 1..130: note = chr12:75601910-75602040
  misc_feature 1..130: note = hyper
  source 1..130: mol_type = genomic DNA
ccccgggaggggatcagcgtccagcgctgtccccgcctcttgcatcaaacctttcccaggtttccagagaactacagagatagcagtcctagtctttcttgacctttcatgacaccgttttccctgcctc

SEQ ID NO: 55209 - DNA, 101 bp, Homo sapiens
  misc_feature 1..101: note = chr12:75602875-75602976
  misc_feature 1..101: note = hyper
  source 1..101: mol_type = genomic DNA
tctacattcctattgcggaaaggcggagcggggggatgctggcctgcagggtcaacatgccctttccaggaaatcgcccctttcaccacccccgcccccat

SEQ ID NO: 55210 - DNA, 263 bp, Homo sapiens
  misc_feature 1..263: note = chr12:75603231-75603494
  misc_feature 1..263: note = hyper
  source 1..263: mol_type = genomic DNA
ccaacctccgcgcccagagtcaccatcgcgcagggttgggcaaaccatggagctcggggcgggtccagccggcactgcccgacccctccgggagcgggcagatcggctggccgtgaatggagtggagactggccgcaggtcaggagagctcaccacttgaaggtgaagtcgccctgctcggattccatctgcagattttgtttctcccccaaatcagccactgctggagctgtcccttcagcaccactcgccatcaacctccc

SEQ ID NO: 55211 - DNA, 226 bp, Homo sapiens
  misc_feature 1..226: note = chr12:75728110-75728336
  misc_feature 1..226: note = hyper
  source 1..226: mol_type = genomic DNA
atagtgctttgcactcgactggcccattgtcagcatcccgcacttgttctttacctaacttgtgtggcttgcatattgcaatctgtattacaatccagacgcgctctgcagattacagattggatccacagaaagcagtttggatggttgaaattccctccaccagagggcgactcagagctttcccctgtagctcagagctttgtggaaggggaaccctgctgcc

SEQ ID NO: 55212 - DNA, 18 bp, Homo sapiens
  misc_feature 1..18: note = chr12:75728485-75728503
  misc_feature 1..18: note = hyper
  source 1..18: mol_type = genomic DNA
ctccgcatcctccacatc

SEQ ID NO: 55213 - DNA, 18 bp, Homo sapiens
  misc_feature 1..18: note = chr12:77719293-77719311
  misc_feature 1..18: note = hyper
  source 1..18: mol_type = genomic DNA
gatgggggtggccagcgc

SEQ ID NO: 55214 - DNA, 158 bp, Homo sapiens
  misc_feature 1..158: note = chr12:77719422-77719580
  misc_feature 1..158: note = hyper
  source 1..158: mol_type = genomic DNA
acccgaggtctccagacgagtgagggagggatgcaggcttgggggtgatggagcgcttggctggtggctggtgagcgtccatacatcatagctctccttcccactcccccgcccctcttcgggattctctctttctctttccccgtcctcatttcttt

SEQ ID NO: 55215 - DNA, 120 bp, Homo sapiens
  misc_feature 1..120: note = chr12:79257351-79257471
  misc_feature 1..120: note = hyper
  source 1..120: mol_type = genomic DNA
cctggcgcgcggtcccttcccccacccgctgagccttcctgttcggtatttcggtattaccaagctataaattgcctgagagcttagagacaatcaggtcaccaccgccctcacaagaga

SEQ ID NO: 55216 - DNA, 375 bp, Homo sapiens; identical to SEQ ID NO: 34534
  misc_feature 1..375: note = chr12:79257722-79258097
  misc_feature 1..375: note = hyper
  source 1..375: mol_type = genomic DNA

SEQ ID NO: 55217 - DNA, 141 bp, Homo sapiens; identical to SEQ ID NO: 34535
  misc_feature 1..141: note = chr12:79258297-79258438
  misc_feature 1..141: note = hyper
  source 1..141: mol_type = genomic DNA

SEQ ID NO: 55218 - DNA, 437 bp, Homo sapiens; identical to SEQ ID NO: 34536
  misc_feature 1..437: note = chr12:79258439-79258876
  misc_feature 1..437: note = hyper
  source 1..437: mol_type = genomic DNA

SEQ ID NO: 55219 - DNA, 30 bp, Homo sapiens; identical to SEQ ID NO: 34538
  misc_feature 1..30: note = chr12:81330218-81330248
  misc_feature 1..30: note = hyper
  source 1..30: mol_type = genomic DNA

SEQ ID NO: 55220 - DNA, 573 bp, Homo sapiens; identical to SEQ ID NO: 34539
  misc_feature 1..573: note = chr12:81330746-81331319
  misc_feature 1..573: note = hyper
  source 1..573: mol_type = genomic DNA

SEQ ID NO: 55221 - DNA, 48 bp, Homo sapiens; identical to SEQ ID NO: 11341
  misc_feature 1..48: note = chr12:81331829-81331877
  misc_feature 1..48: note = hyper
  source 1..48: mol_type = genomic DNA

SEQ ID NO: 55222 - DNA, 62 bp, Homo sapiens
  misc_feature 1..62: note = chr12:81471455-81471517
  misc_feature 1..62: note = hyper
  source 1..62: mol_type = genomic DNA
tgccacctccaccaacgaccttccaaagattaaaccagccgtgtacaaactgctggattgaa

SEQ ID NO: 55223 - skipped

SEQ ID NO: 55224 - DNA, 44 bp, Homo sapiens; identical to SEQ ID NO: 34544
  misc_feature 1..44: note = chr12:82153211-82153255
  misc_feature 1..44: note = hyper
  source 1..44: mol_type = genomic DNA

SEQ ID NO: 55225 - DNA, 195 bp, Homo sapiens; identical to SEQ ID NO: 34545
  misc_feature 1..195: note = chr12:82153283-82153478
  misc_feature 1..195: note = hyper
  source 1..195: mol_type = genomic DNA

SEQ ID NO: 55226 - DNA, 191 bp, Homo sapiens; identical to SEQ ID NO: 11344
  misc_feature 1..191: note = chr12:85305054-85305245
  misc_feature 1..191: note = hyper
  source 1..191: mol_type = genomic DNA

SEQ ID NO: 55227 - DNA, 156 bp, Homo sapiens; identical to SEQ ID NO: 34547
  misc_feature 1..156: note = chr12:85305657-85305813
  misc_feature 1..156: note = hyper
  source 1..156: mol_type = genomic DNA

SEQ ID NO: 55228 - DNA, 61 bp, Homo sapiens
  misc_feature 1..61: note = chr12:85306458-85306519
  misc_feature 1..61: note = hyper
  source 1..61: mol_type = genomic DNA
ggttttgggggtcgccgccctgcaggctggcaaggagagactcgtgagcgcctgtgtgtct

SEQ ID NO: 55229 - skipped

SEQ ID NO: 55230 - DNA, 158 bp, Homo sapiens; identical to SEQ ID NO: 34550
  misc_feature 1..158: note = chr12:85306798-85306956
  misc_feature 1..158: note = hyper
  source 1..158: mol_type = genomic DNA

SEQ ID NO: 55231 - DNA, 46 bp, Homo sapiens
  misc_feature 1..46: note = chr12:85667226-85667272
  misc_feature 1..46: note = hyper
  source 1..46: mol_type = genomic DNA
agtttccatgagaagcgaaacttcattctctttgctcagaatagag

SEQ ID NO: 55232 - DNA, 139 bp, Homo sapiens
  misc_feature 1..139: note = chr12:85673067-85673206
  misc_feature 1..139: note = hyper
  source 1..139: mol_type = genomic DNA
aggcactgatcctaacgggttttcttaaaataatttgggtctaatgataaaatcgtggaccaaagggaagggtggcgaagagggtgtagggaattggttggcattagtataatggcttcattgcctcttgctcggcttc

SEQ ID NO: 55233 - DNA, 225 bp, Homo sapiens
  misc_feature 1..225: note = chr12:85673235-85673460
  misc_feature 1..225: note = hyper
  source 1..225: mol_type = genomic DNA
actccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcct

SEQ ID NO: 55234 - DNA, 77 bp, Homo sapiens
  misc_feature 1..77: note = chr12:85674807-85674884
  misc_feature 1..77: note = hyper
  source 1..77: mol_type = genomic DNA
tcaaagtttgaggatccctagatttctagcgtgtgtgaatttgtaatttctgcttttttttgcgtttgcaatacaac

SEQ ID NO: 55235 - DNA, 16 bp, Homo sapiens
  misc_feature 1..16: note = chr12:93966301-93966317
  misc_feature 1..16: note = hyper
  source 1..16: mol_type = genomic DNA
agagctgggccagggc

SEQ ID NO: 55236 - DNA, 111 bp, Homo sapiens
  misc_feature 1..111: note = chr12:93966318-93966429
  misc_feature 1..111: note = hyper
  source 1..111: mol_type = genomic DNA
ctaactggaagcttggggttaaatggtgcaggaacgtagaggcggaggagtccctgggattttccacgtctatttccccacccccaccccagccgcaggggtccagtttgg

SEQ ID NO: 55237 - DNA, 395 bp, Homo sapiens
  misc_feature 1..395: note = chr12:93966603-93966998
  misc_feature 1..395: note = hyper
  source 1..395: mol_type = genomic DNA
gaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctcca

SEQ ID NO: 55238 - DNA, 426 bp, Homo sapiens; identical to SEQ ID NO: 34556
  misc_feature 1..426: note = chr12:93985172-93985598
  misc_feature 1..426: note = hyper
  source 1..426: mol_type = genomic DNA

SEQ ID NO: 55239 - DNA, 291 bp, Homo sapiens
  misc_feature 1..291: note = chr12:94543118-94543409
  misc_feature 1..291: note = hyper
  source 1..291: mol_type = genomic DNA
caccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggg

SEQ ID NO: 55240 - DNA, 454 bp, Homo sapiens
  misc_feature 1..454: note = chr12:94543445-94543899
  misc_feature 1..454: note = hyper
  source 1..454: mol_type = genomic DNA
cttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcg

SEQ ID NO: 55241 - DNA, 10 bp, Homo sapiens
  misc_feature 1..10: note = chr12:94543961-94543971
  misc_feature 1..10: note = hyper
  source 1..10: mol_type = genomic DNA
gaaggctcct

SEQ ID NO: 55242 - DNA, 332 bp, Homo sapiens; identical to SEQ ID NO: 34559
  misc_feature 1..332: note = chr12:95266862-95267194
  misc_feature 1..332: note = hyper
  source 1..332: mol_type = genomic DNA

SEQ ID NO: 55243 - DNA, 44 bp, Homo sapiens; identical to SEQ ID NO: 34560
  misc_feature 1..44: note = chr12:95267247-95267291
  misc_feature 1..44: note = hyper
  source 1..44: mol_type = genomic DNA

SEQ ID NO: 55244 - DNA, 114 bp, Homo sapiens; identical to SEQ ID NO: 34561
  misc_feature 1..114: note = chr12:95267567-95267681
  misc_feature 1..114: note = hyper
  source 1..114: mol_type = genomic DNA

SEQ ID NO: 55245 - DNA, 92 bp, Homo sapiens; identical to SEQ ID NO: 34562
  misc_feature 1..92: note = chr12:95267706-95267798
  misc_feature 1..92: note = hyper
  source 1..92: mol_type = genomic DNA

SEQ ID NO: 55246 - skipped

SEQ ID NO: 55247 - DNA, 311 bp, Homo sapiens; identical to SEQ ID NO: 34564
  misc_feature 1..311: note = chr12:96883403-96883714
  misc_feature 1..311: note = hyper
  source 1..311: mol_type = genomic DNA

SEQ ID NO: 55248 - DNA, 32 bp, Homo sapiens; identical to SEQ ID NO: 34565
  misc_feature 1..32: note = chr12:97380005-97380037
  misc_feature 1..32: note = hyper
  source 1..32: mol_type = genomic DNA

SEQ ID NO: 55249 - DNA, 30 bp, Homo sapiens; identical to SEQ ID NO: 11363
  misc_feature 1..30: note = chr12:99287423-99287453
  misc_feature 1..30: note = hyper
  source 1..30: mol_type = genomic DNA

SEQ ID NO: 55250 - DNA, 162 bp, Homo sapiens
  misc_feature 1..162: note = chr12:99288150-99288312
  misc_feature 1..162: note = hyper
  source 1..162: mol_type = genomic DNA
aaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggctt

SEQ ID NO: 55251 - DNA, 88 bp, Homo sapiens
  misc_feature 1..88: note = chr12:101110941-101111029
  misc_feature 1..88: note = hyper
  source 1..88: mol_type = genomic DNA
gcgctgggccaaatccgcggcgcgcctctgccgggcacctcccacctccagcttcgcccctcccctctcccggccgcgcgtcctccgc

SEQ ID NO: 55252 - skipped

SEQ ID NO: 55253 - DNA, 96 bp, Homo sapiens
  misc_feature 1..96: note = chr12:101111277-101111373
  misc_feature 1..96: note = hyper
  source 1..96: mol_type = genomic DNA
ccagtctgggcaggacgcgggccaggatggcctccctcaccgcatacggtaactggggccgtcgcgggttcctggggcggcggggcggaagggagg

SEQ ID NO: 55254 - DNA, 106 bp, Homo sapiens; identical to SEQ ID NO: 34574
  misc_feature 1..106: note = chr12:103311184-103311290
  misc_feature 1..106: note = hyper
  source 1..106: mol_type = genomic DNA

SEQ ID NO: 55255 - DNA, 32 bp, Homo sapiens; identical to SEQ ID NO: 34575
  misc_feature 1..32: note = chr12:103344621-103344653
  misc_feature 1..32: note = hyper
  source 1..32: mol_type = genomic DNA

SEQ ID NO: 55256 - DNA, 60 bp, Homo sapiens; identical to SEQ ID NO: 11370
  misc_feature 1..60: note = chr12:103350244-103350304
  misc_feature 1..60: note = hyper
  source 1..60: mol_type = genomic DNA

SEQ ID NO: 55257 - DNA, 239 bp, Homo sapiens; identical to SEQ ID NO: 34577
  misc_feature 1..239: note = chr12:103350383-103350622
  misc_feature 1..239: note = hyper
  source 1..239: mol_type = genomic DNA

SEQ ID NO: 55258 - DNA, 87 bp, Homo sapiens
  misc_feature 1..87: note = chr12:103351477-103351564
  misc_feature 1..87: note = hyper
  source 1..87: mol_type = genomic DNA
acgtggaaggcgcaccgacagggatccggccagggagggcgagtgaaagaaggaaatcagaaaggaagggagttaacaaaataataa

SEQ ID NO: 55259 - DNA, 204 bp, Homo sapiens
  misc_feature 1..204: note = chr12:103358661-103358865
  misc_feature 1..204: note = hyper
  source 1..204: mol_type = genomic DNA
gttctttacccactgcgaaagcgaatggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttga

SEQ ID NO: 55260 - DNA, 64 bp, Homo sapiens
  misc_feature 1..64: note = chr12:103358899-103358963
  misc_feature 1..64: note = hyper
  source 1..64: mol_type = genomic DNA
gcgccgggaactctccaggctacctgaagctggggggaggaagaggaggcgtggggacccgagg

SEQ ID NO: 55261 - DNA, 204 bp, Homo sapiens
  misc_feature 1..204: note = chr12:103359352-103359556
  misc_feature 1..204: note = hyper
  source 1..204: mol_type = genomic DNA
gagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttg

SEQ ID NO: 55262 - DNA, 132 bp, Homo sapiens
  misc_feature 1..132: note = chr12:103359586-103359718
  misc_feature 1..132: note = hyper
  source 1..132: mol_type = genomic DNA
cgcctccggactcgaccccaccatagccccgccgtccgaatcgtctctgaaccaaactacttctgcctgcctttctttggatctgtctttctctgtcatctgagtcactttctctctcgcctctcttttctt

SEQ ID NO: 55263 - DNA, 288 bp, Homo sapiens; identical to SEQ ID NO: 34586
  misc_feature 1..288: note = chr12:103889228-103889516
  misc_feature 1..288: note = hyper
  source 1..288: mol_type = genomic DNA

SEQ ID NO: 55264 - DNA, 197 bp, Homo sapiens; identical to SEQ ID NO: 1063
  misc_feature 1..197: note = chr12:103889517-103889714
  misc_feature 1..197: note = hyper
  source 1..197: mol_type = genomic DNA

SEQ ID NO: 55265 - DNA, 213 bp, Homo sapiens
  misc_feature 1..213: note = chr12:103889812-103890025
  misc_feature 1..213: note = hyper
  source 1..213: mol_type = genomic DNA
gggctgccttgccgtgagaccctcccccgcgactgccaccaaagtcacagaaaactttcacacctctcatctgacactgtggcctgtgcacgactccaagcactggggaagccttcgacatcagaatatgaatggcacctgttcttccgggggcggcaagggggatcccgatgtttatcaaaatgggttgattttccacggagggggtacttc

SEQ ID NO: 55266 - DNA, 112 bp, Homo sapiens; identical to SEQ ID NO: 34589
  misc_feature 1..112: note = chr12:104322966-104323078
  misc_feature 1..112: note = hyper
  source 1..112: mol_type = genomic DNA

SEQ ID NO: 55267 - DNA, 81 bp, Homo sapiens
  misc_feature 1..81: note = chr12:104609336-104609417
  misc_feature 1..81: note = hyper
  source 1..81: mol_type = genomic DNA
ggattttgggtggtgcgctcttttctcctttccatttctgcattttccaatttacctttagcgaccgttctttcctgttaa

SEQ ID NO: 55268 - DNA, 261 bp, Homo sapiens
  misc_feature 1..261: note = chr12:104850244-104850505
  misc_feature 1..261: note = hyper
  source 1..261: mol_type = genomic DNA
aaagaaaaacgaaaccgcccagttctgagcgtcggaaaatgggcactcgctccctgggggtttggggcaacttccccgctacgtcgcccagggattttaaataattgccagccaccagaaaccccctaacccttaattcttccctccgagacccagcccgctgcttgccacttccctctccaaacgctggcgggggtgggtggcagcaccgaggcgattttcttcgtctttttttcctccgggttttgtcatggaaacgct

SEQ ID NO: 55269 - DNA, 485 bp, Homo sapiens
  misc_feature 1..485: note = chr12:104850592-104851077
  misc_feature 1..485: note = hyper
  source 1..485: mol_type = genomic DNA
ccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagcct

SEQ ID NO: 55270 - DNA, 63 bp, Homo sapiens
  misc_feature 1..63: note = chr12:104851186-104851249
  misc_feature 1..63: note = hyper
  source 1..63: mol_type = genomic DNA
gccatgaagccagcgctgctggaagtgatgaggatgaacagaatctgccggatggtgctggcc

SEQ ID NO: 55271 - DNA, 112 bp, Homo sapiens
  misc_feature 1..112: note = chr12:104851920-104852032
  misc_feature 1..112: note = hyper
  source 1..112: mol_type = genomic DNA
gttgcccctccaccacgcgccggccgtttgcccccggggtccgggtccgcagtgaccttgcggctggtgccccggggcctgctccagcccccagccctgagctggaaactcc

SEQ ID NO: 55272 - DNA, 107 bp, Homo sapiens; identical to SEQ ID NO: 34598
  misc_feature 1..107: note = chr12:104852725-104852832
  misc_feature 1..107: note = hyper
  source 1..107: mol_type = genomic DNA

SEQ ID NO: 55273 - DNA, 43 bp, Homo sapiens; identical to SEQ ID NO: 34599
  misc_feature 1..43: note = chr12:105478265-105478308
  misc_feature 1..43: note = hyper
  source 1..43: mol_type = genomic DNA

SEQ ID NO: 55274 - DNA, 30 bp, Homo sapiens; identical to SEQ ID NO: 34600
  misc_feature 1..30: note = chr12:106532217-106532247
  misc_feature 1..30: note = hyper
  source 1..30: mol_type = genomic DNA

SEQ ID NO: 55275 - DNA, 610 bp, Homo sapiens
  misc_feature 1..610: note = chr12:106974383-106974993
  misc_feature 1..610: note = hyper
  source 1..610: mol_type = genomic DNA
ataataatagcaacaataatagtctcatccgccctggagaccacccgtgcccccgtggcatccctcaaggactctccgggcggtggcagccgcccaccctggggacgcgctccttgctgccaccggaacgcccctggccaggctccatctacgcgctgtcagaccctcccgccgtctgaagaaggcttttactcttcagcctattccagtggcagagaagctaaggctacaaaggcgaacgcgaacagtcagatctgacttcgaattccgctgtcattgctgccaggcgcaccacgaggacgcgcggtgaccgccaccatggcattcggctgccaaaggtttccatcgacctctttcccatcaccagcatcgcagcgggaaagaatgtgcctggcgcccttctgggcactgggcatggggtggtgaacaaagtcctccagaaataaaccgggtaatgagcccggcagcggccggggcaggaagggaccttcgcagagagtggtcaggcacagcccctccgaggaggcgacgctcagctgagaccagggtgacgcaaaggtgtcggccggttaggcacctgtgaggaaggaggagccggcagagtgccaag

SEQ ID NO: 55276 - DNA, 439 bp, Homo sapiens; identical to SEQ ID NO: 34602
  misc_feature 1..439: note = chr12:106975246-106975685
  misc_feature 1..439: note = hyper
  source 1..439: mol_type = genomic DNA

SEQ ID NO: 55277 - DNA, 119 bp, Homo sapiens; identical to SEQ ID NO: 34603
  misc_feature 1..119: note = chr12:106976403-106976522
  misc_feature 1..119: note = hyper
  source 1..119: mol_type = genomic DNA

SEQ ID NO: 55278 - DNA, 11 bp, Homo sapiens
  misc_feature 1..11: note = chr12:106976842-106976853
  misc_feature 1..11: note = hyper
  source 1..11: mol_type = genomic DNA
cgctttttctc

SEQ ID NO: 55279 - DNA, 355 bp, Homo sapiens
  misc_feature 1..355: note = chr12:106977497-106977852
  misc_feature 1..355: note = hyper
  source 1..355: mol_type = genomic DNA
ccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttttctgccaggaaggggcacccaacgccgggctccactagggagctgtgaccttgctggagggagggcaggacgcagactggcccgctaaactcggcgt

SEQ ID NO: 55280 - DNA, 30 bp, Homo sapiens; identical to SEQ ID NO: 34607
  misc_feature 1..30: note = chr12:106978736-106978766
  misc_feature 1..30: note = hyper
  source 1..30: mol_type = genomic DNA

SEQ ID NO: 55281 - DNA, 56 bp, Homo sapiens
  misc_feature 1..56: note = chr12:106979534-106979590
  misc_feature 1..56: note = hyper
  source 1..56: mol_type = genomic DNA
aaccgactcacagcaagtgctggggcgaagtaggaaacgtccaggataagagaggc

SEQ ID NO: 55282 - DNA, 163 bp, Homo sapiens
  misc_feature 1..163: note = chr12:106979636-106979799
  misc_feature 1..163: note = hyper
  source 1..163: mol_type = genomic DNA
cgaagtgcctcgggcccgggagaacagttttgcaggggccagggctctagtggcctgctttggggccacttcagcatgacctgcggaaacgcgcccctttgttccgcacactgagccagtaatatattcctcgggtttccccaaaatactcaacaagtgtgga

SEQ ID NO: 55283 - DNA, 147 bp, Homo sapiens
  misc_feature 1..147: note = chr12:106980333-106980480
  misc_feature 1..147: note = hyper
  source 1..147: mol_type = genomic DNA
ctgccaagctggagctggaaacttctgcctccatccactttccgctcccatctccagaacccagagctgaggcggccaaagtacttcctggagccggatttgagttccccgggccgcatcggtgggagggcacgctagtttacaggc

SEQ ID NO: 55284 - DNA, 28 bp, Homo sapiens
  misc_feature 1..28: note = chr12:106980719-106980747
  misc_feature 1..28: note = hyper
  source 1..28: mol_type = genomic DNA
caaaccagacagtctcgccctccccggg

SEQ ID NO: 55285 - DNA, 133 bp, Homo sapiens; identical to SEQ ID NO: 21490
  misc_feature 1..133: note = chr12:106981406-106981539
  misc_feature 1..133: note = hyper
  source 1..133: mol_type = genomic DNA

SEQ ID NO: 55286 - DNA, 42 bp, Homo sapiens; identical to SEQ ID NO: 34615
  misc_feature 1..42: note = chr12:107297268-107297310
  misc_feature 1..42: note = hyper
  source 1..42: mol_type = genomic DNA

SEQ ID NO: 55287 - DNA, 100 bp, Homo sapiens
  misc_feature 1..100: note = chr12:107486450-107486550
  misc_feature 1..100: note = hyper
  source 1..100: mol_type = genomic DNA
cctaaaattcgtaagcggtataagcaagacagtcccacgtctaaattcacagatttggcggatcgcatggaattcattaacatcagactcattaaacacc

SEQ ID NO: 55288 - DNA, 38 bp, Homo sapiens; identical to SEQ ID NO: 34618
  misc_feature 1..38: note = chr12:107711950-107711988
  misc_feature 1..38: note = hyper
  source 1..38: mol_type = genomic DNA

SEQ ID NO: 55289 - DNA, 206 bp, Homo sapiens
  misc_feature 1..206: note = chr12:107714660-107714866
  misc_feature 1..206: note = hyper
  source 1..206: mol_type = genomic DNA
gttagtttagggcgtcgtttccagcaggttctatcatcgtctcttcatgccccactgttttgaaggcctgacttgggtaggtttgaacccgcagttctgtccttgaagggggtggggccggggcgcttgttttcgagagctcgcgctggcggtgctgcccgtctgcgaaagccggagctagacacttcaaagcttcaattttccac

SEQ ID NO: 55290 - DNA, 37 bp, Homo sapiens
  misc_feature 1..37: note = chr12:107715153-107715190
  misc_feature 1..37: note = hyper
  source 1..37: mol_type = genomic DNA
tccagccgaagcctttggaaaccgaccctgccgccct

SEQ ID NO: 55291 - DNA, 49 bp, Homo sapiens; identical to SEQ ID NO: 21492
  misc_feature 1..49: note = chr12:108168922-108168971
  misc_feature 1..49: note = hyper
  source 1..49: mol_type = genomic DNA

SEQ ID NO: 55292 - DNA, 31 bp, Homo sapiens
  misc_feature 1..31: note = chr12:108169573-108169604
  misc_feature 1..31: note = hyper
  source 1..31: mol_type = genomic DNA
aacctaaggtcctcttcgaaggtggtttgca

SEQ ID NO: 55293 - DNA, 44 bp, Homo sapiens
  misc_feature 1..44: note = chr12:108237422-108237466
  misc_feature 1..44: note = hyper
  source 1..44: mol_type = genomic DNA
aaacagcttcttcatcgcggcagcttcggagaagcctcagctac

SEQ ID NO: 55294 - DNA, 88 bp, Homo sapiens
  misc_feature 1..88: note = chr12:108297323-108297411
  misc_feature 1..88: note = hyper
  source 1..88: mol_type = genomic DNA
aagttggagatacaccgattctcctgtttctggggaaggattctcagaaggtggctcatatgagtaaaaatcatttttcctgggtagc

SEQ ID NO: 55295 - DNA, 290 bp, Homo sapiens; identical to SEQ ID NO: 21494
  misc_feature 1..290: note = chr12:108297466-108297756
  misc_feature 1..290: note = hyper
  source 1..290: mol_type = genomic DNA

SEQ ID NO: 55296 - DNA, 79 bp, Homo sapiens; identical to SEQ ID NO: 34626
  misc_feature 1..79: note = chr12:108523360-108523439
  misc_feature 1..79: note = hyper
  source 1..79: mol_type = genomic DNA

SEQ ID NO: 55297 - DNA, 30 bp, Homo sapiens; identical to SEQ ID NO: 34627
  misc_feature 1..30: note = chr12:109746889-109746919
  misc_feature 1..30: note = hyper
  source 1..30: mol_type = genomic DNA

SEQ ID NO: 55298 - DNA, 100 bp, Homo sapiens; identical to SEQ ID NO: 34628
  misc_feature 1..100: note = chr12:110271088-110271188
  misc_feature 1..100: note = hyper
  source 1..100: mol_type = genomic DNA

SEQ ID NO: 55299 - DNA, 372 bp, Homo sapiens; identical to SEQ ID NO: 11409
  misc_feature 1..372: note = chr12:111284662-111285034
  misc_feature 1..372: note = hyper
  source 1..372: mol_type = genomic DNA

SEQ ID NO: 55300 - DNA, 12 bp, Homo sapiens
  misc_feature 1..12: note = chr12:111471165-111471177
  misc_feature 1..12: note = hyper
  source 1..12: mol_type = genomic DNA
tggtgacatttc

SEQ ID NO: 55301 - DNA, 389 bp, Homo sapiens; identical to SEQ ID NO: 21497
  misc_feature 1..389: note = chr12:111471559-111471948
  misc_feature 1..389: note = hyper
  source 1..389: mol_type = genomic DNA

SEQ ID NO: 55302 - DNA, 166 bp, Homo sapiens; identical to SEQ ID NO: 3946
  misc_feature 1..166: note = chr12:111472851-111473017
  misc_feature 1..166: note = hyper
  source 1..166: mol_type = genomic DNA

SEQ ID NO: 55303 - DNA, 67 bp, Homo sapiens; identical to SEQ ID NO: 34637
  misc_feature 1..67: note = chr12:111844623-111844690
  misc_feature 1..67: note = hyper
  source 1..67: mol_type = genomic DNA

SEQ ID NO: 55304 - DNA, 122 bp, Homo sapiens; identical to SEQ ID NO: 21499
  misc_feature 1..122: note = chr12:113013157-113013279
  misc_feature 1..122: note = hyper
  source 1..122: mol_type = genomic DNA

SEQ ID NO: 55305 - DNA, 30 bp, Homo sapiens; identical to SEQ ID NO: 34639
  misc_feature 1..30: note = chr12:113229420-113229450
  misc_feature 1..30: note = hyper
  source 1..30: mol_type = genomic DNA

SEQ ID NO: 55306 - DNA, 77 bp, Homo sapiens; identical to SEQ ID NO: 34640
  misc_feature 1..77: note = chr12:113494339-113494416
  misc_feature 1..77: note = hyper
  source 1..77: mol_type = genomic DNA

SEQ ID NO: 55307 - DNA, 607 bp, Homo sapiens; identical to SEQ ID NO: 34641
  misc_feature 1..607: note = chr12:113494430-113495037
  misc_feature 1..607: note = hyper
  source 1..607: mol_type = genomic DNA

SEQ ID NO: 55308 - DNA, 50 bp, Homo sapiens; identical to SEQ ID NO: 34642
  misc_feature 1..50: note = chr12:113495038-113495088
  misc_feature 1..50: note = hyper
  source 1..50: mol_type = genomic DNA

SEQ ID NO: 55309 - DNA, 161 bp, Homo sapiens
  misc_feature 1..161: note = chr12:113541506-113541667
  misc_feature 1..161: note = hyper
  source 1..161: mol_type = genomic DNA
ttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttg

SEQ ID NO: 55310 - DNA, 111 bp, Homo sapiens; identical to SEQ ID NO: 21504
  misc_feature 1..111: note = chr12:113592127-113592238
  misc_feature 1..111: note = hyper
  source 1..111: mol_type = genomic DNA

SEQ ID NO: 55311 - DNA, 39 bp, Homo sapiens; identical to SEQ ID NO: 21505
  misc_feature 1..39: note = chr12:113592359-113592398
  misc_feature 1..39: note = hyper
  source 1..39: mol_type = genomic DNA

SEQ ID NO: 55312 - DNA, 140 bp, Homo sapiens; identical to SEQ ID NO: 34645
  misc_feature 1..140: note = chr12:113900538-113900678
  misc_feature 1..140: note = hyper
  source 1..140: mol_type = genomic DNA

SEQ ID NO: 55313 - DNA, 309 bp, Homo sapiens; identical to SEQ ID NO: 21506
  misc_feature 1..309: note = chr12:113900765-113901074
  misc_feature 1..309: note = hyper
  source 1..309: mol_type = genomic DNA

SEQ ID NO: 55314 - DNA, 427 bp, Homo sapiens
  misc_feature 1..427: note = chr12:113901591-113902018
  misc_feature 1..427: note = hyper
  source 1..427: mol_type = genomic DNA
ctcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagt

SEQ ID NO: 55315 - DNA, 79 bp, Homo sapiens; identical to SEQ ID NO: 34649
  misc_feature 1..79: note = chr12:113902608-113902687
  misc_feature 1..79: note = hyper
  source 1..79: mol_type = genomic DNA

SEQ ID NO: 55316 - DNA, 447 bp, Homo sapiens; identical to SEQ ID NO: 21507
  misc_feature 1..447: note = chr12:113903021-113903468
  misc_feature 1..447: note = hyper
  source 1..447: mol_type = genomic DNA

SEQ ID NO: 55317 - DNA, 45 bp, Homo sapiens; identical to SEQ ID NO: 21508
  misc_feature 1..45: note = chr12:113903498-113903543
  misc_feature 1..45: note = hyper
  source 1..45: mol_type = genomic DNA

SEQ ID NO: 55318 - DNA, 23 bp, Homo sapiens
  misc_feature 1..23: note = chr12:113904756-113904779
  misc_feature 1..23: note = hyper
  source 1..23: mol_type = genomic DNA
gcgatcgtgtctagacgtgtgtc

SEQ ID NO: 55319 - DNA, 13 bp, Homo sapiens
  misc_feature 1..13: note = chr12:113905016-113905029
  misc_feature 1..13: note = hyper
  source 1..13: mol_type = genomic DNA
gaataggacaggt

SEQ ID NO: 55320 - DNA, 33 bp, Homo sapiens; identical to SEQ ID NO: 34652
  misc_feature 1..33: note = chr12:113905380-113905413
  misc_feature 1..33: note = hyper
  source 1..33: mol_type = genomic DNA

SEQ ID NO: 55321 - DNA, 761 bp, Homo sapiens; identical to SEQ ID NO: 34653
  misc_feature 1..761: note = chr12:113905673-113906434
  misc_feature 1..761: note = hyper
  source 1..761: mol_type = genomic DNA

SEQ ID NO: 55322 - DNA, 32 bp, Homo sapiens; identical to SEQ ID NO: 34654
  misc_feature 1..32: note = chr12:113907104-113907136
  misc_feature 1..32: note = hyper
  source 1..32: mol_type = genomic DNA

SEQ ID NO: 55323 - DNA, 35 bp, Homo sapiens; identical to SEQ ID NO: 34656
  misc_feature 1..35: note = chr12:113909468-113909503
  misc_feature 1..35: note = hyper
  source 1..35: mol_type = genomic DNA

SEQ ID NO: 55324 - DNA, 123 bp, Homo sapiens; identical to SEQ ID NO: 34657
  misc_feature 1..123: note = chr12:113909534-113909657
  misc_feature 1..123: note = hyper
  source 1..123: mol_type = genomic DNA

SEQ ID NO: 55325 - DNA, 449 bp, Homo sapiens; identical to SEQ ID NO: 34658
  misc_feature 1..449: note = chr12:113909717-113910166
  misc_feature 1..449: note = hyper
  source 1..449: mol_type = genomic DNA

SEQ ID NO: 55326 - DNA, 157 bp, Homo sapiens; identical to SEQ ID NO: 11429
  misc_feature 1..157: note = chr12:113910529-113910686
  misc_feature 1..157: note = hyper
  source 1..157: mol_type = genomic DNA

SEQ ID NO: 55327 - DNA, 399 bp, Homo sapiens
  misc_feature 1..399: note = chr12:113912868-113913267
  misc_feature 1..399: note = hyper
  source 1..399: mol_type = genomic DNA
agctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgt

SEQ ID NO: 55328 - DNA, 174 bp, Homo sapiens; identical to SEQ ID NO: 21515
  misc_feature 1..174: note = chr12:113914050-113914224
  misc_feature 1..174: note = hyper
  source 1..174: mol_type = genomic DNA

SEQ ID NO: 55329 - DNA, 228 bp, Homo sapiens; identical to SEQ ID NO: 34662
  misc_feature 1..228: note = chr12:113914300-113914528
  misc_feature 1..228: note = hyper
  source 1..228: mol_type = genomic DNA

SEQ ID NO: 55330 - DNA, 323 bp, Homo sapiens
  misc_feature 1..323: note = chr12:113916326-113916649
  misc_feature 1..323: note = hyper
  source 1..323: mol_type = genomic DNA
gtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccccagctccttcctcccaaggcgagtatgtttaccctgctgggcacccttccgctccgcggg

SEQ ID NO: 55331 - DNA, 52 bp, Homo sapiens
  misc_feature 1..52: note = chr12:113916678-113916730
  misc_feature 1..52: note = hyper
  source 1..52: mol_type = genomic DNA
tcctctcaactgccccgcagtgcgcggcggccttttccgccaggttttttgg

SEQ ID NO: 55332 - DNA, 207 bp, Homo sapiens
  misc_feature 1..207: note = chr12:113917310-113917517
  misc_feature 1..207: note = hyper
  source 1..207: mol_type = genomic DNA
ttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcc

SEQ ID NO: 55333 - DNA, 121 bp, Homo sapiens; identical to SEQ ID NO: 34666
  misc_feature 1..121: note = chr12:113917580-113917701
  misc_feature 1..121: note = hyper
  source 1..121: mol_type = genomic DNA

SEQ ID NO: 55334 - DNA, 45 bp, Homo sapiens
  misc_feature 1..45: note = chr12:113917730-113917775
  misc_feature 1..45: note = hyper
  source 1..45: mol_type = genomic DNA
cgcggccggctggggcctcgggcagtgacagtgaaacgaattcca

SEQ ID NO: 55335 - DNA, 136 bp, Homo sapiens; identical to SEQ ID NO: 34668
  misc_feature 1..136: note = chr12:113918155-113918291
  misc_feature 1..136: note = hyper
  source 1..136: mol_type = genomic DNA

SEQ ID NO: 55336 - DNA, 192 bp, Homo sapiens; identical to SEQ ID NO: 34669
  misc_feature 1..192: note = chr12:113952930-113953122
  misc_feature 1..192: note = hyper
  source 1..192: mol_type = genomic DNA

SEQ ID NO: 55337 - DNA, 42 bp, Homo sapiens; identical to SEQ ID NO: 34670
  misc_feature 1..42: note = chr12:113953467-113953509
  misc_feature 1..42: note = hyper
  source 1..42: mol_type = genomic DNA

SEQ ID NO: 55338 - DNA, 368 bp, Homo sapiens; identical to SEQ ID NO: 34671
  misc_feature 1..368: note = chr12:113957639-113958007
  misc_feature 1..368: note = hyper
  source 1..368: mol_type = genomic DNA

SEQ ID NO: 55339 - DNA, 177 bp, Homo sapiens
  misc_feature 1..177: note = chr12:114029660-114029837
  misc_feature 1..177: note = hyper
  source 1..177: mol_type = genomic DNA
ctcgccgagctcgattctccgggtgccataaattaggacgccagtcgccggcgaacgctgggggcttccagtataccttccagcgcagcccgcaggctatttttatctccctcagcacctcggcacctcggaggagcttctgctaattcactaccccgacaccgtctcatctcccct

SEQ ID NO: 55340 - DNA, 96 bp, Homo sapiens; identical to SEQ ID NO: 34673
  misc_feature 1..96: note = chr12:114075780-114075876
  misc_feature 1..96: note = hyper
  source 1..96: mol_type = genomic DNA

SEQ ID NO: 55341 - DNA, 120 bp, Homo sapiens
  misc_feature 1..120: note = chr12:114075909-114076029
  misc_feature 1..120: note = hyper
  source 1..120: mol_type = genomic DNA
cgcgtttcacacagcgcacaatggccgccctcaaaggcgcgccgcccgcattgttcgggccggcgcccgcgcgtcctacctccgcgcgcgaattaacccccgtcaccccgccattgtcac

SEQ ID NO: 55342 - DNA, 218 bp, Homo sapiens
  misc_feature 1..218: note = chr12:114833767-114833985
  misc_feature 1..218: note = hyper
  source 1..218: mol_type = genomic DNA
tccccaccgaacttgcgaatcgccgcgtttaacagcctgaaaatctggcctgctttttcccgggaactgcggaggttgtctctgtgactttgattatttgcattgatgaccctggggcaagattcttggaccaaccctggagtccggccccgatcgagtggaggtagttgggggaggcgagccgcggccgggggcgggggagggacgaggaactcgcg

SEQ ID NO: 55343 - DNA, 24 bp, Homo sapiens
  misc_feature 1..24: note = chr12:114834102-114834126
  misc_feature 1..24: note = hyper
  source 1..24: mol_type = genomic DNA
gcggggccccgctggccgccacag

SEQ ID NO: 55344 - DNA, 30 bp, Homo sapiens; identical to SEQ ID NO: 34676
  misc_feature 1..30: note = chr12:114834466-114834496
  misc_feature 1..30: note = hyper
  source 1..30: mol_type = genomic DNA

SEQ ID NO: 55345 - DNA, 124 bp, Homo sapiens
  misc_feature 1..124: note = chr12:114838726-114838850
  misc_feature 1..124: note = hyper
  source 1..124: mol_type = genomic DNA
ctccaccctcccccttcacacactcggtggcttgggcctaccgttcgcctgctccacacgcctgctcggggcatcctctggctttttgctttgcgggacgcggaagacccgtccagcacgggta

SEQ ID NO: 55346 - DNA, 12 bp, Homo sapiens
  misc_feature 1..12: note = chr12:114841034-114841046
  misc_feature 1..12: note = hyper
  source 1..12: mol_type = genomic DNA
acaaatggtgcg

SEQ ID NO: 55347 - DNA, 99 bp, Homo sapiens
  misc_feature 1..99: note = chr12:114841084-114841183
  misc_feature 1..99: note = hyper
  source 1..99: mol_type = genomic DNA
gaggcaggaggaggcgggaggaggcgaaggctacggaagatcagaagaggggtcaagccatcgctcatgccggcctgaatcggccgctgacctggccct

SEQ ID NO: 55348 - DNA, 30 bp, Homo sapiens; identical to SEQ ID NO: 34679
  misc_feature 1..30: note = chr12:114841854-114841884
  misc_feature 1..30: note = hyper
  source 1..30: mol_type = genomic DNA

SEQ ID NO: 55349 - DNA, 72 bp, Homo sapiens; identical to SEQ ID NO: 11445
  misc_feature 1..72: note = chr12:114843007-114843079
  misc_feature 1..72: note = hyper
  source 1..72: mol_type = genomic DNA

SEQ ID NO: 55350 - DNA, 260 bp, Homo sapiens; identical to SEQ ID NO: 21527
  misc_feature 1..260: note = chr12:114843285-114843545
  misc_feature 1..260: note = hyper
  source 1..260: mol_type = genomic DNA

SEQ ID NO: 55351 - DNA, 145 bp, Homo sapiens
  misc_feature 1..145: note = chr12:114843660-114843805
  misc_feature 1..145: note = hyper
  source 1..145: mol_type = genomic DNA
aatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 55352 - DNA, 17 bp, Homo sapiens
  misc_feature 1..17: note = chr12:114844184-114844201
  misc_feature 1..17: note = hyper
  source 1..17: mol_type = genomic DNA
acaaatcatttcaaacg

SEQ ID NO: 55353 - DNA, 74 bp, Homo sapiens
  misc_feature 1..74: note = chr12:114844300-114844374
  misc_feature 1..74: note = hyper
  source 1..74: mol_type = genomic DNA
ttgcagacattctctccaacgctgacctcgagaaggagagctgcctgaccccgcctggccggcgctcgccttcc

SEQ ID NO: 55354 - DNA, 175 bp, Homo sapiens; identical to SEQ ID NO: 34683
  misc_feature 1..175: note = chr12:114845868-114846043
  misc_feature 1..175: note = hyper
  source 1..175: mol_type = genomic DNA

SEQ ID NO: 55355 - DNA, 259 bp, Homo sapiens
  misc_feature 1..259: note = chr12:114846456-114846715
  misc_feature 1..259: note = hyper
  source 1..259: mol_type = genomic DNA
tccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttg

SEQ ID NO: 55356 - DNA, 179 bp, Homo sapiens; identical to SEQ ID NO: 21531
  misc_feature 1..179: note = chr12:114846768-114846947
  misc_feature 1..179: note = hyper
  source 1..179: mol_type = genomic DNA

SEQ ID NO: 55357 - DNA, 62 bp, Homo sapiens; identical to SEQ ID NO: 34688
  misc_feature 1..62: note = chr12:114852127-114852189
  misc_feature 1..62: note = hyper
  source 1..62: mol_type = genomic DNA

SEQ ID NO: 55358 - DNA, 71 bp, Homo sapiens
  misc_feature 1..71: note = chr12:114877262-114877333
  misc_feature 1..71: note = hyper
  source 1..71: mol_type = genomic DNA
ctccgaagccagggtgctcaacctggccccctttctttcctgctggtgaggccacccgctttgggacagaa

SEQ ID NO: 55359 - DNA, 183 bp, Homo sapiens
  misc_feature 1..183: note = chr12:114878367-114878550
  misc_feature 1..183: note = hyper
  source 1..183: mol_type = genomic DNA
ataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtc

SEQ ID NO: 55360 - DNA, 10 bp, Homo sapiens
  misc_feature 1..10: note = chr12:114878584-114878594
  misc_feature 1..10: note = hyper
  source 1..10: mol_type = genomic DNA
ggctaaatcc

SEQ ID NO: 55361 - skipped

SEQ ID NO: 55362 - DNA, 320 bp, Homo sapiens
  misc_feature 1..320: note = chr12:114881764-114882084
  misc_feature 1..320: note = hyper
  source 1..320: mol_type = genomic DNA
tccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgaccagagaagcattaaggagcggcgcgggcaagaatttgg

SEQ ID NO: 55363 - DNA, 21 bp, Homo sapiens
  misc_feature 1..21: note = chr12:114883452-114883473
  misc_feature 1..21: note = hyper
  source 1..21: mol_type = genomic DNA
ttgtttgaggatccccgcgcc

SEQ ID NO: 55364 - DNA, 30 bp, Homo sapiens; identical to SEQ ID NO: 34695
  misc_feature 1..30: note = chr12:114883832-114883862
  misc_feature 1..30: note = hyper
  source 1..30: mol_type = genomic DNA

SEQ ID NO: 55365 - DNA, 39 bp, Homo sapiens; identical to SEQ ID NO: 34696
  misc_feature 1..39: note = chr12:114885145-114885184
  misc_feature 1..39: note = hyper
  source 1..39: mol_type = genomic DNA

SEQ ID NO: 55366 - DNA, 15 bp, Homo sapiens
  misc_feature 1..15: note = chr12:114885371-114885386
  misc_feature 1..15: note = hyper
  source 1..15: mol_type = genomic DNA
cgctggaagaaacga

SEQ ID NO: 55367 - DNA, 61 bp, Homo sapiens; identical to SEQ ID NO: 34698
  misc_feature 1..61: note = chr12:114885605-114885666
  misc_feature 1..61: note = hyper
  source 1..61: mol_type = genomic DNA

SEQ ID NO: 55368 - DNA, 421 bp, Homo sapiens; identical to SEQ ID NO: 34699
  misc_feature 1..421: note = chr12:114917674-114918095
  misc_feature 1..421: note = hyper
  source 1..421: mol_type = genomic DNA

SEQ ID NO: 55369 - skipped

SEQ ID NO: 55370 - DNA, 38 bp, Homo sapiens; identical to SEQ ID NO: 11459
  misc_feature 1..38: note = chr12:115106464-115106502
  misc_feature 1..38: note = hyper
  source 1..38: mol_type = genomic DNA

SEQ ID NO: 55371 - DNA, 130 bp, Homo sapiens; identical to SEQ ID NO: 34702
  misc_feature 1..130: note = chr12:115121885-115122015
  misc_feature 1..130: note = hyper
  source 1..130: mol_type = genomic DNA

SEQ ID NO: 55372 - DNA, 40 bp, Homo sapiens; identical to SEQ ID NO: 34703
  misc_feature 1..40: note = chr12:115130675-115130715
  misc_feature 1..40: note = hyper
  source 1..40: mol_type = genomic DNA

SEQ ID NO: 55373 - DNA, 73 bp, Homo sapiens; identical to SEQ ID NO: 34704
  misc_feature 1..73: note = chr12:115889703-115889776
  misc_feature 1..73: note = hyper
  source 1..73: mol_type = genomic DNA

SEQ ID NO: 55374 - DNA, 291 bp, Homo sapiens; identical to SEQ ID NO: 34707
  misc_feature 1..291: note = chr12:117319805-117320096
  misc_feature 1..291: note = hyper
  source 1..291: mol_type = genomic DNA

SEQ ID NO: 55375 - DNA, 310 bp, Homo sapiens
  misc_feature 1..310: note = chr12:117798095-117798405
  misc_feature 1..310: note = hyper
  source 1..310: mol_type = genomic DNA
ggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgca

SEQ ID NO: 55376 - DNA, 193 bp, Homo sapiens; identical to SEQ ID NO: 34709
  misc_feature 1..193: note = chr12:117799086-117799279
  misc_feature 1..193: note = hyper
  source 1..193: mol_type = genomic DNA

SEQ ID NO: 55377 - DNA, 83 bp, Homo sapiens; identical to SEQ ID NO: 21541
  misc_feature 1..83: note = chr12:117799330-117799413
  misc_feature 1..83: note = hyper
  source 1..83: mol_type = genomic DNA

SEQ ID NO: 55378 - skipped

SEQ ID NO: 55379 - DNA, 88 bp, Homo sapiens; identical to SEQ ID NO: 34711
  misc_feature 1..88: note = chr12:119212112-119212200
  misc_feature 1..88: note = hyper
  source 1..88: mol_type = genomic DNA

SEQ ID NO: 55380 - DNA, 25 bp, Homo sapiens
  misc_feature 1..25: note = chr12:119212381-119212406
  misc_feature 1..25: note = hyper
  source 1..25: mol_type = genomic DNA
atggtttccgcggagctggtgaagg

SEQ ID NO: 55381 - DNA, 62 bp, Homo sapiens; identical to SEQ ID NO: 34713
  misc_feature 1..62: note = chr12:119417764-119417826
  misc_feature 1..62: note = hyper
  source 1..62: mol_type = genomic DNA

SEQ ID NO: 55382 - DNA, 78 bp, Homo sapiens
  misc_feature 1..78: note = chr12:119418516-119418594
  misc_feature 1..78: note = hyper
  source 1..78: mol_type = genomic DNA
aaaagtggctgcaggcggattccccaggagtggatgggggtggggtggggtgagatgggaactctttcctctggacgg

SEQ ID NO: 55383 - DNA, 477 bp, Homo sapiens
  misc_feature 1..477: note = chr12:119418847-119419324
  misc_feature 1..477: note = hyper
  source 1..477: mol_type = genomic DNA
tgagggtctgggggaggccggctggggtggatagattaagttttttacgagcccccccaaccccccccccccccccacgcagaagatcagctacaagacttgcgaaggggctggaaagaaaggtggcctggcccaaagggggcacccaggaaagggctgaggaaggccagcgatgatgggagaggagaggggcctgggaagcaggatctcctgcctggcgcagattggggtgccaggatggcttctcagagggatcagcgctgcaactcggtcgccgcggggccctggtgacaggcgcacgccccgccctttctcctcccaagacctgcgggcttttgttatgcagatggcggcaggaggctgagcctgaggaggagggggttggtggggaggaggagagacggagaggggggaggaaagtgcagctcgcgcgaccagcctcctcttccaacgtcacattgtgcgagagacaaaacc

SEQ ID NO: 55384 - DNA, 68 bp, Homo sapiens
  misc_feature 1..68: note = chr12:119419368-119419436
  misc_feature 1..68: note = hyper
  source 1..68: mol_type = genomic DNA
cgtcgcctcttctctcctggtgctgcccagaaagccagccctcccttcccttcttggggcgcagaggc

SEQ ID NO: 55385 - DNA, 254 bp, Homo sapiens; identical to SEQ ID NO: 21545
  misc_feature 1..254: note = chr12:119419466-119419720
  misc_feature 1..254: note = hyper
  source 1..254: mol_type = genomic DNA

SEQ ID NO: 55386 - DNA, 30 bp, Homo sapiens; identical to SEQ ID NO: 34716
  misc_feature 1..30: note = chr12:119446620-119446650
  misc_feature 1..30: note = hyper
  source 1..30: mol_type = genomic DNA

SEQ ID NO: 55387 - DNA, 91 bp, Homo sapiens; identical to SEQ ID NO: 34717
  misc_feature 1..91: note = chr12:119458719-119458810
  misc_feature 1..91: note = hyper
  source 1..91: mol_type = genomic DNA

SEQ ID NO: 55388 - DNA, 119 bp, Homo sapiens; identical to SEQ ID NO: 34718
  misc_feature 1..119: note = chr12:119499184-119499303
  misc_feature 1..119: note = hyper
  source 1..119: mol_type = genomic DNA

SEQ ID NO: 55389 - DNA, 30 bp, Homo sapiens; identical to SEQ ID NO: 34719
  misc_feature 1..30: note = chr12:120031836-120031866
  misc_feature 1..30: note = hyper
  source 1..30: mol_type = genomic DNA

SEQ ID NO: 55390 - DNA, 29 bp, Homo sapiens
  misc_feature 1..29: note = chr12:120032345-120032374
  misc_feature 1..29: note = hyper
  source 1..29: mol_type = genomic DNA
cttctctctttgctgcgcccaagggcacc

SEQ ID NO: 55391 - DNA, 56 bp, Homo sapiens; identical to SEQ ID NO: 34721
  misc_feature 1..56: note = chr12:120032375-120032431
  misc_feature 1..56: note = hyper
  source 1..56: mol_type = genomic DNA

SEQ ID NO: 55392 - DNA, 153 bp, Homo sapiens; identical to SEQ ID NO: 34722
  misc_feature 1..153: note = chr12:120032454-120032607
  misc_feature 1..153: note = hyper
  source 1..153: mol_type = genomic DNA

SEQ ID NO: 55393 - DNA, 25 bp, Homo sapiens
  misc_feature 1..25: note = chr12:120032837-120032862
  misc_feature 1..25: note = hyper
  source 1..25: mol_type = genomic DNA
ctctctaggagtggccgctggggcc

SEQ ID NO: 55394 - DNA, 151 bp, Homo sapiens
  misc_feature 1..151: note = chr12:120033169-120033320
  misc_feature 1..151: note = hyper
  source 1..151: mol_type = genomic DNA
ccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 55395 - DNA, 32 bp, Homo sapiens; identical to SEQ ID NO: 34724
  misc_feature 1..32: note = chr12:120807600-120807632
  misc_feature 1..32: note = hyper
  source 1..32: mol_type = genomic DNA

SEQ ID NO: 55396 - DNA, 193 bp, Homo sapiens; identical to SEQ ID NO: 34725
  misc_feature 1..193: note = chr12:120807844-120808037
  misc_feature 1..193: note = hyper
  source 1..193: mol_type = genomic DNA

SEQ ID NO: 55397 - DNA, 30 bp, Homo sapiens; identical to SEQ ID NO: 34726
  misc_feature 1..30: note = chr12:120826930-120826960
  misc_feature 1..30: note = hyper
  source 1..30: mol_type = genomic DNA

SEQ ID NO: 55398 - DNA, 191 bp, Homo sapiens; identical to SEQ ID NO: 34727
  misc_feature 1..191: note = chr12:121566850-121567041
  misc_feature 1..191: note = hyper
  source 1..191: mol_type = genomic DNA

SEQ ID NO: 55399 - DNA, 36 bp, Homo sapiens; identical to SEQ ID NO: 34728
  misc_feature 1..36: note = chr12:122667836-122667872
  misc_feature 1..36: note = hyper
  source 1..36: mol_type = genomic DNA

SEQ ID NO: 55400 - DNA, 527 bp, Homo sapiens; identical to SEQ ID NO: 34729
  misc_feature 1..527: note = chr12:122688648-122689175
  misc_feature 1..527: note = hyper
  source 1..527: mol_type = genomic DNA

SEQ ID NO: 55401 - DNA, 156 bp, Homo sapiens; identical to SEQ ID NO: 34730
  misc_feature 1..156: note = chr12:123920515-123920671
  misc_feature 1..156: note = hyper
  source 1..156: mol_type = genomic DNA

SEQ ID NO: 55402 - DNA, 42 bp, Homo sapiens; identical to SEQ ID NO: 34731
  misc_feature 1..42: note = chr12:124779516-124779558
  misc_feature 1..42: note = hyper
  source 1..42: mol_type = genomic DNA

SEQ ID NO: 55403 - DNA, 15 bp, Homo sapiens
  misc_feature 1..15: note = chr12:125534407-125534422
  misc_feature 1..15: note = hyper
  source 1..15: mol_type = genomic DNA
cgggaagggagggga

SEQ ID NO: 55404 - DNA, 15 bp, Homo sapiens
  misc_feature 1..15: note = chr12:125670102-125670117
  misc_feature 1..15: note = hyper
  source 1..15: mol_type = genomic DNA
ctggatggaagaatt

SEQ ID NO: 55405 - DNA, 111 bp, Homo sapiens; identical to SEQ ID NO: 34734
  misc_feature 1..111: note = chr12:125670334-125670445
  misc_feature 1..111: note = hyper
  source 1..111: mol_type = genomic DNA

SEQ ID NO: 55406 - DNA, 369 bp, Homo sapiens; identical to SEQ ID NO: 34735
  misc_feature 1..369: note = chr12:125671544-125671913
  misc_feature 1..369: note = hyper
  source 1..369: mol_type = genomic DNA

SEQ ID NO: 55407 - DNA, 268 bp, Homo sapiens; identical to SEQ ID NO: 34736
  misc_feature 1..268: note = chr12:125672764-125673032
  misc_feature 1..268: note = hyper
  source 1..268: mol_type = genomic DNA

SEQ ID NO: 55408 - DNA, 127 bp, Homo sapiens
  misc_feature 1..127: note = chr12:126168427-126168554
  misc_feature 1..127: note = hyper
  source 1..127: mol_type = genomic DNA
gcacaggtggccccgcgcctctcacacaggttcagctcccgccggtccctgtgcagagcgccccctgccggtccctcttggaggctgggccagcgttgcgagtcttgccagggacgcgcgctctagc

SEQ ID NO: 55409 - DNA, 51 bp, Homo sapiens
  misc_feature 1..51: note = chr12:126168620-126168671
  misc_feature 1..51: note = hyper
  source 1..51: mol_type = genomic DNA
gcacctgtcctagaccccctgcgcctattcctcgcccgccccatccttccc

SEQ ID NO: 55410 - DNA, 267 bp, Homo sapiens; identical to SEQ ID NO: 34738
  misc_feature 1..267: note = chr12:126675639-126675906
  misc_feature 1..267: note = hyper
  source 1..267: mol_type = genomic DNA

SEQ ID NO: 55411 - DNA, 30 bp, Homo sapiens; identical to SEQ ID NO: 11481
  misc_feature 1..30: note = chr12:127212512-127212542
  misc_feature 1..30: note = hyper
  source 1..30: mol_type = genomic DNA

SEQ ID NO: 55412 - DNA, 17 bp, Homo sapiens
  misc_feature 1..17: note = chr12:127765432-127765449
  misc_feature 1..17: note = hyper
  source 1..17: mol_type = genomic DNA
cacgaggggccgacagg

SEQ ID NO: 55413 - DNA, 127 bp, Homo sapiens; identical to SEQ ID NO: 11483
  misc_feature 1..127: note = chr12:127865735-127865862
  misc_feature 1..127: note = hyper
  source 1..127: mol_type = genomic DNA

SEQ ID NO: 55414 - DNA, 251 bp, Homo sapiens
  misc_feature 1..251: note = chr12:128751133-128751384
  misc_feature 1..251: note = hyper
  source 1..251: mol_type = genomic DNA
cgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccggg

SEQ ID NO: 55415 - DNA, 127 bp, Homo sapiens
  misc_feature 1..127: note = chr12:128751694-128751821
  misc_feature 1..127: note = hyper
  source 1..127: mol_type = genomic DNA
aggctgcggaggctgcgggagaaaagttgtcccggccggagcgcgagcagcggcggagccggagccgccagagccagagccggagctgcggcggcgtggacccggcaggggcgggcctcggacagca

SEQ ID NO: 55416 - DNA, 27 bp, Homo sapiens
  misc_feature 1..27: note = chr12:128752240-128752267
  misc_feature 1..27: note = hyper
  source 1..27: mol_type = genomic DNA
ggtcccgagtcccgaatctcccacccc

SEQ ID NO: 55417 - DNA, 266 bp, Homo sapiens; identical to SEQ ID NO: 21563
  misc_feature 1..266: note = chr12:128752944-128753210
  misc_feature 1..266: note = hyper
  source 1..266: mol_type = genomic DNA

SEQ ID NO: 55418 - DNA, 84 bp, Homo sapiens; identical to SEQ ID NO: 34747
  misc_feature 1..84: note = chr12:129337826-129337910
  misc_feature 1..84: note = hyper
  source 1..84: mol_type = genomic DNA

SEQ ID NO: 55419 - DNA, 10 bp, Homo sapiens
  misc_feature 1..10: note = chr12:129338816-129338826
  misc_feature 1..10: note = hyper
  source 1..10: mol_type = genomic DNA
gcgttaatcc

SEQ ID NO: 55420 - DNA, 79 bp, Homo sapiens; identical to SEQ ID NO: 34749
  misc_feature 1..79: note = chr12:129338851-129338930
  misc_feature 1..79: note = hyper
  source 1..79: mol_type = genomic DNA

SEQ ID NO: 55421 - DNA, 30 bp, Homo sapiens; identical to SEQ ID NO: 34750
  misc_feature 1..30: note = chr12:130387483-130387513
  misc_feature 1..30: note = hyper
  source 1..30: mol_type = genomic DNA

SEQ ID NO: 55422 - DNA, 114 bp, Homo sapiens
  misc_feature 1..114: note = chr12:130387811-130387925
  misc_feature 1..114: note = hyper
  source 1..114: mol_type = genomic DNA
aaaacagggcggccaggctgatgagtaccggcgaccagtggtgccacagcgtccccatctcagacgggcacatcctggagacccggagcgcagatcctccgctccccggcgccg

SEQ ID NO: 55423 - DNA, 131 bp, Homo sapiens; identical to SEQ ID NO: 21568
  misc_feature 1..131: note = chr12:130388279-130388410
  misc_feature 1..131: note = hyper
  source 1..131: mol_type = genomic DNA

SEQ ID NO: 55424 - DNA, 30 bp, Homo sapiens; identical to SEQ ID NO: 34754
  misc_feature 1..30: note = chr12:130498725-130498755
  misc_feature 1..30: note = hyper
  source 1..30: mol_type = genomic DNA

SEQ ID NO: 55425 - DNA, 42 bp, Homo sapiens; identical to SEQ ID NO: 11494
  misc_feature 1..42: note = chr12:130526846-130526888
  misc_feature 1..42: note = hyper
  source 1..42: mol_type = genomic DNA

SEQ ID NO: 55426 - DNA, 164 bp, Homo sapiens; identical to SEQ ID NO: 34756
  misc_feature 1..164: note = chr12:130526931-130527095
  misc_feature 1..164: note = hyper
  source 1..164: mol_type = genomic DNA

SEQ ID NO: 55427 - DNA, 43 bp, Homo sapiens; identical to SEQ ID NO: 21571
  misc_feature 1..43: note = chr12:130589266-130589309
  misc_feature 1..43: note = hyper
  source 1..43: mol_type = genomic DNA

SEQ ID NO: 55428 - DNA, 47 bp, Homo sapiens
  misc_feature 1..47: note = chr12:130645186-130645233
  misc_feature 1..47: note = hyper
  source 1..47: mol_type = genomic DNA
ccccaagtttcttaccgatgtaaaaattgtagggcttgttttaatta

SEQ ID NO: 55429 - DNA, 123 bp, Homo sapiens
  misc_feature 1..123: note = chr12:130645627-130645750
  misc_feature 1..123: note = hyper
  source 1..123: mol_type = genomic DNA
ccctgggaggagagggccggccacctcctaggggtgctgtttttttaagggtcaacccaggacgctacgggaagcacctggcgcatccttgggaacagtggggcttggcggtgggcgcccacc

SEQ ID NO: 55430 - DNA, 235 bp, Homo sapiens; identical to SEQ ID NO: 34759
  misc_feature 1..235: note = chr12:130646084-130646319
  misc_feature 1..235: note = hyper
  source 1..235: mol_type = genomic DNA

SEQ ID NO: 55431 - DNA, 89 bp, Homo sapiens; identical to SEQ ID NO: 34760
  misc_feature 1..89: note = chr12:130646565-130646654
  misc_feature 1..89: note = hyper
  source 1..89: mol_type = genomic DNA

SEQ ID NO: 55432 - DNA, 48 bp, Homo sapiens; identical to SEQ ID NO: 34764
  misc_feature 1..48: note = chr12:131199494-131199542
  misc_feature 1..48: note = hyper
  source 1..48: mol_type = genomic DNA

SEQ ID NO: 55433 - DNA, 49 bp, Homo sapiens; identical to SEQ ID NO: 34765
  misc_feature 1..49: note = chr12:131199887-131199936
  misc_feature 1..49: note = hyper
  source 1..49: mol_type = genomic DNA

SEQ ID NO: 55434 - DNA, 47 bp, Homo sapiens; identical to SEQ ID NO: 34766
  misc_feature 1..47: note = chr12:131199937-131199984
  misc_feature 1..47: note = hyper
  source 1..47: mol_type = genomic DNA

SEQ ID NO: 55435 - DNA, 24 bp, Homo sapiens
  misc_feature 1..24: note = chr12:131200355-131200379
  misc_feature 1..24: note = hyper
  source 1..24: mol_type = genomic DNA
ctgagaagcctggggcgcactccc

SEQ ID NO: 55436 - DNA, 150 bp, Homo sapiens; identical to SEQ ID NO: 34769
  misc_feature 1..150: note = chr12:132312680-132312830
  misc_feature 1..150: note = hyper
  source 1..150: mol_type = genomic DNA

SEQ ID NO: 55437 - DNA, 730 bp, Homo sapiens; identical to SEQ ID NO: 34770
  misc_feature 1..730: note = chr12:132312856-132313586
  misc_feature 1..730: note = hyper
  source 1..730: mol_type = genomic DNA

SEQ ID NO: 55438 - DNA, 30 bp, Homo sapiens; identical to SEQ ID NO: 34771
  misc_feature 1..30: note = chr12:132314800-132314830
  misc_feature 1..30: note = hyper
  source 1..30: mol_type = genomic DNA

SEQ ID NO: 55439 - DNA, 30 bp, Homo sapiens; identical to SEQ ID NO: 34772
  misc_feature 1..30: note = chr12:132315470-132315500
  misc_feature 1..30: note = hyper
  source 1..30: mol_type = genomic DNA

SEQ ID NO: 55440 - DNA, 30 bp, Homo sapiens; identical to SEQ ID NO: 34773
  misc_feature 1..30: note = chr12:133174537-133174567
  misc_feature 1..30: note = hyper
  source 1..30: mol_type = genomic DNA

SEQ ID NO: 55441 - DNA, 122 bp, Homo sapiens; identical to SEQ ID NO: 34774
  misc_feature 1..122: note = chr12:133194939-133195061
  misc_feature 1..122: note = hyper
  source 1..122: mol_type = genomic DNA

SEQ ID NO: 55442 - DNA, 31 bp, Homo sapiens
  misc_feature 1..31: note = chr12:133195062-133195093
  misc_feature 1..31: note = hyper
  source 1..31: mol_type = genomic DNA
agctcggaaaaagttcccacccggggaatcc

SEQ ID NO: 55443 - DNA, 33 bp, Homo sapiens
  misc_feature 1..33: note = chr12:133195196-133195229
  misc_feature 1..33: note = hyper
  source 1..33: mol_type = genomic DNA
gctcccagccccacctgggacacccgggactcc

SEQ ID NO: 55444 - DNA, 140 bp, Homo sapiens; identical to SEQ ID NO: 34776
  misc_feature 1..140: note = chr12:133195488-133195628
  misc_feature 1..140: note = hyper
  source 1..140: mol_type = genomic DNA

SEQ ID NO: 55445 - DNA, 163 bp, Homo sapiens
  misc_feature 1..163: note = chr12:133463573-133463736
  misc_feature 1..163: note = hyper
  source 1..163: mol_type = genomic DNA
cttatacagttgtaacgaaggctaaatgatgtgcgtgaatcatgcgcaagaatcggtgggcagaacaccgaataaataccagttcttacatgacatttcactccacggaaaaatctggagcgcacactgcaccgccgcccgtgtggcctgcccgcaacccggt

SEQ ID NO: 55446 - DNA, 53 bp, Homo sapiens
  misc_feature 1..53: note = chr12:133463876-133463929
  misc_feature 1..53: note = hyper
  source 1..53: mol_type = genomic DNA
ggcggcggcgactgcttgccttcctcgggccgctccatcgggattcacatctg

SEQ ID NO: 55447 - DNA, 127 bp, Homo sapiens; identical to SEQ ID NO: 34778
  misc_feature 1..127: note = chr12:133464414-133464541
  misc_feature 1..127: note = hyper
  source 1..127: mol_type = genomic DNA

SEQ ID NO: 55448 - DNA, 30 bp, Homo sapiens; identical to SEQ ID NO: 34779
  misc_feature 1..30: note = chr12:133464773-133464803
  misc_feature 1..30: note = hyper
  source 1..30: mol_type = genomic DNA

SEQ ID NO: 55449 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 55450 - DNA, 146 bp, Homo sapiens
  misc_feature 1..146: note = chr12:133484596-133484742
  misc_feature 1..146: note = hyper
  source 1..146: mol_type = genomic DNA
cagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtca

SEQ ID NO: 55451 - DNA, 118 bp, Homo sapiens; identical to SEQ ID NO: 21582
  misc_feature 1..118: note = chr12:133485439-133485557
  misc_feature 1..118: note = hyper
  source 1..118: mol_type = genomic DNA

SEQ ID NO: 55452 - DNA, 30 bp, Homo sapiens; identical to SEQ ID NO: 34787
  misc_feature 1..30: note = chr13:20692885-20692915
  misc_feature 1..30: note = hyper
  source 1..30: mol_type = genomic DNA

SEQ ID NO: 55453 - DNA, 101 bp, Homo sapiens; identical to SEQ ID NO: 34788
  misc_feature 1..101: note = chr13:20734542-20734643
  misc_feature 1..101: note = hyper
  source 1..101: mol_type = genomic DNA

SEQ ID NO: 55454 - DNA, 94 bp, Homo sapiens; identical to SEQ ID NO: 34789
  misc_feature 1..94: note = chr13:20735438-20735532
  misc_feature 1..94: note = hyper
  source 1..94: mol_type = genomic DNA

SEQ ID NO: 55455 - DNA, 271 bp, Homo sapiens; identical to SEQ ID NO: 21584
  misc_feature 1..271: note = chr13:20735533-20735804
  misc_feature 1..271: note = hyper
  source 1..271: mol_type = genomic DNA

SEQ ID NO: 55456 - DNA, 62 bp, Homo sapiens; identical to SEQ ID NO: 34791
  misc_feature 1..62: note = chr13:20766251-20766313
  misc_feature 1..62: note = hyper
  source 1..62: mol_type = genomic DNA

SEQ ID NO: 55457 - DNA, 534 bp, Homo sapiens; identical to SEQ ID NO: 34792
  misc_feature 1..534: note = chr13:20805970-20806504
  misc_feature 1..534: note = hyper
  source 1..534: mol_type = genomic DNA

SEQ ID NO: 55458 - DNA, 45 bp, Homo sapiens; identical to SEQ ID NO: 34793
  misc_feature 1..45: note = chr13:21520313-21520358
  misc_feature 1..45: note = hyper
  source 1..45: mol_type = genomic DNA

SEQ ID NO: 55459 - DNA, 30 bp, Homo sapiens; identical to SEQ ID NO: 34794
  misc_feature 1..30: note = chr13:21634461-21634491
  misc_feature 1..30: note = hyper
  source 1..30: mol_type = genomic DNA

SEQ ID NO: 55460 - DNA, 154 bp, Homo sapiens; identical to SEQ ID NO: 34795
  misc_feature 1..154: note = chr13:21634799-21634953
  misc_feature 1..154: note = hyper
  source 1..154: mol_type = genomic DNA

SEQ ID NO: 55461 - DNA, 13 bp, Homo sapiens
  misc_feature 1..13: note = chr13:21649623-21649636
  misc_feature 1..13: note = hyper
  source 1..13: mol_type = genomic DNA
aaataatcacaga

SEQ ID NO: 55462 - DNA, 267 bp, Homo sapiens; identical to SEQ ID NO: 21589
  misc_feature 1..267: note = chr13:21649775-21650042
  misc_feature 1..267: note = hyper
  source 1..267: mol_type = genomic DNA

SEQ ID NO: 55463 - DNA, 395 bp, Homo sapiens
  misc_feature 1..395: note = chr13:22243469-22243864
  misc_feature 1..395: note = hyper
  source 1..395: mol_type = genomic DNA
atgcttcagaaacacgtaagcaagacgcaccgagccagccccggacacccaatgaccctggactgcggcaaagggggggtgggaaaggaagaggggaggaccactcgctcttctctccttcctcctcgcccgggccggagcacgccttcctccccggagggcaggggaaggtcgctccaggtcgctggcacctccagcgcccccgaaatctgcaaattcatcgctccctttcgtcttcaggcgaagccctcccgtccggagtagggccagccccagttatgcatctccagcctttagctgactactaaggcggatccgacttctcccccataaccaggttttgattcgcttccccaccgcaggggttcagtctctgctttcgactttgcttctca

SEQ ID NO: 55464 - DNA, 69 bp, Homo sapiens; identical to SEQ ID NO: 34798
  misc_feature 1..69: note = chr13:22247111-22247180
  misc_feature 1..69: note = hyper
  source 1..69: mol_type = genomic DNA

SEQ ID NO: 55465 - DNA, 159 bp, Homo sapiens
  misc_feature 1..159: note = chr13:23489692-23489851
  misc_feature 1..159: note = hyper
  source 1..159: mol_type = genomic DNA
gcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaag

SEQ ID NO: 55466 - DNA, 57 bp, Homo sapiens; identical to SEQ ID NO: 21591
  misc_feature 1..57: note = chr13:23489914-23489971
  misc_feature 1..57: note = hyper
  source 1..57: mol_type = genomic DNA

SEQ ID NO: 55467 - DNA, 264 bp, Homo sapiens
  misc_feature 1..264: note = chr13:23734020-23734284
  misc_feature 1..264: note = hyper
  source 1..264: mol_type = genomic DNA
gaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggag

SEQ ID NO: 55468 - DNA, 30 bp, Homo sapiens; identical to SEQ ID NO: 34801
  misc_feature 1..30: note = chr13:24007814-24007844
  misc_feature 1..30: note = hyper
  source 1..30: mol_type = genomic DNA

SEQ ID NO: 55469 - DNA, 209 bp, Homo sapiens; identical to SEQ ID NO: 34802
  misc_feature 1..209: note = chr13:24040780-24040989
  misc_feature 1..209: note = hyper
  source 1..209: mol_type = genomic DNA

SEQ ID NO: 55470 - DNA, 30 bp, Homo sapiens; identical to SEQ ID NO: 34803
  misc_feature 1..30: note = chr13:24153182-24153212
  misc_feature 1..30: note = hyper
  source 1..30: mol_type = genomic DNA

SEQ ID NO: 55471 - DNA, 178 bp, Homo sapiens; identical to SEQ ID NO: 34804
  misc_feature 1..178: note = chr13:24153573-24153751
  misc_feature 1..178: note = hyper
  source 1..178: mol_type = genomic DNA

SEQ ID NO: 55472 - DNA, 70 bp, Homo sapiens; identical to SEQ ID NO: 34805
  misc_feature 1..70: note = chr13:24154053-24154123
  misc_feature 1..70: note = hyper
  source 1..70: mol_type = genomic DNA

SEQ ID NO: 55473 - DNA, 53 bp, Homo sapiens
  misc_feature 1..53: note = chr13:24477590-24477643
  misc_feature 1..53: note = hyper
  source 1..53: mol_type = genomic DNA
tgccgaggtcccaggcgggcggcaggatccaattagtccgtgtaaaatgagag

SEQ ID NO: 55474 - DNA, 111 bp, Homo sapiens
  misc_feature 1..111: note = chr13:24477906-24478017
  misc_feature 1..111: note = hyper
  source 1..111: mol_type = genomic DNA
taggcagcctgccggcgcagacccagcgagggaaggccagtctcgggcctccaaccggacacgcgctccccattccgggctctcccacgtctgcacactccagcccagcca

SEQ ID NO: 55475 - DNA, 243 bp, Homo sapiens; identical to SEQ ID NO: 34807
  misc_feature 1..243: note = chr13:25254954-25255197
  misc_feature 1..243: note = hyper
  source 1..243: mol_type = genomic DNA

SEQ ID NO: 55476 - DNA, 26 bp, Homo sapiens
  misc_feature 1..26: note = chr13:25319830-25319856
  misc_feature 1..26: note = hyper
  source 1..26: mol_type = genomic DNA
ccagaacaacgagggcgacgaagaca

SEQ ID NO: 55477 - DNA, 349 bp, Homo sapiens; identical to SEQ ID NO: 21597
  misc_feature 1..349: note = chr13:25321350-25321699
  misc_feature 1..349: note = hyper
  source 1..349: mol_type = genomic DNA

SEQ ID NO: 55478 - DNA, 252 bp, Homo sapiens
  misc_feature 1..252: note = chr13:25321942-25322194
  misc_feature 1..252: note = hyper
  source 1..252: mol_type = genomic DNA
cagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctct

SEQ ID NO: 55479 - DNA, 72 bp, Homo sapiens; identical to SEQ ID NO: 34813
  misc_feature 1..72: note = chr13:25592968-25593040
  misc_feature 1..72: note = hyper
  source 1..72: mol_type = genomic DNA

SEQ ID NO: 55480 - DNA, 55 bp, Homo sapiens; identical to SEQ ID NO: 34815
  misc_feature 1..55: note = chr13:25620899-25620954
  misc_feature 1..55: note = hyper
  source 1..55: mol_type = genomic DNA

SEQ ID NO: 55481 - DNA, 90 bp, Homo sapiens
  misc_feature 1..90: note = chr13:25620955-25621045
  misc_feature 1..90: note = hyper
  source 1..90: mol_type = genomic DNA
aggagccctggagactcagggcccgtctggtgcggcccgggctttgctccgcgctcgccccctgcagctgccggggccgccgcaactttt

SEQ ID NO: 55482 - DNA, 17 bp, Homo sapiens
  misc_feature 1..17: note = chr13:25621394-25621411
  misc_feature 1..17: note = hyper
  source 1..17: mol_type = genomic DNA
ctcggccagcgcgggac

SEQ ID NO: 55483 - DNA, 79 bp, Homo sapiens
  misc_feature 1..79: note = chr13:25744637-25744716
  misc_feature 1..79: note = hyper
  source 1..79: mol_type = genomic DNA
ttttcagtgaagtcacgtcagaaaacatcaaacaaatacgatctgccgacgggtctgagggtggatcgacagaggcagg

SEQ ID NO: 55484 - DNA, 84 bp, Homo sapiens; identical to SEQ ID NO: 34821
  misc_feature 1..84: note = chr13:25945934-25946018
  misc_feature 1..84: note = hyper
  source 1..84: mol_type = genomic DNA

SEQ ID NO: 55485 - DNA, 21 bp, Homo sapiens
  misc_feature 1..21: note = chr13:25946599-25946620
  misc_feature 1..21: note = hyper
  source 1..21: mol_type = genomic DNA
gcgtcgctgcacctgcggggc

SEQ ID NO: 55486 - DNA, 51 bp, Homo sapiens; identical to SEQ ID NO: 34824
  misc_feature 1..51: note = chr13:25946801-25946852
  misc_feature 1..51: note = hyper
  source 1..51: mol_type = genomic DNA

SEQ ID NO: 55487 - DNA, 183 bp, Homo sapiens; identical to SEQ ID NO: 34827
  misc_feature 1..183: note = chr13:26624710-26624893
  misc_feature 1..183: note = hyper
  source 1..183: mol_type = genomic DNA

SEQ ID NO: 55488 - DNA, 35 bp, Homo sapiens
  misc_feature 1..35: note = chr13:26625266-26625301
  misc_feature 1..35: note = hyper
  source 1..35: mol_type = genomic DNA
cgacgccgggccctaggtccaggagctcctaagcc

SEQ ID NO: 55489 - DNA, 39 bp, Homo sapiens; identical to SEQ ID NO: 34829
  misc_feature 1..39: note = chr13:26626239-26626278
  misc_feature 1..39: note = hyper
  source 1..39: mol_type = genomic DNA

SEQ ID NO: 55490 - DNA, 86 bp, Homo sapiens; identical to SEQ ID NO: 34830
  misc_feature 1..86: note = chr13:27050496-27050582
  misc_feature 1..86: note = hyper
  source 1..86: mol_type = genomic DNA

SEQ ID NO: 55491 - DNA, 276 bp, Homo sapiens; identical to SEQ ID NO: 34831
  misc_feature 1..276: note = chr13:27131553-27131829
  misc_feature 1..276: note = hyper
  source 1..276: mol_type = genomic DNA

SEQ ID NO: 55492 - DNA, 451 bp, Homo sapiens; identical to SEQ ID NO: 34832
  misc_feature 1..451: note = chr13:27131859-27132310
  misc_feature 1..451: note = hyper
  source 1..451: mol_type = genomic DNA

SEQ ID NO: 55493 - DNA, 158 bp, Homo sapiens; identical to SEQ ID NO: 34833
  misc_feature 1..158: note = chr13:27132629-27132787
  misc_feature 1..158: note = hyper
  source 1..158: mol_type = genomic DNA

SEQ ID NO: 55494 - DNA, 160 bp, Homo sapiens; identical to SEQ ID NO: 21609
  misc_feature 1..160: note = chr13:27334563-27334723
  misc_feature 1..160: note = hyper
  source 1..160: mol_type = genomic DNA

SEQ ID NO: 55495 - DNA, 48 bp, Homo sapiens; identical to SEQ ID NO: 21610
  misc_feature 1..48: note = chr13:27334724-27334772
  misc_feature 1..48: note = hyper
  source 1..48: mol_type = genomic DNA

SEQ ID NO: 55496 - DNA, 86 bp, Homo sapiens
  misc_feature 1..86: note = chr13:27334894-27334980
  misc_feature 1..86: note = hyper
  source 1..86: mol_type = genomic DNA
agcagcctcggctcgcgcgcccagctttccccgccgcgcccgcccggcccacacgctccccgcgcgcgcgccgcccccgccccgcg

SEQ ID NO: 55497 - DNA, 30 bp, Homo sapiens; identical to SEQ ID NO: 11551
  misc_feature 1..30: note = chr13:28363673-28363703
  misc_feature 1..30: note = hyper
  source 1..30: mol_type = genomic DNA

SEQ ID NO: 55498 - DNA, 142 bp, Homo sapiens; identical to SEQ ID NO: 34837
  misc_feature 1..142: note = chr13:28363953-28364095
  misc_feature 1..142: note = hyper
  source 1..142: mol_type = genomic DNA

SEQ ID NO: 55499 - DNA, 28 bp, Homo sapiens
  misc_feature 1..28: note = chr13:28364723-28364751
  misc_feature 1..28: note = hyper
  source 1..28: mol_type = genomic DNA
cgctggccactcgcgggctcccagctcc

SEQ ID NO: 55500 - DNA, 46 bp, Homo sapiens; identical to SEQ ID NO: 21613
  misc_feature 1..46: note = chr13:28365659-28365705
  misc_feature 1..46: note = hyper
  source 1..46: mol_type = genomic DNA

SEQ ID NO: 55501 - DNA, 74 bp, Homo sapiens
  misc_feature 1..74: note = chr13:28366408-28366482
  misc_feature 1..74: note = hyper
  source 1..74: mol_type = genomic DNA
cgagggcgcctgttacggcgtgggtggggttgacaagaatagagtacattatgcagttcatttagttaacaagt

SEQ ID NO: 55502 - DNA, 25 bp, Homo sapiens
  misc_feature 1..25: note = chr13:28366577-28366602
  misc_feature 1..25: note = hyper
  source 1..25: mol_type = genomic DNA
ggcaatagtcctatttaagccgcgc

SEQ ID NO: 55503 - DNA, 360 bp, Homo sapiens
  misc_feature 1..360: note = chr13:28366664-28367024
  misc_feature 1..360: note = hyper
  source 1..360: mol_type = genomic DNA
cggcagcagaggctactgtttcagcctaggtctcagccgcgcgttcagcctcctgggcagaggcagctgcgggataccgcggccagggaaagcgcgtggagagccgaaaggtgcggtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgca

SEQ ID NO: 55504 - skipped

SEQ ID NO: 55505 - DNA, 193 bp, Homo sapiens
  misc_feature 1..193: note = chr13:28367601-28367794
  misc_feature 1..193: note = hyper
  source 1..193: mol_type = genomic DNA
gtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttct

SEQ ID NO: 55506 - DNA, 135 bp, Homo sapiens
  misc_feature 1..135: note = chr13:28368168-28368303
  misc_feature 1..135: note = hyper
  source 1..135: mol_type = genomic DNA
acccgcagccaaaccactgcctggcatggatttggcactgctttgcagaggtcccgggcctgggcagggctgagagcttggcagagactggaccatggcgtccccgccccagggctcgctcgtgtccaaagccaa

SEQ ID NO: 55507 - DNA, 234 bp, Homo sapiens
  misc_feature 1..234: note = chr13:28368718-28368952
  misc_feature 1..234: note = hyper
  source 1..234: mol_type = genomic DNA
acagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttt

SEQ ID NO: 55508 - DNA, 77 bp, Homo sapiens
  misc_feature 1..77: note = chr13:28369990-28370067
  misc_feature 1..77: note = hyper
  source 1..77: mol_type = genomic DNA
gaaagacggtccacctgaggttgcttaacatttttgaagctcatttcctcccccccacaaaacggctttattgagct

SEQ ID NO: 55509 - DNA, 15 bp, Homo sapiens
  misc_feature 1..15: note = chr13:28370409-28370424
  misc_feature 1..15: note = hyper
  source 1..15: mol_type = genomic DNA
tagtcccagtctaac

SEQ ID NO: 55510 - DNA, 184 bp, Homo sapiens
  misc_feature 1..184: note = chr13:28370763-28370947
  misc_feature 1..184: note = hyper
  source 1..184: mol_type = genomic DNA
caccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactct

SEQ ID NO: 55511 - DNA, 400 bp, Homo sapiens
  misc_feature 1..400: note = chr13:28371061-28371461
  misc_feature 1..400: note = hyper
  source 1..400: mol_type = genomic DNA
acctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 55512 - DNA, 104 bp, Homo sapiens
  misc_feature 1..104: note = chr13:28394662-28394766
  misc_feature 1..104: note = hyper
  source 1..104: mol_type = genomic DNA
agttgtgttggaacccgtggagagaaggaactgtccgtttccaaactctgcttcggcccctctcccctcccacccacggccccaggcagagagggccggaaagg

SEQ ID NO: 55513 - DNA, 246 bp, Homo sapiens; identical to SEQ ID NO: 21619
  misc_feature 1..246: note = chr13:28395255-28395501
  misc_feature 1..246: note = hyper
  source 1..246: mol_type = genomic DNA

SEQ ID NO: 55514 - DNA, 104 bp, Homo sapiens; identical to SEQ ID NO: 21620
  misc_feature 1..104: note = chr13:28395553-28395657
  misc_feature 1..104: note = hyper
  source 1..104: mol_type = genomic DNA

SEQ ID NO: 55515 - DNA, 140 bp, Homo sapiens; identical to SEQ ID NO: 11563
  misc_feature 1..140: note = chr13:28396578-28396718
  misc_feature 1..140: note = hyper
  source 1..140: mol_type = genomic DNA

SEQ ID NO: 55516 - DNA, 292 bp, Homo sapiens; identical to SEQ ID NO: 34853
  misc_feature 1..292: note = chr13:28397177-28397469
  misc_feature 1..292: note = hyper
  source 1..292: mol_type = genomic DNA

SEQ ID NO: 55517 - DNA, 298 bp, Homo sapiens
  misc_feature 1..298: note = chr13:28491946-28492244
  misc_feature 1..298: note = hyper
  source 1..298: mol_type = genomic DNA
ctgagagcctcttttctttctgcagggccgagcaaaaatattaaatggaagcaaatgaagcatcgaaatggagaccaatttacagaaatgtgcaattagttgagaagtgcaaagtaaacactccgggggtggcaggcgaggcagggagcaggggagggagagtggggcgcagactgagtccagagtgggtgtaggggtgcccagggaggaggggaagggggaggaaaaggagggggaggggaaaagtggccgatctttgtcctgagcggagcttgccgtccgctcataaccgcgtcgc

SEQ ID NO: 55518 - DNA, 61 bp, Homo sapiens; identical to SEQ ID NO: 34856
  misc_feature 1..61: note = chr13:28494773-28494834
  misc_feature 1..61: note = hyper
  source 1..61: mol_type = genomic DNA

SEQ ID NO: 55519 - DNA, 30 bp, Homo sapiens; identical to SEQ ID NO: 34857
  misc_feature 1..30: note = chr13:28503435-28503465
  misc_feature 1..30: note = hyper
  source 1..30: mol_type = genomic DNA

SEQ ID NO: 55520 - DNA, 145 bp, Homo sapiens; identical to SEQ ID NO: 34858
  misc_feature 1..145: note = chr13:28527239-28527384
  misc_feature 1..145: note = hyper
  source 1..145: mol_type = genomic DNA

SEQ ID NO: 55521 - DNA, 689 bp, Homo sapiens
  misc_feature 1..689: note = chr13:28527845-28528534
  misc_feature 1..689: note = hyper
  source 1..689: mol_type = genomic DNA
tgtgaagagaaggagcgggggttttaagagccacagcgccaccgagagagtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaggccgcggggtccaggccgttccgcccgctcagccggagcagcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttc

SEQ ID NO: 55522 - DNA, 84 bp, Homo sapiens
  misc_feature 1..84: note = chr13:28528748-28528832
  misc_feature 1..84: note = hyper
  source 1..84: mol_type = genomic DNA
cgggcgcccgctgggagcgcggggaggctctgggctcagggaagctgcgctccgagtggccttggaggacggtcaaggagcccg

SEQ ID NO: 55523 - DNA, 38 bp, Homo sapiens; identical to SEQ ID NO: 34860
  misc_feature 1..38: note = chr13:28534516-28534554
  misc_feature 1..38: note = hyper
  source 1..38: mol_type = genomic DNA

SEQ ID NO: 55524 - DNA, 251 bp, Homo sapiens; identical to SEQ ID NO: 34861
  misc_feature 1..251: note = chr13:28535305-28535556
  misc_feature 1..251: note = hyper
  source 1..251: mol_type = genomic DNA

SEQ ID NO: 55525 - DNA, 39 bp, Homo sapiens
  misc_feature 1..39: note = chr13:28540706-28540745
  misc_feature 1..39: note = hyper
  source 1..39: mol_type = genomic DNA
cgcctggaagtgtctcggagcgacccttgctcgggtgct

SEQ ID NO: 55526 - DNA, 18 bp, Homo sapiens
  misc_feature 1..18: note = chr13:28541082-28541100
  misc_feature 1..18: note = hyper
  source 1..18: mol_type = genomic DNA
catcacaagggcacccgg

SEQ ID NO: 55527 - DNA, 71 bp, Homo sapiens; identical to SEQ ID NO: 34864
  misc_feature 1..71: note = chr13:28541179-28541250
  misc_feature 1..71: note = hyper
  source 1..71: mol_type = genomic DNA

SEQ ID NO: 55528 - DNA, 74 bp, Homo sapiens; identical to SEQ ID NO: 34865
  misc_feature 1..74: note = chr13:28542653-28542727
  misc_feature 1..74: note = hyper
  source 1..74: mol_type = genomic DNA

SEQ ID NO: 55529 - DNA, 484 bp, Homo sapiens
  misc_feature 1..484: note = chr13:28542728-28543212
  misc_feature 1..484: note = hyper
  source 1..484: mol_type = genomic DNA
tttgcagcagcccagaagcgcaggaaggcgcggcggccgggtggtgcgggtggtgatgcgggtggtggtgcggatggtagtctgcggggctgctgtagcccatggctgcggccggggagccaccgttgaggccgtgagccacggcgttggcggcggccgcggcgcctccgggcgcgtagccattccagtcctcccggagtggggcgccatacgctgccggccaggatggccccggggactgcgcgctgtccaagttcgctgccgctgcagctgcggccgccacgtggtaaccgccgtagtccgggtactgcggggggctgacgaagttctgcggcgccaggttgaggccgccagagtggcgcacggagctagggtacatgctcacgtccttgtccaggaggtagctcacgtacatggtggcgagggtccgggagcagacctcaccatgctgcctggggaccgacgctggaggctgccggggggc

SEQ ID NO: 55530 - DNA, 194 bp, Homo sapiens
  misc_feature 1..194: note = chr13:28543242-28543436
  misc_feature 1..194: note = hyper
  source 1..194: mol_type = genomic DNA
agcggcgggtggctgcgccccagcccgcggtgctccgctggctcctcgcggctcttctgcctccgaggcggtccctccctctggcctgcctcctccctccctccctttcttccttctttcctcccacctccttcccactaggctgcagaggcggggaagacccgccacaggctggcgtgcggagccccaggccg

SEQ ID NO: 55531 - DNA, 199 bp, Homo sapiens
  misc_feature 1..199: note = chr13:28544198-28544397
  misc_feature 1..199: note = hyper
  source 1..199: mol_type = genomic DNA
ggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttaca

SEQ ID NO: 55532 - DNA, 30 bp, Homo sapiens; identical to SEQ ID NO: 34869
  misc_feature 1..30: note = chr13:28545247-28545277
  misc_feature 1..30: note = hyper
  source 1..30: mol_type = genomic DNA

SEQ ID NO: 55533 - DNA, 288 bp, Homo sapiens
  misc_feature 1..288: note = chr13:28551129-28551417
  misc_feature 1..288: note = hyper
  source 1..288: mol_type = genomic DNA
gccacctctggccttcgcctattaccttgtctttgttggggagaccatgggtgtttcatttctcctctgccaatagaagcctaagtagtatttgttggggctctttacaccttccctgtgttggggggggcgggggggtgtcgacgggtggtagaatgtggtgggctcctccgcaggatgctaatgtactttcccccagtggacagtctggctgctggtacaggaagctgcccagcctaataggggtctgaaactccagggctgacaagcaaagatttctatgggcac

SEQ ID NO: 55534 - DNA, 88 bp, Homo sapiens; identical to SEQ ID NO: 21634
  misc_feature 1..88: note = chr13:28551461-28551549
  misc_feature 1..88: note = hyper
  source 1..88: mol_type = genomic DNA

SEQ ID NO: 55535 - DNA, 292 bp, Homo sapiens
  misc_feature 1..292: note = chr13:28551658-28551950
  misc_feature 1..292: note = hyper
  source 1..292: mol_type = genomic DNA
cgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccac

SEQ ID NO: 55536 - DNA, 218 bp, Homo sapiens
  misc_feature 1..218: note = chr13:28552167-28552385
  misc_feature 1..218: note = hyper
  source 1..218: mol_type = genomic DNA
cccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggt

SEQ ID NO: 55537 - DNA, 135 bp, Homo sapiens
  misc_feature 1..135: note = chr13:28552659-28552794
  misc_feature 1..135: note = hyper
  source 1..135: mol_type = genomic DNA
cgcgtaggccgcgcccggcccccctgccccgccccgccccgcccggccccaaagaaggctgcgggagggtgaagtagagtacccaggcggtgatgtcctggcggaacaggggcgcccttggcgcgcccctctaac

SEQ ID NO: 55538 - DNA, 206 bp, Homo sapiens
  misc_feature 1..206: note = chr13:28552824-28553030
  misc_feature 1..206: note = hyper
  source 1..206: mol_type = genomic DNA
actacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcgataaggatcctgagcttttcctatctttcaaagtcctttgctctcagggggggcttt

SEQ ID NO: 55539 - DNA, 35 bp, Homo sapiens
  misc_feature 1..35: note = chr13:28553138-28553173
  misc_feature 1..35: note = hyper
  source 1..35: mol_type = genomic DNA
gggataacatccatggggctcggcaaataaatgcc

SEQ ID NO: 55540 - DNA, 449 bp, Homo sapiens
  misc_feature 1..449: note = chr13:28674734-28675183
  misc_feature 1..449: note = hyper
  source 1..449: mol_type = genomic DNA
tcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaa

SEQ ID NO: 55541 - DNA, 510 bp, Homo sapiens; identical to SEQ ID NO: 21639
  misc_feature 1..510: note = chr13:29068416-29068926
  misc_feature 1..510: note = hyper
  source 1..510: mol_type = genomic DNA

SEQ ID NO: 55542 - DNA, 211 bp, Homo sapiens
  misc_feature 1..211: note = chr13:29069065-29069276
  misc_feature 1..211: note = hyper
  source 1..211: mol_type = genomic DNA
cgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagcc

SEQ ID NO: 55543 - DNA, 32 bp, Homo sapiens; identical to SEQ ID NO: 11588
  misc_feature 1..32: note = chr13:29069551-29069583
  misc_feature 1..32: note = hyper
  source 1..32: mol_type = genomic DNA

SEQ ID NO: 55544 - DNA, 30 bp, Homo sapiens; identical to SEQ ID NO: 34881
  misc_feature 1..30: note = chr13:29069801-29069831
  misc_feature 1..30: note = hyper
  source 1..30: mol_type = genomic DNA

SEQ ID NO: 55545 - DNA, 334 bp, Homo sapiens; identical to SEQ ID NO: 34882
  misc_feature 1..334: note = chr13:29105249-29105583
  misc_feature 1..334: note = hyper
  source 1..334: mol_type = genomic DNA

SEQ ID NO: 55546 - DNA, 208 bp, Homo sapiens; identical to SEQ ID NO: 34886
  misc_feature 1..208: note = chr13:29393656-29393864
  misc_feature 1..208: note = hyper
  source 1..208: mol_type = genomic DNA

SEQ ID NO: 55547 - DNA, 14 bp, Homo sapiens
  misc_feature 1..14: note = chr13:29394329-29394343
  misc_feature 1..14: note = hyper
  source 1..14: mol_type = genomic DNA
gggagcgcctgggc

SEQ ID NO: 55548 - DNA, 268 bp, Homo sapiens; identical to SEQ ID NO: 34888
  misc_feature 1..268: note = chr13:29394643-29394911
  misc_feature 1..268: note = hyper
  source 1..268: mol_type = genomic DNA

SEQ ID NO: 55549 - DNA, 160 bp, Homo sapiens; identical to SEQ ID NO: 34889
  misc_feature 1..160: note = chr13:33001068-33001228
  misc_feature 1..160: note = hyper
  source 1..160: mol_type = genomic DNA

SEQ ID NO: 55550 - DNA, 176 bp, Homo sapiens; identical to SEQ ID NO: 34890
  misc_feature 1..176: note = chr13:33590482-33590658
  misc_feature 1..176: note = hyper
  source 1..176: mol_type = genomic DNA

SEQ ID NO: 55551 - DNA, 234 bp, Homo sapiens
  misc_feature 1..234: note = chr13:33591066-33591300
  misc_feature 1..234: note = hyper
  source 1..234: mol_type = genomic DNA
cgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaaccccta

SEQ ID NO: 55552 - DNA, 22 bp, Homo sapiens
  misc_feature 1..22: note = chr13:33591419-33591441
  misc_feature 1..22: note = hyper
  source 1..22: mol_type = genomic DNA
agggccacgcaggggagacaga

SEQ ID NO: 55553 - DNA, 29 bp, Homo sapiens
  misc_feature 1..29: note = chr13:33924637-33924666
  misc_feature 1..29: note = hyper
  source 1..29: mol_type = genomic DNA
cggacgcggcactcccgccggggtcccgg

SEQ ID NO: 55554 - DNA, 41 bp, Homo sapiens; identical to SEQ ID NO: 34893
  misc_feature 1..41: note = chr13:35517132-35517173
  misc_feature 1..41: note = hyper
  source 1..41: mol_type = genomic DNA

SEQ ID NO: 55555 - DNA, 139 bp, Homo sapiens
  misc_feature 1..139: note = chr13:36704800-36704939
  misc_feature 1..139: note = hyper
  source 1..139: mol_type = genomic DNA
cacacatcactggcccgggcacacggaaaagcacacacacaataagaggccgggcccggccactccttccttggttcccgctccgcagccagttctgacaatgacaagcacctctcccagctcctccgccctggctctc

SEQ ID NO: 55556 - DNA, 391 bp, Homo sapiens
  misc_feature 1..391: note = chr13:36705055-36705446
  misc_feature 1..391: note = hyper
  source 1..391: mol_type = genomic DNA
gcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctc

SEQ ID NO: 55557 - skipped

SEQ ID NO: 55558 - DNA, 77 bp, Homo sapiens
  misc_feature 1..77: note = chr13:36705489-36705566
  misc_feature 1..77: note = hyper
  source 1..77: mol_type = genomic DNA
cagcctctctctccagaggagggcggcggcggcggcggcggcgggcgcgctcccttttcttgtctcactcgctcaca

SEQ ID NO: 55559 - DNA, 15 bp, Homo sapiens
  misc_feature 1..15: note = chr13:36705621-36705636
  misc_feature 1..15: note = hyper
  source 1..15: mol_type = genomic DNA
cgcccttcttggcag

SEQ ID NO: 55560 - DNA, 91 bp, Homo sapiens; identical to SEQ ID NO: 34897
  misc_feature 1..91: note = chr13:36729246-36729337
  misc_feature 1..91: note = hyper
  source 1..91: mol_type = genomic DNA

SEQ ID NO: 55561 - DNA, 345 bp, Homo sapiens; identical to SEQ ID NO: 34898
  misc_feature 1..345: note = chr13:36919879-36920224
  misc_feature 1..345: note = hyper
  source 1..345: mol_type = genomic DNA

SEQ ID NO: 55562 - DNA, 51 bp, Homo sapiens
  misc_feature 1..51: note = chr13:36920266-36920317
  misc_feature 1..51: note = hyper
  source 1..51: mol_type = genomic DNA
cgcccgctcagcctcccagccgagtccgcggggcctggggcgcccaccccg

SEQ ID NO: 55563 - DNA, 164 bp, Homo sapiens
  misc_feature 1..164: note = chr13:36920464-36920628
  misc_feature 1..164: note = hyper
  source 1..164: mol_type = genomic DNA
cgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccg

SEQ ID NO: 55564 - DNA, 336 bp, Homo sapiens
  misc_feature 1..336: note = chr13:36920785-36921121
  misc_feature 1..336: note = hyper
  source 1..336: mol_type = genomic DNA
ggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtctt

SEQ ID NO: 55565 - DNA, 108 bp, Homo sapiens; identical to SEQ ID NO: 4013
  misc_feature 1..108: note = chr13:37005473-37005581
  misc_feature 1..108: note = hyper
  source 1..108: mol_type = genomic DNA

SEQ ID NO: 55566 - DNA, 109 bp, Homo sapiens
  misc_feature 1..109: note = chr13:37006762-37006871
  misc_feature 1..109: note = hyper
  source 1..109: mol_type = genomic DNA
agaccggctttcccgcaatcatgtaccctggatcttttattgggggctggggagaagagtatctcagctgggaaggaccggggctcccagatttcgtcttccaggtaac

SEQ ID NO: 55567 - DNA, 456 bp, Homo sapiens
  misc_feature 1..456: note = chr13:37248523-37248979
  misc_feature 1..456: note = hyper
  source 1..456: mol_type = genomic DNA
gtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggc

SEQ ID NO: 55568 - DNA, 15 bp, Homo sapiens
  misc_feature 1..15: note = chr13:37249039-37249054
  misc_feature 1..15: note = hyper
  source 1..15: mol_type = genomic DNA
cgggtctgatgagac

SEQ ID NO: 55569 - DNA, 18 bp, Homo sapiens
  misc_feature 1..18: note = chr13:38443600-38443618
  misc_feature 1..18: note = hyper
  source 1..18: mol_type = genomic DNA
ccccgcagggatgtccgc

SEQ ID NO: 55570 - DNA, 87 bp, Homo sapiens; identical to SEQ ID NO: 34910
  misc_feature 1..87: note = chr13:39260356-39260443
  misc_feature 1..87: note = hyper
  source 1..87: mol_type = genomic DNA

SEQ ID NO: 55571 - DNA, 300 bp, Homo sapiens; identical to SEQ ID NO: 34911
  misc_feature 1..300: note = chr13:39261007-39261307
  misc_feature 1..300: note = hyper
  source 1..300: mol_type = genomic DNA

SEQ ID NO: 55572 - DNA, 94 bp, Homo sapiens; identical to SEQ ID NO: 34912
  misc_feature 1..94: note = chr13:39261689-39261783
  misc_feature 1..94: note = hyper
  source 1..94: mol_type = genomic DNA

SEQ ID NO: 55573 - DNA, 102 bp, Homo sapiens; identical to SEQ ID NO: 34913
  misc_feature 1..102: note = chr13:39261928-39262030
  misc_feature 1..102: note = hyper
  source 1..102: mol_type = genomic DNA

SEQ ID NO: 55574 - DNA, 112 bp, Homo sapiens; identical to SEQ ID NO: 11605
  misc_feature 1..112: note = chr13:39262129-39262241
  misc_feature 1..112: note = hyper
  source 1..112: mol_type = genomic DNA

SEQ ID NO: 55575 - DNA, 95 bp, Homo sapiens; identical to SEQ ID NO: 34915
  misc_feature 1..95: note = chr13:42031220-42031315
  misc_feature 1..95: note = hyper
  source 1..95: mol_type = genomic DNA

SEQ ID NO: 55576 - DNA, 69 bp, Homo sapiens; identical to SEQ ID NO: 34916
  misc_feature 1..69: note = chr13:42032580-42032649
  misc_feature 1..69: note = hyper
  source 1..69: mol_type = genomic DNA

SEQ ID NO: 55577 - DNA, 188 bp, Homo sapiens; identical to SEQ ID NO: 21654
  misc_feature 1..188: note = chr13:43566059-43566247
  misc_feature 1..188: note = hyper
  source 1..188: mol_type = genomic DNA

SEQ ID NO: 55578 - DNA, 137 bp, Homo sapiens; identical to SEQ ID NO: 34918
  misc_feature 1..137: note = chr13:44359843-44359980
  misc_feature 1..137: note = hyper
  source 1..137: mol_type = genomic DNA

SEQ ID NO: 55579 - DNA, 236 bp, Homo sapiens; identical to SEQ ID NO: 34919
  misc_feature 1..236: note = chr13:44360043-44360279
  misc_feature 1..236: note = hyper
  source 1..236: mol_type = genomic DNA

SEQ ID NO: 55580 - DNA, 327 bp, Homo sapiens; identical to SEQ ID NO: 34920
  misc_feature 1..327: note = chr13:44360467-44360794
  misc_feature 1..327: note = hyper
  source 1..327: mol_type = genomic DNA

SEQ ID NO: 55581 - DNA, 99 bp, Homo sapiens; identical to SEQ ID NO: 34921
  misc_feature 1..99: note = chr13:44360995-44361094
  misc_feature 1..99: note = hyper
  source 1..99: mol_type = genomic DNA

SEQ ID NO: 55582 - skipped

SEQ ID NO: 55583 - DNA, 320 bp, Homo sapiens
  misc_feature 1..320: note = chr13:44948197-44948517
  misc_feature 1..320: note = hyper
  source 1..320: mol_type = genomic DNA
aagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctc

SEQ ID NO: 55584 - DNA, 119 bp, Homo sapiens
  misc_feature 1..119: note = chr13:45885757-45885876
  misc_feature 1..119: note = hyper
  source 1..119: mol_type = genomic DNA
ctgccgagcagcatccgcgcggagcgagctgcggtcctcgggaccccgcagcaggagccacgagcccgccccggcgtccgagccctgcaggcgaggccaggcttggcgcggagggacct

SEQ ID NO: 55585 - DNA, 59 bp, Homo sapiens
  misc_feature 1..59: note = chr13:45885905-45885964
  misc_feature 1..59: note = hyper
  source 1..59: mol_type = genomic DNA
agttcctgctgccagagccgggcctcctctgctctccgcagcctcgcagggagggcgca

SEQ ID NO: 55586 - DNA, 146 bp, Homo sapiens; identical to SEQ ID NO: 34924
  misc_feature 1..146: note = chr13:46189788-46189934
  misc_feature 1..146: note = hyper
  source 1..146: mol_type = genomic DNA

SEQ ID NO: 55587 - DNA, 33 bp, Homo sapiens; identical to SEQ ID NO: 34925
  misc_feature 1..33: note = chr13:46425360-46425393
  misc_feature 1..33: note = hyper
  source 1..33: mol_type = genomic DNA

SEQ ID NO: 55588 - DNA, 410 bp, Homo sapiens
  misc_feature 1..410: note = chr13:46961084-46961494
  misc_feature 1..410: note = hyper
  source 1..410: mol_type = genomic DNA
tctccaaggggtccccgacactgctctgagcgaccctaagatacctgggtgtctctgctgggcacaaacctctctggcgccacttccaccatccaacctctcccgcggccctcccttccctttctccaaccaccctctccaccccgcgccgctcccatctcgcccccggccccgccagcctcacccagccaaacccgagcggtggaacgctgcgctgggtaaacgccgcgcgtcgggtcctccctcgcgcggctccgggcagcgttccgtggccaccgcgctcccggtaacagcagaaaggggagggaggagagctaccgaggaggggacagcgacgccccgacgccgccacgccccccgcctcccacacgggggccaccgtagctctctagaagctcctcagggaagca

SEQ ID NO: 55589 - DNA, 99 bp, Homo sapiens
  misc_feature 1..99: note = chr13:46961533-46961632
  misc_feature 1..99: note = hyper
  source 1..99: mol_type = genomic DNA
atggaagaaactctggagatgcgcgctcctacaccggtgccgcggcgcccgggcccagcaccacgcacctatgcgcgcctctgccggtcctcctagaaa

SEQ ID NO: 55590 - DNA, 236 bp, Homo sapiens; identical to SEQ ID NO: 34928
  misc_feature 1..236: note = chr13:50070422-50070658
  misc_feature 1..236: note = hyper
  source 1..236: mol_type = genomic DNA

SEQ ID NO: 55591 - DNA, 15 bp, Homo sapiens
  misc_feature 1..15: note = chr13:50070684-50070699
  misc_feature 1..15: note = hyper
  source 1..15: mol_type = genomic DNA
cgtctccccttctcc

SEQ ID NO: 55592 - DNA, 108 bp, Homo sapiens; identical to SEQ ID NO: 34930
  misc_feature 1..108: note = chr13:50704569-50704677
  misc_feature 1..108: note = hyper
  source 1..108: mol_type = genomic DNA

SEQ ID NO: 55593 - DNA, 30 bp, Homo sapiens; identical to SEQ ID NO: 34931
  misc_feature 1..30: note = chr13:50705047-50705077
  misc_feature 1..30: note = hyper
  source 1..30: mol_type = genomic DNA

SEQ ID NO: 55594 - DNA, 30 bp, Homo sapiens; identical to SEQ ID NO: 34932
  misc_feature 1..30: note = chr13:51086861-51086891
  misc_feature 1..30: note = hyper
  source 1..30: mol_type = genomic DNA

SEQ ID NO: 55595 - DNA, 68 bp, Homo sapiens; identical to SEQ ID NO: 34933
  misc_feature 1..68: note = chr13:51797123-51797191
  misc_feature 1..68: note = hyper
  source 1..68: mol_type = genomic DNA

SEQ ID NO: 55596 - DNA, 63 bp, Homo sapiens; identical to SEQ ID NO: 34934
  misc_feature 1..63: note = chr13:52979747-52979810
  misc_feature 1..63: note = hyper
  source 1..63: mol_type = genomic DNA

SEQ ID NO: 55597 - DNA, 169 bp, Homo sapiens; identical to SEQ ID NO: 34935
  misc_feature 1..169: note = chr13:52980066-52980235
  misc_feature 1..169: note = hyper
  source 1..169: mol_type = genomic DNA

SEQ ID NO: 55598 - DNA, 105 bp, Homo sapiens; identical to SEQ ID NO: 34936
  misc_feature 1..105: note = chr13:53174056-53174161
  misc_feature 1..105: note = hyper
  source 1..105: mol_type = genomic DNA

SEQ ID NO: 55599 - DNA, 14 bp, Homo sapiens
  misc_feature 1..14: note = chr13:53174673-53174687
  misc_feature 1..14: note = hyper
  source 1..14: mol_type = genomic DNA
gggtgctttcctac

SEQ ID NO: 55600 - DNA, 131 bp, Homo sapiens
  misc_feature 1..131: note = chr13:53312860-53312991
  misc_feature 1..131: note = hyper
  source 1..131: mol_type = genomic DNA
tgccttccccacggtcgcgccactgcttagtgggagatgagccgagaacggcctttctcggaccgtccactacattctcccctactctacgcttcaatcttctcccgtgaaaccttcacttgcttttctac

SEQ ID NO: 55601 - DNA, 30 bp, Homo sapiens
  misc_feature 1..30: note = chr13:53313920-53313950
  misc_feature 1..30: note = hyper
  source 1..30: mol_type = genomic DNA
aacgccgcgcgcacacacggtgcacggtcc

SEQ ID NO: 55602 - DNA, 245 bp, Homo sapiens
  misc_feature 1..245: note = chr13:53419775-53420020
  misc_feature 1..245: note = hyper
  source 1..245: mol_type = genomic DNA
gggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagc

SEQ ID NO: 55603 - DNA, 22 bp, Homo sapiens
  misc_feature 1..22: note = chr13:53421826-53421848
  misc_feature 1..22: note = hyper
  source 1..22: mol_type = genomic DNA
cgccctgcgggaaggccgggct

SEQ ID NO: 55604 - DNA, 138 bp, Homo sapiens; identical to SEQ ID NO: 34944
  misc_feature 1..138: note = chr13:53422642-53422780
  misc_feature 1..138: note = hyper
  source 1..138: mol_type = genomic DNA

SEQ ID NO: 55605 - DNA, 27 bp, Homo sapiens
  misc_feature 1..27: note = chr13:53422781-53422808
  misc_feature 1..27: note = hyper
  source 1..27: mol_type = genomic DNA
cctcgcgccgcctttgcctttatagcc

SEQ ID NO: 55606 - DNA, 76 bp, Homo sapiens; identical to SEQ ID NO: 34946
  misc_feature 1..76: note = chr13:53422809-53422885
  misc_feature 1..76: note = hyper
  source 1..76: mol_type = genomic DNA

SEQ ID NO: 55607 - DNA, 30 bp, Homo sapiens; identical to SEQ ID NO: 11621
  misc_feature 1..30: note = chr13:53423168-53423198
  misc_feature 1..30: note = hyper
  source 1..30: mol_type = genomic DNA

SEQ ID NO: 55608 - DNA, 73 bp, Homo sapiens
  misc_feature 1..73: note = chr13:53423765-53423838
  misc_feature 1..73: note = hyper
  source 1..73: mol_type = genomic DNA
ctaaacggtgatgggcgctgaattccacacaatacccggctcgtattaaagtgcatttagagaactttttcct

SEQ ID NO: 55609 - DNA, 128 bp, Homo sapiens
  misc_feature 1..128: note = chr13:53423978-53424106
  misc_feature 1..128: note = hyper
  source 1..128: mol_type = genomic DNA
accatctgcttaggaaagtgtggagcttcggcactgccaaaatctgggctgggcggatcctggggctggccgggcgctgcgctgccccacagatagccccctcccatccctgacggccagggagatgg

SEQ ID NO: 55610 - DNA, 105 bp, Homo sapiens; identical to SEQ ID NO: 34949
  misc_feature 1..105: note = chr13:53424765-53424870
  misc_feature 1..105: note = hyper
  source 1..105: mol_type = genomic DNA

SEQ ID NO: 55611 - DNA, 196 bp, Homo sapiens; identical to SEQ ID NO: 34950
  misc_feature 1..196: note = chr13:53425241-53425437
  misc_feature 1..196: note = hyper
  source 1..196: mol_type = genomic DNA

SEQ ID NO: 55612 - DNA, 146 bp, Homo sapiens; identical to SEQ ID NO: 34951
  misc_feature 1..146: note = chr13:53425699-53425845
  misc_feature 1..146: note = hyper
  source 1..146: mol_type = genomic DNA

SEQ ID NO: 55613 - DNA, 12 bp, Homo sapiens
  misc_feature 1..12: note = chr13:58203590-58203602
  misc_feature 1..12: note = hyper
  source 1..12: mol_type = genomic DNA
gcatgttcgtac

SEQ ID NO: 55614 - DNA, 207 bp, Homo sapiens; identical to SEQ ID NO: 21668
  misc_feature 1..207: note = chr13:58203644-58203851
  misc_feature 1..207: note = hyper
  source 1..207: mol_type = genomic DNA

SEQ ID NO: 55615 - DNA, 247 bp, Homo sapiens
  misc_feature 1..247: note = chr13:58204103-58204350
  misc_feature 1..247: note = hyper
  source 1..247: mol_type = genomic DNA
cctggccccgcccccgccatcctcttctccgcctcccattggacgcgggccgagaaggcagggccttgctcctcgctcggattggctgacagggaatcagtatcaatgtttaagcggcggcgtgaggtgaatagagtcagtcagcaagagacgctggggagagagcagggatcgcgagcccggcggatgcggcagcggcggaaggcggctggggagacgctactccaactgttgaattgaattttca

SEQ ID NO: 55616 - DNA, 28 bp, Homo sapiens
  misc_feature 1..28: note = chr13:58204393-58204421
  misc_feature 1..28: note = hyper
  source 1..28: mol_type = genomic DNA
ttgctttgaaatccgcatatctttctca

SEQ ID NO: 55617 - DNA, 63 bp, Homo sapiens; identical to SEQ ID NO: 34953
  misc_feature 1..63: note = chr13:58204937-58205000
  misc_feature 1..63: note = hyper
  source 1..63: mol_type = genomic DNA

SEQ ID NO: 55618 - DNA, 202 bp, Homo sapiens
  misc_feature 1..202: note = chr13:58205840-58206042
  misc_feature 1..202: note = hyper
  source 1..202: mol_type = genomic DNA
gaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcag

SEQ ID NO: 55619 - DNA, 29 bp, Homo sapiens
  misc_feature 1..29: note = chr13:58206983-58207012
  misc_feature 1..29: note = hyper
  source 1..29: mol_type = genomic DNA
tgccagctgtccctcgaggtgttcgccaa

SEQ ID NO: 55620 - DNA, 105 bp, Homo sapiens
  misc_feature 1..105: note = chr13:58208020-58208125
  misc_feature 1..105: note = hyper
  source 1..105: mol_type = genomic DNA
gggctctcctcccctcaactccaccaagtcgttcgcgatcaagattctagacgagaacgacaacccgcctcggttcaccaaagggctctacgtgcttcaggtgca

SEQ ID NO: 55621 - DNA, 161 bp, Homo sapiens; identical to SEQ ID NO: 21671
  misc_feature 1..161: note = chr13:58208334-58208495
  misc_feature 1..161: note = hyper
  source 1..161: mol_type = genomic DNA

SEQ ID NO: 55622 - DNA, 17 bp, Homo sapiens
  misc_feature 1..17: note = chr13:58208926-58208943
  misc_feature 1..17: note = hyper
  source 1..17: mol_type = genomic DNA
cccgcagctgggtgggg

SEQ ID NO: 55623 - DNA, 69 bp, Homo sapiens; identical to SEQ ID NO: 34960
  misc_feature 1..69: note = chr13:67804269-67804338
  misc_feature 1..69: note = hyper
  source 1..69: mol_type = genomic DNA

SEQ ID NO: 55624 - DNA, 100 bp, Homo sapiens; identical to SEQ ID NO: 34961
  misc_feature 1..100: note = chr13:67804644-67804744
  misc_feature 1..100: note = hyper
  source 1..100: mol_type = genomic DNA

SEQ ID NO: 55625 - DNA, 23 bp, Homo sapiens
  misc_feature 1..23: note = chr13:67804745-67804768
  misc_feature 1..23: note = hyper
  source 1..23: mol_type = genomic DNA
cgctggcgctccccaggcccggg

SEQ ID NO: 55626 - DNA, 328 bp, Homo sapiens
  misc_feature 1..328: note = chr13:67804863-67805191
  misc_feature 1..328: note = hyper
  source 1..328: mol_type = genomic DNA
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagacc

SEQ ID NO: 55627 - DNA, 47 bp, Homo sapiens
  misc_feature 1..47: note = chr13:70681579-70681626
  misc_feature 1..47: note = hyper
  source 1..47: mol_type = genomic DNA
agaggacggggaggacgatgaagaggaagaggaggaaggcttcttcc

SEQ ID NO: 55628 - DNA, 30 bp, Homo sapiens; identical to SEQ ID NO: 34966
  misc_feature 1..30: note = chr13:72438533-72438563
  misc_feature 1..30: note = hyper
  source 1..30: mol_type = genomic DNA

SEQ ID NO: 55629 - DNA, 124 bp, Homo sapiens; identical to SEQ ID NO: 34967
  misc_feature 1..124: note = chr13:72438769-72438893
  misc_feature 1..124: note = hyper
  source 1..124: mol_type = genomic DNA

SEQ ID NO: 55630 - DNA, 65 bp, Homo sapiens; identical to SEQ ID NO: 34968
  misc_feature 1..65: note = chr13:72440007-72440072
  misc_feature 1..65: note = hyper
  source 1..65: mol_type = genomic DNA

SEQ ID NO: 55631 - DNA, 30 bp, Homo sapiens; identical to SEQ ID NO: 34969
  misc_feature 1..30: note = chr13:72440711-72440741
  misc_feature 1..30: note = hyper
  source 1..30: mol_type = genomic DNA

SEQ ID NO: 55632 - DNA, 91 bp, Homo sapiens; identical to SEQ ID NO: 34970
  misc_feature 1..91: note = chr13:74707261-74707352
  misc_feature 1..91: note = hyper
  source 1..91: mol_type = genomic DNA

SEQ ID NO: 55633 - DNA, 43 bp, Homo sapiens; identical to SEQ ID NO: 34971
  misc_feature 1..43: note = chr13:74707625-74707668
  misc_feature 1..43: note = hyper
  source 1..43: mol_type = genomic DNA

SEQ ID NO: 55634 - DNA, 165 bp, Homo sapiens; identical to SEQ ID NO: 34972
  misc_feature 1..165: note = chr13:75149921-75150086
  misc_feature 1..165: note = hyper
  source 1..165: mol_type = genomic DNA

SEQ ID NO: 55635 - DNA, 175 bp, Homo sapiens
  misc_feature 1..175: note = chr13:78492991-78493166
  misc_feature 1..175: note = hyper
  source 1..175: mol_type = genomic DNA
taatatgcagtggggcggggcgttctggaaggggtgtgccagggagggaatgatgggggtcccaggcaaagctccgaactctttcacgtaacgggaggaatacagacacgtcttagttaagcgtgcgtgggaaccgcggaattaaggcacctagaggccaagggcttgtgtcaag

SEQ ID NO: 55636 - DNA, 259 bp, Homo sapiens
  misc_feature 1..259: note = chr13:78493196-78493455
  misc_feature 1..259: note = hyper
  source 1..259: mol_type = genomic DNA
ataccccgcgattgaactcgaaagactcctcccggcggatgaaagccgctactccctggctggctgagctacagctcccgcagcgcgcccaggagtgcgccggagattcggaaacccgcagagacttctcaagtcagcaggaacttggaaaccgctgttccctccaaacggcttcaaacactcgcgctccttcctttacccaacctaattttaatttgccctctctataggcttaatttttatttttttaaaatcccaa

SEQ ID NO: 55637 - DNA, 163 bp, Homo sapiens
  misc_feature 1..163: note = chr13:78493809-78493972
  misc_feature 1..163: note = hyper
  source 1..163: mol_type = genomic DNA
ctttccccttgggcgatgcctggacagcatcagtagtagttgcccgagggaggggggcagtcctcgtccggggacaggtcccaaaaggctgtttatttgttagagttctacgctcttcaaatgaacccaaatcaagggcaagttatcacgcaccatgtgacac

SEQ ID NO: 55638 - DNA, 47 bp, Homo sapiens; identical to SEQ ID NO: 34974
  misc_feature 1..47: note = chr13:79160995-79161042
  misc_feature 1..47: note = hyper
  source 1..47: mol_type = genomic DNA

SEQ ID NO: 55639 - DNA, 234 bp, Homo sapiens
  misc_feature 1..234: note = chr13:79170884-79171118
  misc_feature 1..234: note = hyper
  source 1..234: mol_type = genomic DNA
agctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaag

SEQ ID NO: 55640 - DNA, 175 bp, Homo sapiens
  misc_feature 1..175: note = chr13:79175595-79175770
  misc_feature 1..175: note = hyper
  source 1..175: mol_type = genomic DNA
ttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcag

SEQ ID NO: 55641 - DNA, 210 bp, Homo sapiens
  misc_feature 1..210: note = chr13:79176783-79176993
  misc_feature 1..210: note = hyper
  source 1..210: mol_type = genomic DNA
gcgaagggcaaacacaaagcaaccaaaataacaacgggtttgggggcagtggagagcgggaaagacggagagggggcacattgacgaccagggagggggcagacgagaagggatgggagcgtggagagggggacagaagtagggagaaagggggacacaagaacacattccggaaacgggcgtgggagacgaaaaagagggaaaagaaga

SEQ ID NO: 55642 - DNA, 80 bp, Homo sapiens
  misc_feature 1..80: note = chr13:79177998-79178078
  misc_feature 1..80: note = hyper
  source 1..80: mol_type = genomic DNA
tcagaaggtccagctattgtctaagggtgggcaccttttagaataaaaaagacgagatgcgcgcacgcccctctatgtgt

SEQ ID NO: 55643 - DNA, 221 bp, Homo sapiens; identical to SEQ ID NO: 34984
  misc_feature 1..221: note = chr13:79182709-79182930
  misc_feature 1..221: note = hyper
  source 1..221: mol_type = genomic DNA

SEQ ID NO: 55644 - DNA, 226 bp, Homo sapiens
  misc_feature 1..226: note = chr13:79183180-79183406
  misc_feature 1..226: note = hyper
  source 1..226: mol_type = genomic DNA
aatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaa

SEQ ID NO: 55645 - DNA, 21 bp, Homo sapiens
  misc_feature 1..21: note = chr13:84455560-84455581
  misc_feature 1..21: note = hyper
  source 1..21: mol_type = genomic DNA
tcttctctttgcaaacgtccc

SEQ ID NO: 55646 - DNA, 41 bp, Homo sapiens
  misc_feature 1..41: note = chr13:84455715-84455756
  misc_feature 1..41: note = hyper
  source 1..41: mol_type = genomic DNA
tcaagttcatttagtgctccaatgtccgaagccaggaaagg

SEQ ID NO: 55647 - DNA, 274 bp, Homo sapiens; identical to SEQ ID NO: 34987
  misc_feature 1..274: note = chr13:84456111-84456385
  misc_feature 1..274: note = hyper
  source 1..274: mol_type = genomic DNA

SEQ ID NO: 55648 - DNA, 199 bp, Homo sapiens
  misc_feature 1..199: note = chr13:88323380-88323579
  misc_feature 1..199: note = hyper
  source 1..199: mol_type = genomic DNA
caggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgcc

SEQ ID NO: 55649 - DNA, 275 bp, Homo sapiens
  misc_feature 1..275: note = chr13:88324241-88324516
  misc_feature 1..275: note = hyper
  source 1..275: mol_type = genomic DNA
atgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgc

SEQ ID NO: 55650 - DNA, 79 bp, Homo sapiens; identical to SEQ ID NO: 34991
  misc_feature 1..79: note = chr13:88325198-88325277
  misc_feature 1..79: note = hyper
  source 1..79: mol_type = genomic DNA

SEQ ID NO: 55651 - DNA, 200 bp, Homo sapiens
  misc_feature 1..200: note = chr13:88325619-88325819
  misc_feature 1..200: note = hyper
  source 1..200: mol_type = genomic DNA
tgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactg

SEQ ID NO: 55652 - DNA, 38 bp, Homo sapiens
  misc_feature 1..38: note = chr13:88326500-88326538
  misc_feature 1..38: note = hyper
  source 1..38: mol_type = genomic DNA
cttaatcagcccaggcgtcctttccctgagattaaaaa

SEQ ID NO: 55653 - DNA, 110 bp, Homo sapiens
  misc_feature 1..110: note = chr13:88327014-88327124
  misc_feature 1..110: note = hyper
  source 1..110: mol_type = genomic DNA
gatttaagagcttcttggggctcctttgatgcattatattacagcctttttgcctctgaaaagtatcctttaggttcccaccgtggcatttctagcgatggtttaaaata

SEQ ID NO: 55654 - DNA, 30 bp, Homo sapiens; identical to SEQ ID NO: 34995
  misc_feature 1..30: note = chr13:92050679-92050709
  misc_feature 1..30: note = hyper
  source 1..30: mol_type = genomic DNA

SEQ ID NO: 55655 - DNA, 143 bp, Homo sapiens
  misc_feature 1..143: note = chr13:92050996-92051139
  misc_feature 1..143: note = hyper
  source 1..143: mol_type = genomic DNA
cttgcgggctccctgcggctccactagttttcttcgccccgcccagccgcccactcttctcggctagggaagaagaccagagggtgctcagctggaaaactctggtgtctcagcttagggcctcctccgggaagagctaactg

SEQ ID NO: 55656 - DNA, 206 bp, Homo sapiens; identical to SEQ ID NO: 21690
  misc_feature 1..206: note = chr13:92051168-92051374
  misc_feature 1..206: note = hyper
  source 1..206: mol_type = genomic DNA

SEQ ID NO: 55657 - skipped

SEQ ID NO: 55658 - DNA, 86 bp, Homo sapiens; identical to SEQ ID NO: 21692
  misc_feature 1..86: note = chr13:93879375-93879461
  misc_feature 1..86: note = hyper
  source 1..86: mol_type = genomic DNA

SEQ ID NO: 55659 - DNA, 47 bp, Homo sapiens
  misc_feature 1..47: note = chr13:93880042-93880089
  misc_feature 1..47: note = hyper
  source 1..47: mol_type = genomic DNA
gcgggggaaggtgtgcgtctccgccgcctcattgtgtgcacacgcgg

SEQ ID NO: 55660 - DNA, 170 bp, Homo sapiens
  misc_feature 1..170: note = chr13:93880856-93881026
  misc_feature 1..170: note = hyper
  source 1..170: mol_type = genomic DNA
ctctgtgaatgaaacgtgtcggggagagataatcctttggctgctaaagaacagaactgagagaggccgagggaggccaggagatgctgcgagggcgcgggctgctcaaaccgggcagctgaagtccttagtgacctcagatcgtcaagtcaaaacgctgaatttccacc

SEQ ID NO: 55661 - DNA, 65 bp, Homo sapiens; identical to SEQ ID NO: 35004
  misc_feature 1..65: note = chr13:95354293-95354358
  misc_feature 1..65: note = hyper
  source 1..65: mol_type = genomic DNA

SEQ ID NO: 55662 - DNA, 46 bp, Homo sapiens; identical to SEQ ID NO: 35005
  misc_feature 1..46: note = chr13:95355963-95356009
  misc_feature 1..46: note = hyper
  source 1..46: mol_type = genomic DNA

SEQ ID NO: 55663 - DNA, 285 bp, Homo sapiens
  misc_feature 1..285: note = chr13:95357026-95357311
  misc_feature 1..285: note = hyper
  source 1..285: mol_type = genomic DNA
tttcctccagtcaagcgtgagtgatggggcggccgcgcaagggcaacggagtccagcggacaaagcttgcagagaggggcagtggcccggaggcaagggtggcggtggggggggtggggggatgggtcacaaaagtagagcaactgagcttgctgcctagcggtgccacttccctgctctgcgctaaggctatcgtcgaaggcccagagacaccttgaccctggaaacccaatccagcacgtcctgcctccccacaaatatccctcaccccaaatcgctgtgcgt

SEQ ID NO: 55664 - DNA, 233 bp, Homo sapiens
  misc_feature 1..233: note = chr13:95357341-95357574
  misc_feature 1..233: note = hyper
  source 1..233: mol_type = genomic DNA
ttggatttattcagatagaactcttcggaagtttttcagatttttcaatttcaagaatttgcatgttttaagtgaagctgaaaccgcgaaggctcaggttacactttaaaatatgcaaggcttccgtgcggccccgacatttggtaaggctcaattgcttaagaaaaaagaaaaaaaaaagaacattgctttgagaatttggggtgccccccccccacttttgtcacaattca

SEQ ID NO: 55665 - DNA, 65 bp, Homo sapiens
  misc_feature 1..65: note = chr13:95359682-95359747
  misc_feature 1..65: note = hyper
  source 1..65: mol_type = genomic DNA
cgcggaccctcgaggcggacgagttgcgggaacttcgcttgcctggaggacacggcggcccaggc

SEQ ID NO: 55666 - DNA, 58 bp, Homo sapiens
  misc_feature 1..58: note = chr13:95359803-95359861
  misc_feature 1..58: note = hyper
  source 1..58: mol_type = genomic DNA
ctgctccggggagagtggaatcttctctccatcttctgcgccccgagcctggggtgag

SEQ ID NO: 55667 - DNA, 91 bp, Homo sapiens; identical to SEQ ID NO: 21696
  misc_feature 1..91: note = chr13:95360231-95360322
  misc_feature 1..91: note = hyper
  source 1..91: mol_type = genomic DNA

SEQ ID NO: 55668 - DNA, 42 bp, Homo sapiens
  misc_feature 1..42: note = chr13:95360371-95360413
  misc_feature 1..42: note = hyper
  source 1..42: mol_type = genomic DNA
gccctcttgccccggagccgctccccccgctccaacccctta

SEQ ID NO: 55669 - DNA, 201 bp, Homo sapiens; identical to SEQ ID NO: 21698
  misc_feature 1..201: note = chr13:95363009-95363210
  misc_feature 1..201: note = hyper
  source 1..201: mol_type = genomic DNA

SEQ ID NO: 55670 - DNA, 23 bp, Homo sapiens
  misc_feature 1..23: note = chr13:95363429-95363452
  misc_feature 1..23: note = hyper
  source 1..23: mol_type = genomic DNA
gtacacgtgtgcacaccggtcct

SEQ ID NO: 55671 - DNA, 303 bp, Homo sapiens
  misc_feature 1..303: note = chr13:95363493-95363796
  misc_feature 1..303: note = hyper
  source 1..303: mol_type = genomic DNA
cgcggggtaggggtccagctggggcttgcccatgcccggcagcaggatgtaggcgagcggcggctgcagcccggggctgggccacgcgctgcagttgcacgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagta

SEQ ID NO: 55672 - DNA, 575 bp, Homo sapiens
  misc_feature 1..575: note = chr13:95364800-95365375
  misc_feature 1..575: note = hyper
  source 1..575: mol_type = genomic DNA
ggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgca

SEQ ID NO: 55673 - DNA, 101 bp, Homo sapiens; identical to SEQ ID NO: 35014
  misc_feature 1..101: note = chr13:95365624-95365725
  misc_feature 1..101: note = hyper
  source 1..101: mol_type = genomic DNA

SEQ ID NO: 55674 - DNA, 218 bp, Homo sapiens; identical to SEQ ID NO: 21702
  misc_feature 1..218: note = chr13:95619803-95620021
  misc_feature 1..218: note = hyper
  source 1..218: mol_type = genomic DNA

SEQ ID NO: 55675 - DNA, 228 bp, Homo sapiens; identical to SEQ ID NO: 21703
  misc_feature 1..228: note = chr13:95620078-95620306
  misc_feature 1..228: note = hyper
  source 1..228: mol_type = genomic DNA

SEQ ID NO: 55676 - DNA, 340 bp, Homo sapiens; identical to SEQ ID NO: 21704
  misc_feature 1..340: note = chr13:95620307-95620647
  misc_feature 1..340: note = hyper
  source 1..340: mol_type = genomic DNA

SEQ ID NO: 55677 - DNA, 63 bp, Homo sapiens
  misc_feature 1..63: note = chr13:95621011-95621074
  misc_feature 1..63: note = hyper
  source 1..63: mol_type = genomic DNA
gaccccagatcttcaccctaggatttccatctcagcatttcacgttcccggggaaaaagggag

SEQ ID NO: 55678 - DNA, 205 bp, Homo sapiens; identical to SEQ ID NO: 35018
  misc_feature 1..205: note = chr13:95655055-95655260
  misc_feature 1..205: note = hyper
  source 1..205: mol_type = genomic DNA

SEQ ID NO: 55679 - DNA, 30 bp, Homo sapiens; identical to SEQ ID NO: 35019
  misc_feature 1..30: note = chr13:96056313-96056343
  misc_feature 1..30: note = hyper
  source 1..30: mol_type = genomic DNA

SEQ ID NO: 55680 - DNA, 83 bp, Homo sapiens; identical to SEQ ID NO: 21706
  misc_feature 1..83: note = chr13:96296473-96296556
  misc_feature 1..83: note = hyper
  source 1..83: mol_type = genomic DNA

SEQ ID NO: 55681 - DNA, 101 bp, Homo sapiens
  misc_feature 1..101: note = chr13:96297137-96297238
  misc_feature 1..101: note = hyper
  source 1..101: mol_type = genomic DNA
ccctcagcaagctaatttcccagaggagcttcaggtgaattatcttccaaaaagagatgcgttttaatcgcagaagtctgcagatgcgaaggaccttgaaa

SEQ ID NO: 55682 - DNA, 30 bp, Homo sapiens; identical to SEQ ID NO: 35024
  misc_feature 1..30: note = chr13:96742799-96742829
  misc_feature 1..30: note = hyper
  source 1..30: mol_type = genomic DNA

SEQ ID NO: 55683 - DNA, 57 bp, Homo sapiens; identical to SEQ ID NO: 35025
  misc_feature 1..57: note = chr13:96743056-96743113
  misc_feature 1..57: note = hyper
  source 1..57: mol_type = genomic DNA

SEQ ID NO: 55684 - DNA, 198 bp, Homo sapiens; identical to SEQ ID NO: 35026
  misc_feature 1..198: note = chr13:96743376-96743574
  misc_feature 1..198: note = hyper
  source 1..198: mol_type = genomic DNA

SEQ ID NO: 55685 - DNA, 324 bp, Homo sapiens; identical to SEQ ID NO: 35029
  misc_feature 1..324: note = chr13:99404616-99404940
  misc_feature 1..324: note = hyper
  source 1..324: mol_type = genomic DNA

SEQ ID NO: 55686 - DNA, 30 bp, Homo sapiens; identical to SEQ ID NO: 35032
  misc_feature 1..30: note = chr13:100609476-100609506
  misc_feature 1..30: note = hyper
  source 1..30: mol_type = genomic DNA

SEQ ID NO: 55687 - DNA, 327 bp, Homo sapiens; identical to SEQ ID NO: 35033
  misc_feature 1..327: note = chr13:100611882-100612209
  misc_feature 1..327: note = hyper
  source 1..327: mol_type = genomic DNA

SEQ ID NO: 55688 - DNA, 32 bp, Homo sapiens; identical to SEQ ID NO: 35034
  misc_feature 1..32: note = chr13:100620640-100620672
  misc_feature 1..32: note = hyper
  source 1..32: mol_type = genomic DNA

SEQ ID NO: 55689 - DNA, 30 bp, Homo sapiens; identical to SEQ ID NO: 35035
  misc_feature 1..30: note = chr13:100620880-100620910
  misc_feature 1..30: note = hyper
  source 1..30: mol_type = genomic DNA

SEQ ID NO: 55690 - DNA, 189 bp, Homo sapiens
  misc_feature 1..189: note = chr13:100621752-100621941
  misc_feature 1..189: note = hyper
  source 1..189: mol_type = genomic DNA
gtgaagagtgtgtcacggtgggcgagtgcgagtggtctccggggttccgaaagcgcattcctgtcttcccggaggggtcccttcccctcccggaaggcctgcctcgggcggcccaaatccggcagcaaatcccacgcccggtcctcggagcgcggagactgcgcggggcctacgacccggtgggaagag

SEQ ID NO: 55691 - DNA, 166 bp, Homo sapiens; identical to SEQ ID NO: 35037
  misc_feature 1..166: note = chr13:100622330-100622496
  misc_feature 1..166: note = hyper
  source 1..166: mol_type = genomic DNA

SEQ ID NO: 55692 - DNA, 201 bp, Homo sapiens; identical to SEQ ID NO: 35038
  misc_feature 1..201: note = chr13:100622959-100623160
  misc_feature 1..201: note = hyper
  source 1..201: mol_type = genomic DNA

SEQ ID NO: 55693 - DNA, 231 bp, Homo sapiens; identical to SEQ ID NO: 35039
  misc_feature 1..231: note = chr13:100623899-100624130
  misc_feature 1..231: note = hyper
  source 1..231: mol_type = genomic DNA

SEQ ID NO: 55694 - DNA, 102 bp, Homo sapiens; identical to SEQ ID NO: 35040
  misc_feature 1..102: note = chr13:100624131-100624233
  misc_feature 1..102: note = hyper
  source 1..102: mol_type = genomic DNA

SEQ ID NO: 55695 - DNA, 239 bp, Homo sapiens
  misc_feature 1..239: note = chr13:100624348-100624587
  misc_feature 1..239: note = hyper
  source 1..239: mol_type = genomic DNA
gggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctaggg

SEQ ID NO: 55696 - DNA, 30 bp, Homo sapiens; identical to SEQ ID NO: 35042
  misc_feature 1..30: note = chr13:100626366-100626396
  misc_feature 1..30: note = hyper
  source 1..30: mol_type = genomic DNA

SEQ ID NO: 55697 - DNA, 54 bp, Homo sapiens; identical to SEQ ID NO: 35044
  misc_feature 1..54: note = chr13:100631883-100631937
  misc_feature 1..54: note = hyper
  source 1..54: mol_type = genomic DNA

SEQ ID NO: 55698 - DNA, 245 bp, Homo sapiens; identical to SEQ ID NO: 35045
  misc_feature 1..245: note = chr13:100635085-100635330
  misc_feature 1..245: note = hyper
  source 1..245: mol_type = genomic DNA

SEQ ID NO: 55699 - skipped

SEQ ID NO: 55700 - DNA, 100 bp, Homo sapiens; identical to SEQ ID NO: 35048
  misc_feature 1..100: note = chr13:100636984-100637084
  misc_feature 1..100: note = hyper
  source 1..100: mol_type = genomic DNA

SEQ ID NO: 55701 - DNA, 26 bp, Homo sapiens
  misc_feature 1..26: note = chr13:100637364-100637390
  misc_feature 1..26: note = hyper
  source 1..26: mol_type = genomic DNA
taccaccgcggcggccgggaggaggg

SEQ ID NO: 55702 - DNA, 521 bp, Homo sapiens
  misc_feature 1..521: note = chr13:100637485-100638006
  misc_feature 1..521: note = hyper
  source 1..521: mol_type = genomic DNA
tgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcga

SEQ ID NO: 55703 - DNA, 30 bp, Homo sapiens; identical to SEQ ID NO: 35050
  misc_feature 1..30: note = chr13:100640440-100640470
  misc_feature 1..30: note = hyper
  source 1..30: mol_type = genomic DNA

SEQ ID NO: 55704 - DNA, 187 bp, Homo sapiens; identical to SEQ ID NO: 11697
  misc_feature 1..187: note = chr13:100640972-100641159
  misc_feature 1..187: note = hyper
  source 1..187: mol_type = genomic DNA

SEQ ID NO: 55705 - DNA, 213 bp, Homo sapiens
  misc_feature 1..213: note = chr13:100643842-100644055
  misc_feature 1..213: note = hyper
  source 1..213: mol_type = genomic DNA
gttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttccc

SEQ ID NO: 55706 - DNA, 32 bp, Homo sapiens; identical to SEQ ID NO: 11700
  misc_feature 1..32: note = chr13:100647898-100647930
  misc_feature 1..32: note = hyper
  source 1..32: mol_type = genomic DNA

SEQ ID NO: 55707 - DNA, 115 bp, Homo sapiens; identical to SEQ ID NO: 35055
  misc_feature 1..115: note = chr13:100648149-100648264
  misc_feature 1..115: note = hyper
  source 1..115: mol_type = genomic DNA

SEQ ID NO: 55708 - DNA, 52 bp, Homo sapiens; identical to SEQ ID NO: 35058
  misc_feature 1..52: note = chr13:100649944-100649996
  misc_feature 1..52: note = hyper
  source 1..52: mol_type = genomic DNA

SEQ ID NO: 55709 - DNA, 169 bp, Homo sapiens; identical to SEQ ID NO: 35059
  misc_feature 1..169: note = chr13:102068189-102068358
  misc_feature 1..169: note = hyper
  source 1..169: mol_type = genomic DNA

SEQ ID NO: 55710 - DNA, 29 bp, Homo sapiens
  misc_feature 1..29: note = chr13:102068417-102068446
  misc_feature 1..29: note = hyper
  source 1..29: mol_type = genomic DNA
cgccccggccaggccggcaaggaccccac

SEQ ID NO: 55711 - DNA, 58 bp, Homo sapiens; identical to SEQ ID NO: 35061
  misc_feature 1..58: note = chr13:102069013-102069071
  misc_feature 1..58: note = hyper
  source 1..58: mol_type = genomic DNA

SEQ ID NO: 55712 - DNA, 44 bp, Homo sapiens
  misc_feature 1..44: note = chr13:102568410-102568454
  misc_feature 1..44: note = hyper
  source 1..44: mol_type = genomic DNA
gctcagatcagactgcgagcggtggctcgaccccgggtgtggca

SEQ ID NO: 55713 - DNA, 89 bp, Homo sapiens
  misc_feature 1..89: note = chr13:102568484-102568573
  misc_feature 1..89: note = hyper
  source 1..89: mol_type = genomic DNA
gccagtccctatcctcccgggaagccgagactcagggggaacaggtttcccagagcccagcctgcagggacgcggagggcaggagccgc

SEQ ID NO: 55714 - DNA, 109 bp, Homo sapiens; identical to SEQ ID NO: 35063
  misc_feature 1..109: note = chr13:102568659-102568768
  misc_feature 1..109: note = hyper
  source 1..109: mol_type = genomic DNA

SEQ ID NO: 55715 - DNA, 412 bp, Homo sapiens
  misc_feature 1..412: note = chr13:102569542-102569954
  misc_feature 1..412: note = hyper
  source 1..412: mol_type = genomic DNA
tcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaa

SEQ ID NO: 55716 - DNA, 30 bp, Homo sapiens; identical to SEQ ID NO: 35065
  misc_feature 1..30: note = chr13:102572245-102572275
  misc_feature 1..30: note = hyper
  source 1..30: mol_type = genomic DNA

SEQ ID NO: 55717 - DNA, 56 bp, Homo sapiens; identical to SEQ ID NO: 21723
  misc_feature 1..56: note = chr13:103046665-103046721
  misc_feature 1..56: note = hyper
  source 1..56: mol_type = genomic DNA

SEQ ID NO: 55718 - DNA, 58 bp, Homo sapiens; identical to SEQ ID NO: 21724
  misc_feature 1..58: note = chr13:103046995-103047053
  misc_feature 1..58: note = hyper
  source 1..58: mol_type = genomic DNA

SEQ ID NO: 55719 - DNA, 247 bp, Homo sapiens; identical to SEQ ID NO: 11708
  misc_feature 1..247: note = chr13:103047054-103047301
  misc_feature 1..247: note = hyper
  source 1..247: mol_type = genomic DNA

SEQ ID NO: 55720 - DNA, 30 bp, Homo sapiens; identical to SEQ ID NO: 11709
  misc_feature 1..30: note = chr13:103052128-103052158
  misc_feature 1..30: note = hyper
  source 1..30: mol_type = genomic DNA

SEQ ID NO: 55721 - DNA, 254 bp, Homo sapiens; identical to SEQ ID NO: 21727
  misc_feature 1..254: note = chr13:103052574-103052828
  misc_feature 1..254: note = hyper
  source 1..254: mol_type = genomic DNA

SEQ ID NO: 55722 - DNA, 63 bp, Homo sapiens; identical to SEQ ID NO: 21728
  misc_feature 1..63: note = chr13:103052829-103052892
  misc_feature 1..63: note = hyper
  source 1..63: mol_type = genomic DNA

SEQ ID NO: 55723 - DNA, 292 bp, Homo sapiens
  misc_feature 1..292: note = chr13:103052940-103053232
  misc_feature 1..292: note = hyper
  source 1..292: mol_type = genomic DNA
tccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtg

SEQ ID NO: 55724 - DNA, 59 bp, Homo sapiens; identical to SEQ ID NO: 35072
  misc_feature 1..59: note = chr13:103054561-103054620
  misc_feature 1..59: note = hyper
  source 1..59: mol_type = genomic DNA

SEQ ID NO: 55725 - skipped

SEQ ID NO: 55726 - DNA, 48 bp, Homo sapiens
  misc_feature 1..48: note = chr13:107186884-107186932
  misc_feature 1..48: note = hyper
  source 1..48: mol_type = genomic DNA
gagagggtcaggtatcgccatcggacaccttcccggacttgacacccg

SEQ ID NO: 55727 - DNA, 97 bp, Homo sapiens; identical to SEQ ID NO: 35074
  misc_feature 1..97: note = chr13:108518548-108518645
  misc_feature 1..97: note = hyper
  source 1..97: mol_type = genomic DNA

SEQ ID NO: 55728 - DNA, 108 bp, Homo sapiens
  misc_feature 1..108: note = chr13:108518705-108518813
  misc_feature 1..108: note = hyper
  source 1..108: mol_type = genomic DNA
tgctgctgccgctgctgctgctggtgctccttgtcccgggcccgggtcagcttggcctcggcgcagaaccacaagtgatcagagagcaggactgtgaaaaacaagaga

SEQ ID NO: 55729 - DNA, 43 bp, Homo sapiens
  misc_feature 1..43: note = chr13:108519367-108519410
  misc_feature 1..43: note = hyper
  source 1..43: mol_type = genomic DNA
tgtcagcgcgcgggtccccatggccccgcggagcccagcccgc

SEQ ID NO: 55730 - DNA, 115 bp, Homo sapiens
  misc_feature 1..115: note = chr13:108519622-108519737
  misc_feature 1..115: note = hyper
  source 1..115: mol_type = genomic DNA
ccccaccccccaccccgcgctctaagtgctgccgccgccgccgccgccgccgccgctgccgcagggccgcccgcgggcgccgccgccggggctccgactgctgacgccgcctccc

SEQ ID NO: 55731 - skipped

SEQ ID NO: 55732 - DNA, 21 bp, Homo sapiens
  misc_feature 1..21: note = chr13:108520805-108520826
  misc_feature 1..21: note = hyper
  source 1..21: mol_type = genomic DNA
aatctggggtcacctcgattc

SEQ ID NO: 55733 - DNA, 278 bp, Homo sapiens; identical to SEQ ID NO: 35083
  misc_feature 1..278: note = chr13:109148376-109148654
  misc_feature 1..278: note = hyper
  source 1..278: mol_type = genomic DNA

SEQ ID NO: 55734 - DNA, 107 bp, Homo sapiens
  misc_feature 1..107: note = chr13:110958709-110958816
  misc_feature 1..107: note = hyper
  source 1..107: mol_type = genomic DNA
acttctgccttggagcgcgccttaggcagcagtcgtgggaaagctcagatacagctgtttccaggcaaagggcccagagcttttcagcctcagccaccagggtctcc

SEQ ID NO: 55735 - DNA, 73 bp, Homo sapiens
  misc_feature 1..73: note = chr13:110958981-110959054
  misc_feature 1..73: note = hyper
  source 1..73: mol_type = genomic DNA
cgcgggttcaaatcccgccggctcccaggcaccctcaccccgccacagcgcgggctgtttctcctcccttccc

SEQ ID NO: 55736 - DNA, 132 bp, Homo sapiens; identical to SEQ ID NO: 4051
  misc_feature 1..132: note = chr13:110959517-110959649
  misc_feature 1..132: note = hyper
  source 1..132: mol_type = genomic DNA

SEQ ID NO: 55737 - DNA, 173 bp, Homo sapiens
  misc_feature 1..173: note = chr13:110959970-110960143
  misc_feature 1..173: note = hyper
  source 1..173: mol_type = genomic DNA
gagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagac

SEQ ID NO: 55738 - DNA, 197 bp, Homo sapiens
  misc_feature 1..197: note = chr13:110960344-110960541
  misc_feature 1..197: note = hyper
  source 1..197: mol_type = genomic DNA
cggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaa

SEQ ID NO: 55739 - DNA, 221 bp, Homo sapiens; identical to SEQ ID NO: 35090
  misc_feature 1..221: note = chr13:110960909-110961130
  misc_feature 1..221: note = hyper
  source 1..221: mol_type = genomic DNA

SEQ ID NO: 55740 - DNA, 112 bp, Homo sapiens; identical to SEQ ID NO: 35091
  misc_feature 1..112: note = chr13:111766833-111766945
  misc_feature 1..112: note = hyper
  source 1..112: mol_type = genomic DNA

SEQ ID NO: 55741 - DNA, 80 bp, Homo sapiens; identical to SEQ ID NO: 35092
  misc_feature 1..80: note = chr13:111767213-111767293
  misc_feature 1..80: note = hyper
  source 1..80: mol_type = genomic DNA

SEQ ID NO: 55742 - DNA, 252 bp, Homo sapiens; identical to SEQ ID NO: 35093
  misc_feature 1..252: note = chr13:111767866-111768118
  misc_feature 1..252: note = hyper
  source 1..252: mol_type = genomic DNA

SEQ ID NO: 55743 - DNA, 30 bp, Homo sapiens; identical to SEQ ID NO: 35094
  misc_feature 1..30: note = chr13:111768438-111768468
  misc_feature 1..30: note = hyper
  source 1..30: mol_type = genomic DNA

SEQ ID NO: 55744 - DNA, 136 bp, Homo sapiens
  misc_feature 1..136: note = chr13:112707869-112708005
  misc_feature 1..136: note = hyper
  source 1..136: mol_type = genomic DNA
gccgcagggggttggggtcatttttttgatgccgccgcccttaagagttccagtccttcaggcgaaaggggcagatcaggccttcggggaggacccttgcctgggagagggagggcagtgccccaggggccgcctc

SEQ ID NO: 55745 - DNA, 30 bp, Homo sapiens; identical to SEQ ID NO: 35097
  misc_feature 1..30: note = chr13:112709027-112709057
  misc_feature 1..30: note = hyper
  source 1..30: mol_type = genomic DNA

SEQ ID NO: 55746 - DNA, 68 bp, Homo sapiens
  misc_feature 1..68: note = chr13:112709815-112709883
  misc_feature 1..68: note = hyper
  source 1..68: mol_type = genomic DNA
cagagacccagaccccgagaaacaagtgtggctccagcccaggagcctcacagaacacatttcctcct

SEQ ID NO: 55747 - DNA, 123 bp, Homo sapiens
  misc_feature 1..123: note = chr13:112709928-112710051
  misc_feature 1..123: note = hyper
  source 1..123: mol_type = genomic DNA
gcaactaggtcctccgaggtgaggctggggctccgcctgcagagggagtgacagcgcgccgcgagggtccgcgacccaggcaggggtggccgcaccaccccggagcgccgcacagccccgcag

SEQ ID NO: 55748 - DNA, 14 bp, Homo sapiens
  misc_feature 1..14: note = chr13:112710745-112710759
  misc_feature 1..14: note = hyper
  source 1..14: mol_type = genomic DNA
gaggggactgggga

SEQ ID NO: 55749 - DNA, 241 bp, Homo sapiens
  misc_feature 1..241: note = chr13:112711776-112712017
  misc_feature 1..241: note = hyper
  source 1..241: mol_type = genomic DNA
tccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccc

SEQ ID NO: 55750 - DNA, 16 bp, Homo sapiens
  misc_feature 1..16: note = chr13:112715354-112715370
  misc_feature 1..16: note = hyper
  source 1..16: mol_type = genomic DNA
gggaacgctcccagcc

SEQ ID NO: 55751 - DNA, 77 bp, Homo sapiens
  misc_feature 1..77: note = chr13:112715642-112715719
  misc_feature 1..77: note = hyper
  source 1..77: mol_type = genomic DNA
tttcctgatgcagccacagggcccagcagcggctcagcctaggccaccgggtccaggcctctaggcaataggcccgg

SEQ ID NO: 55752 - DNA, 182 bp, Homo sapiens
  misc_feature 1..182: note = chr13:112715803-112715985
  misc_feature 1..182: note = hyper
  source 1..182: mol_type = genomic DNA
cgccgggcgctcggcgcatccgccgtgcccacagcgctgaggaccaactagggctgccctcggccaggggcactgtgcccgtttgagtggcactcggacctggcgaggggtggaagcccaggtagagctcgcgtctttaagagccacccgacagaactgcgcgctacatctgcgccagctgg

SEQ ID NO: 55753 - DNA, 40 bp, Homo sapiens; identical to SEQ ID NO: 21744
  misc_feature 1..40: note = chr13:112716313-112716353
  misc_feature 1..40: note = hyper
  source 1..40: mol_type = genomic DNA

SEQ ID NO: 55754 - DNA, 55 bp, Homo sapiens
  misc_feature 1..55: note = chr13:112716622-112716677
  misc_feature 1..55: note = hyper
  source 1..55: mol_type = genomic DNA
cggaggcacacagcacgcgcgcgtgcgcgcgcgcgcacacacacatacacacaca

SEQ ID NO: 55755 - DNA, 299 bp, Homo sapiens; identical to SEQ ID NO: 21746
  misc_feature 1..299: note = chr13:112717536-112717835
  misc_feature 1..299: note = hyper
  source 1..299: mol_type = genomic DNA

SEQ ID NO: 55756 - DNA, 20 bp, Homo sapiens
  misc_feature 1..20: note = chr13:112717949-112717969
  misc_feature 1..20: note = hyper
  source 1..20: mol_type = genomic DNA
ggactcgggactgacactgg

SEQ ID NO: 55757 - DNA, 218 bp, Homo sapiens
  misc_feature 1..218: note = chr13:112720505-112720723
  misc_feature 1..218: note = hyper
  source 1..218: mol_type = genomic DNA
atgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcact

SEQ ID NO: 55758 - DNA, 245 bp, Homo sapiens; identical to SEQ ID NO: 21748
  misc_feature 1..245: note = chr13:112720767-112721012
  misc_feature 1..245: note = hyper
  source 1..245: mol_type = genomic DNA

SEQ ID NO: 55759 - DNA, 91 bp, Homo sapiens
  misc_feature 1..91: note = chr13:112722312-112722403
  misc_feature 1..91: note = hyper
  source 1..91: mol_type = genomic DNA
agcacccggattacaagtaccggccgcgccgcaagaccaagacgctgctcaagaaggacaagtactcgctggccggcgggctcctggcggc

SEQ ID NO: 55760 - DNA, 111 bp, Homo sapiens; identical to SEQ ID NO: 35112
  misc_feature 1..111: note = chr13:112722871-112722982
  misc_feature 1..111: note = hyper
  source 1..111: mol_type = genomic DNA

SEQ ID NO: 55761 - DNA, 236 bp, Homo sapiens; identical to SEQ ID NO: 35113
  misc_feature 1..236: note = chr13:112723488-112723724
  misc_feature 1..236: note = hyper
  source 1..236: mol_type = genomic DNA

SEQ ID NO: 55762 - DNA, 333 bp, Homo sapiens
  misc_feature 1..333: note = chr13:112724172-112724505
  misc_feature 1..333: note = hyper
  source 1..333: mol_type = genomic DNA
aagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttc

SEQ ID NO: 55763 - DNA, 30 bp, Homo sapiens; identical to SEQ ID NO: 35115
  misc_feature 1..30: note = chr13:112725438-112725468
  misc_feature 1..30: note = hyper
  source 1..30: mol_type = genomic DNA

SEQ ID NO: 55764 - DNA, 45 bp, Homo sapiens; identical to SEQ ID NO: 35116
  misc_feature 1..45: note = chr13:112725825-112725870
  misc_feature 1..45: note = hyper
  source 1..45: mol_type = genomic DNA

SEQ ID NO: 55765 - DNA, 169 bp, Homo sapiens
  misc_feature 1..169: note = chr13:112726560-112726729
  misc_feature 1..169: note = hyper
  source 1..169: mol_type = genomic DNA
cggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttgg

SEQ ID NO: 55766 - DNA, 378 bp, Homo sapiens; identical to SEQ ID NO: 35118
  misc_feature 1..378: note = chr13:112726796-112727174
  misc_feature 1..378: note = hyper
  source 1..378: mol_type = genomic DNA

SEQ ID NO: 55767 - DNA, 42 bp, Homo sapiens; identical to SEQ ID NO: 35119
  misc_feature 1..42: note = chr13:112727837-112727879
  misc_feature 1..42: note = hyper
  source 1..42: mol_type = genomic DNA

SEQ ID NO: 55768 - skipped

SEQ ID NO: 55769 - DNA, 104 bp, Homo sapiens
  misc_feature 1..104: note = chr13:112758003-112758107
  misc_feature 1..104: note = hyper
  source 1..104: mol_type = genomic DNA
ctcagcacctgcaggcggggggaccgcgcgcttggctcgaagaccccgccctgggcaggggacagaaaatatgaaatcagatggggagttatgaataactgtcc

SEQ ID NO: 55770 - DNA, 17 bp, Homo sapiens
  misc_feature 1..17: note = chr13:112758257-112758274
  misc_feature 1..17: note = hyper
  source 1..17: mol_type = genomic DNA
acttttctcagtgtggg

SEQ ID NO: 55771 - DNA, 78 bp, Homo sapiens; identical to SEQ ID NO: 21754
  misc_feature 1..78: note = chr13:112758613-112758691
  misc_feature 1..78: note = hyper
  source 1..78: mol_type = genomic DNA

SEQ ID NO: 55772 - DNA, 364 bp, Homo sapiens
  misc_feature 1..364: note = chr13:112759248-112759612
  misc_feature 1..364: note = hyper
  source 1..364: mol_type = genomic DNA
tgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggat

SEQ ID NO: 55773 - DNA, 139 bp, Homo sapiens
  misc_feature 1..139: note = chr13:112759642-112759781
  misc_feature 1..139: note = hyper
  source 1..139: mol_type = genomic DNA
tcacaatcacttatctggaaacctgcggttggattaatcgttatattcccgagatgagcgtcgctgcaatccgcagcgaacgcgggtagggacctggagacgcctcccgggcgctggcggggccggtgtgggccagctc

SEQ ID NO: 55774 - DNA, 95 bp, Homo sapiens
  misc_feature 1..95: note = chr13:112760327-112760422
  misc_feature 1..95: note = hyper
  source 1..95: mol_type = genomic DNA
gaagaggaacttgcattacaaagacttgtctttctgagctgaagtcaaaacgggggcgtcaagcgcgctccgtttggcggcggtggaggggccgc

SEQ ID NO: 55775 - DNA, 128 bp, Homo sapiens
  misc_feature 1..128: note = chr13:112761214-112761342
  misc_feature 1..128: note = hyper
  source 1..128: mol_type = genomic DNA
agtccagaccccctccaacgttggtaggggtaggaagaggaggaggggcccagggaggggggtctttcgcaagtggggcctcgggggatccctgctctccttctggtgcattccgcaactttaaaagc

SEQ ID NO: 55776 - DNA, 69 bp, Homo sapiens; identical to SEQ ID NO: 35126
  misc_feature 1..69: note = chr13:113547082-113547151
  misc_feature 1..69: note = hyper
  source 1..69: mol_type = genomic DNA

SEQ ID NO: 55777 - DNA, 132 bp, Homo sapiens; identical to SEQ ID NO: 35127
  misc_feature 1..132: note = chr13:114462866-114462998
  misc_feature 1..132: note = hyper
  source 1..132: mol_type = genomic DNA

SEQ ID NO: 55778 - DNA, 119 bp, Homo sapiens
  misc_feature 1..119: note = chr14:21093631-21093750
  misc_feature 1..119: note = hyper
  source 1..119: mol_type = genomic DNA
aggatcctgaagtactaacactttctaactagtaaaataattaaatcttcctttcccaggattctcccggattacacagcatcagttcctctgaattctgcattcgtaattaaaatcct

SEQ ID NO: 55779 - DNA, 30 bp, Homo sapiens; identical to SEQ ID NO: 35130
  misc_feature 1..30: note = chr14:21098864-21098894
  misc_feature 1..30: note = hyper
  source 1..30: mol_type = genomic DNA

SEQ ID NO: 55780 - DNA, 119 bp, Homo sapiens
  misc_feature 1..119: note = chr14:21100629-21100748
  misc_feature 1..119: note = hyper
  source 1..119: mol_type = genomic DNA
gcaacttttccccgacggcacctcctgggcgcccttgaaagacgccttaaatctaaacctataatacataggtaatcaactaaagctgaaagggaatggccaaagcacccacgtggagt

SEQ ID NO: 55781 - DNA, 23 bp, Homo sapiens
  misc_feature 1..23: note = chr14:21100778-21100801
  misc_feature 1..23: note = hyper
  source 1..23: mol_type = genomic DNA
agtggcttttagagctcaacatc

SEQ ID NO: 55782 - DNA, 176 bp, Homo sapiens
  misc_feature 1..176: note = chr14:21100831-21101007
  misc_feature 1..176: note = hyper
  source 1..176: mol_type = genomic DNA
ccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 55783 - skipped

SEQ ID NO: 55784 - DNA, 19 bp, Homo sapiens
  misc_feature 1..19: note = chr14:21101037-21101056
  misc_feature 1..19: note = hyper
  source 1..19: mol_type = genomic DNA
cgcacgttgactttcctgg

SEQ ID NO: 55785 - DNA, 30 bp, Homo sapiens; identical to SEQ ID NO: 11759
  misc_feature 1..30: note = chr14:21121400-21121430
  misc_feature 1..30: note = hyper
  source 1..30: mol_type = genomic DNA

SEQ ID NO: 55786 - DNA, 15 bp, Homo sapiens
  misc_feature 1..15: note = chr14:21121902-21121917
  misc_feature 1..15: note = hyper
  source 1..15: mol_type = genomic DNA
ctcatcccccacccc

SEQ ID NO: 55787 - DNA, 292 bp, Homo sapiens; identical to SEQ ID NO: 35136
  misc_feature 1..292: note = chr14:21769054-21769346
  misc_feature 1..292: note = hyper
  source 1..292: mol_type = genomic DNA

SEQ ID NO: 55788 - DNA, 139 bp, Homo sapiens; identical to SEQ ID NO: 35137
  misc_feature 1..139: note = chr14:21994200-21994339
  misc_feature 1..139: note = hyper
  source 1..139: mol_type = genomic DNA

SEQ ID NO: 55789 - DNA, 88 bp, Homo sapiens; identical to SEQ ID NO: 35138
  misc_feature 1..88: note = chr14:23291857-23291945
  misc_feature 1..88: note = hyper
  source 1..88: mol_type = genomic DNA

SEQ ID NO: 55790 - DNA, 30 bp, Homo sapiens; identical to SEQ ID NO: 35139
  misc_feature 1..30: note = chr14:23652871-23652901
  misc_feature 1..30: note = hyper
  source 1..30: mol_type = genomic DNA

SEQ ID NO: 55791 - DNA, 177 bp, Homo sapiens; identical to SEQ ID NO: 35140
  misc_feature 1..177: note = chr14:23821399-23821576
  misc_feature 1..177: note = hyper
  source 1..177: mol_type = genomic DNA

SEQ ID NO: 55792 - DNA, 592 bp, Homo sapiens; identical to SEQ ID NO: 35141
  misc_feature 1..592: note = chr14:23821601-23822193
  misc_feature 1..592: note = hyper
  source 1..592: mol_type = genomic DNA

SEQ ID NO: 55793 - DNA, 121 bp, Homo sapiens
  misc_feature 1..121: note = chr14:24803473-24803594
  misc_feature 1..121: note = hyper
  source 1..121: mol_type = genomic DNA
gaacccggacagaaacgagaagcatccaggactcagctttctccctgagcagacccagaagggtagagtgacttgcccagggtcactgcagttcctagccaggctcaatggtcctttcttt

SEQ ID NO: 55794 - DNA, 70 bp, Homo sapiens; identical to SEQ ID NO: 35144
  misc_feature 1..70: note = chr14:24804424-24804494
  misc_feature 1..70: note = hyper
  source 1..70: mol_type = genomic DNA

SEQ ID NO: 55795 - DNA, 36 bp, Homo sapiens; identical to SEQ ID NO: 35145
  misc_feature 1..36: note = chr14:24808711-24808747
  misc_feature 1..36: note = hyper
  source 1..36: mol_type = genomic DNA

SEQ ID NO: 55796 - DNA, 30 bp, Homo sapiens; identical to SEQ ID NO: 35146
  misc_feature 1..30: note = chr14:24837774-24837804
  misc_feature 1..30: note = hyper
  source 1..30: mol_type = genomic DNA

SEQ ID NO: 55797 - DNA, 234 bp, Homo sapiens; identical to SEQ ID NO: 35147
  misc_feature 1..234: note = chr14:25518435-25518669
  misc_feature 1..234: note = hyper
  source 1..234: mol_type = genomic DNA

SEQ ID NO: 55798 - DNA, 432 bp, Homo sapiens; identical to SEQ ID NO: 35148
  misc_feature 1..432: note = chr14:25519184-25519616
  misc_feature 1..432: note = hyper
  source 1..432: mol_type = genomic DNA

SEQ ID NO: 55799 - DNA, 35 bp, Homo sapiens
  misc_feature 1..35: note = chr14:26674319-26674354
  misc_feature 1..35: note = hyper
  source 1..35: mol_type = genomic DNA
agcccgactctggggcgtttgggaggtgggcctga

SEQ ID NO: 55800 - DNA, 193 bp, Homo sapiens; identical to SEQ ID NO: 21771
  misc_feature 1..193: note = chr14:26674384-26674577
  misc_feature 1..193: note = hyper
  source 1..193: mol_type = genomic DNA

SEQ ID NO: 55801 - DNA, 110 bp, Homo sapiens; identical to SEQ ID NO: 35150
  misc_feature 1..110: note = chr14:27066218-27066328
  misc_feature 1..110: note = hyper
  source 1..110: mol_type = genomic DNA

SEQ ID NO: 55802 - DNA, 60 bp, Homo sapiens; identical to SEQ ID NO: 11772
  misc_feature 1..60: note = chr14:27067097-27067157
  misc_feature 1..60: note = hyper
  source 1..60: mol_type = genomic DNA

SEQ ID NO: 55803 - DNA, 65 bp, Homo sapiens; identical to SEQ ID NO: 35153
  misc_feature 1..65: note = chr14:27067614-27067679
  misc_feature 1..65: note = hyper
  source 1..65: mol_type = genomic DNA

SEQ ID NO: 55804 - DNA, 37 bp, Homo sapiens; identical to SEQ ID NO: 35154
  misc_feature 1..37: note = chr14:27068238-27068275
  misc_feature 1..37: note = hyper
  source 1..37: mol_type = genomic DNA

SEQ ID NO: 55805 - DNA, 46 bp, Homo sapiens; identical to SEQ ID NO: 35155
  misc_feature 1..46: note = chr14:29224761-29224807
  misc_feature 1..46: note = hyper
  source 1..46: mol_type = genomic DNA

SEQ ID NO: 55806 - DNA, 207 bp, Homo sapiens
  misc_feature 1..207: note = chr14:29225561-29225768
  misc_feature 1..207: note = hyper
  source 1..207: mol_type = genomic DNA
ggagggccagagcggggatcgcagcagaatctgcagcactggtgttaaggagaatttgagcgctcgaatgctgttgttaaatttcttcccagagccccatgctccctcgtttagcatctcccttccccaataattacttgagaggatgagctcgagattgaagagtgaggttggcttttctgtgtgaggagccgataggatccacca

SEQ ID NO: 55807 - DNA, 38 bp, Homo sapiens; identical to SEQ ID NO: 21776
  misc_feature 1..38: note = chr14:29226033-29226071
  misc_feature 1..38: note = hyper
  source 1..38: mol_type = genomic DNA

SEQ ID NO: 55808 - DNA, 207 bp, Homo sapiens; identical to SEQ ID NO: 35158
  misc_feature 1..207: note = chr14:29226360-29226567
  misc_feature 1..207: note = hyper
  source 1..207: mol_type = genomic DNA

SEQ ID NO: 55809 - DNA, 48 bp, Homo sapiens; identical to SEQ ID NO: 35159
  misc_feature 1..48: note = chr14:29227895-29227943
  misc_feature 1..48: note = hyper
  source 1..48: mol_type = genomic DNA

SEQ ID NO: 55810 - DNA, 386 bp, Homo sapiens
  misc_feature 1..386: note = chr14:29228268-29228654
  misc_feature 1..386: note = hyper
  source 1..386: mol_type = genomic DNA
ccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattc

SEQ ID NO: 55811 - DNA, 329 bp, Homo sapiens
  misc_feature 1..329: note = chr14:29228778-29229107
  misc_feature 1..329: note = hyper
  source 1..329: mol_type = genomic DNA
gattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaac

SEQ ID NO: 55812 - DNA, 332 bp, Homo sapiens
  misc_feature 1..332: note = chr14:29229386-29229718
  misc_feature 1..332: note = hyper
  source 1..332: mol_type = genomic DNA
ggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggctt

SEQ ID NO: 55813 - DNA, 200 bp, Homo sapiens
  misc_feature 1..200: note = chr14:29230871-29231071
  misc_feature 1..200: note = hyper
  source 1..200: mol_type = genomic DNA
cttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacat

SEQ ID NO: 55814 - DNA, 142 bp, Homo sapiens
  misc_feature 1..142: note = chr14:29231283-29231425
  misc_feature 1..142: note = hyper
  source 1..142: mol_type = genomic DNA
cgcccccggggacgttgagggtgcgcgtgcgcgcgctgagagcagccactgacaacctgcagctccctaatgagtgacgaggcagggctgctgcagaaaagtaacacttccctggtgtgaagacctcttactgagaagttta

SEQ ID NO: 55815 - DNA, 30 bp, Homo sapiens; identical to SEQ ID NO: 35164
  misc_feature 1..30: note = chr14:29231696-29231726
  misc_feature 1..30: note = hyper
  source 1..30: mol_type = genomic DNA

SEQ ID NO: 55816 - DNA, 35 bp, Homo sapiens; identical to SEQ ID NO: 35165
  misc_feature 1..35: note = chr14:29234555-29234590
  misc_feature 1..35: note = hyper
  source 1..35: mol_type = genomic DNA

SEQ ID NO: 55817 - DNA, 150 bp, Homo sapiens; identical to SEQ ID NO: 21784
  misc_feature 1..150: note = chr14:29234853-29235003
  misc_feature 1..150: note = hyper
  source 1..150: mol_type = genomic DNA

SEQ ID NO: 55818 - DNA, 203 bp, Homo sapiens; identical to SEQ ID NO: 35168
  misc_feature 1..203: note = chr14:29236018-29236221
  misc_feature 1..203: note = hyper
  source 1..203: mol_type = genomic DNA

SEQ ID NO: 55819 - DNA, 54 bp, Homo sapiens; identical to SEQ ID NO: 35169
  misc_feature 1..54: note = chr14:29236281-29236335
  misc_feature 1..54: note = hyper
  source 1..54: mol_type = genomic DNA

SEQ ID NO: 55820 - DNA, 371 bp, Homo sapiens; identical to SEQ ID NO: 35170
  misc_feature 1..371: note = chr14:29236413-29236784
  misc_feature 1..371: note = hyper
  source 1..371: mol_type = genomic DNA

SEQ ID NO: 55821 - DNA, 33 bp, Homo sapiens
  misc_feature 1..33: note = chr14:29237030-29237063
  misc_feature 1..33: note = hyper
  source 1..33: mol_type = genomic DNA
gccgttcagctacaacgcgctcatcatgatggc

SEQ ID NO: 55822 - DNA, 77 bp, Homo sapiens; identical to SEQ ID NO: 35172
  misc_feature 1..77: note = chr14:29237139-29237216
  misc_feature 1..77: note = hyper
  source 1..77: mol_type = genomic DNA

SEQ ID NO: 55823 - DNA, 317 bp, Homo sapiens; identical to SEQ ID NO: 35173
  misc_feature 1..317: note = chr14:29237573-29237890
  misc_feature 1..317: note = hyper
  source 1..317: mol_type = genomic DNA

SEQ ID NO: 55824 - DNA, 30 bp, Homo sapiens; identical to SEQ ID NO: 35174
  misc_feature 1..30: note = chr14:29242568-29242598
  misc_feature 1..30: note = hyper
  source 1..30: mol_type = genomic DNA

SEQ ID NO: 55825 - DNA, 63 bp, Homo sapiens; identical to SEQ ID NO: 11788
  misc_feature 1..63: note = chr14:29243208-29243271
  misc_feature 1..63: note = hyper
  source 1..63: mol_type = genomic DNA

SEQ ID NO: 55826 - skipped

SEQ ID NO: 55827 - DNA, 336 bp, Homo sapiens
  misc_feature 1..336: note = chr14:29243888-29244224
  misc_feature 1..336: note = hyper
  source 1..336: mol_type = genomic DNA
tccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcag

SEQ ID NO: 55828 - DNA, 592 bp, Homo sapiens
  misc_feature 1..592: note = chr14:29247097-29247689
  misc_feature 1..592: note = hyper
  source 1..592: mol_type = genomic DNA
atcttctcaccctggcgagttttcctgaaactacttatccttagcgtcagcgctgtaagaggtggagccgctcagtcccgcgggtggctgcagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtacc

SEQ ID NO: 55829 - DNA, 15 bp, Homo sapiens
  misc_feature 1..15: note = chr14:29254425-29254440
  misc_feature 1..15: note = hyper
  source 1..15: mol_type = genomic DNA
ggcgcccgcagaagc

SEQ ID NO: 55830 - DNA, 420 bp, Homo sapiens
  misc_feature 1..420: note = chr14:29254713-29255133
  misc_feature 1..420: note = hyper
  source 1..420: mol_type = genomic DNA
ggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttt

SEQ ID NO: 55831 - DNA, 30 bp, Homo sapiens; identical to SEQ ID NO: 35181
  misc_feature 1..30: note = chr14:30396081-30396111
  misc_feature 1..30: note = hyper
  source 1..30: mol_type = genomic DNA

SEQ ID NO: 55832 - DNA, 51 bp, Homo sapiens; identical to SEQ ID NO: 35182
  misc_feature 1..51: note = chr14:30396380-30396431
  misc_feature 1..51: note = hyper
  source 1..51: mol_type = genomic DNA

SEQ ID NO: 55833 - DNA, 245 bp, Homo sapiens; identical to SEQ ID NO: 35183
  misc_feature 1..245: note = chr14:30396925-30397170
  misc_feature 1..245: note = hyper
  source 1..245: mol_type = genomic DNA

SEQ ID NO: 55834 - DNA, 39 bp, Homo sapiens; identical to SEQ ID NO: 35184
  misc_feature 1..39: note = chr14:30739946-30739985
  misc_feature 1..39: note = hyper
  source 1..39: mol_type = genomic DNA

SEQ ID NO: 55835 - DNA, 623 bp, Homo sapiens; identical to SEQ ID NO: 35185
  misc_feature 1..623: note = chr14:31343352-31343975
  misc_feature 1..623: note = hyper
  source 1..623: mol_type = genomic DNA

SEQ ID NO: 55836 - DNA, 159 bp, Homo sapiens
  misc_feature 1..159: note = chr14:31344187-31344346
  misc_feature 1..159: note = hyper
  source 1..159: mol_type = genomic DNA
cgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgca

SEQ ID NO: 55837 - DNA, 40 bp, Homo sapiens; identical to SEQ ID NO: 35187
  misc_feature 1..40: note = chr14:32671453-32671493
  misc_feature 1..40: note = hyper
  source 1..40: mol_type = genomic DNA

SEQ ID NO: 55838 - DNA, 232 bp, Homo sapiens; identical to SEQ ID NO: 35188
  misc_feature 1..232: note = chr14:33401993-33402225
  misc_feature 1..232: note = hyper
  source 1..232: mol_type = genomic DNA

SEQ ID NO: 55839 - DNA, 95 bp, Homo sapiens
  misc_feature 1..95: note = chr14:33402367-33402462
  misc_feature 1..95: note = hyper
  source 1..95: mol_type = genomic DNA
cggcctgtgtcactcttggccttggcaacttctggccaatccgccctgcccctctgggtcccggcgggccggctgcgccctaggctcaaagggtt

SEQ ID NO: 55840 - DNA, 155 bp, Homo sapiens
  misc_feature 1..155: note = chr14:33402762-33402917
  misc_feature 1..155: note = hyper
  source 1..155: mol_type = genomic DNA
ggctcgccagccggaagaaagaggaggaagtgggacaacgggggtcctgggcaggggtaggggaaacgatcaactcccactgcccccacccactagtcgagttggaatgcaagtcgtcacttaaaaaggctcacccaaaccgcaggcatacctcc

SEQ ID NO: 55841 - DNA, 550 bp, Homo sapiens
  misc_feature 1..550: note = chr14:33403316-33403866
  misc_feature 1..550: note = hyper
  source 1..550: mol_type = genomic DNA
gcgctgcctgatgtgcataagacgggcagagaggggttccggccaggaagggaggctctacgtccccattcctgcacacgcgggctggcttccaggttgctggaagccgcgggaggcgcgagcttgcctggatggtggttatttctctagagaaaggaggagagagagagcgcgcctgagtcttgcactttgggtcggaagtgcgcggcgtgtgtgtgtgtgtgtgtgtgtgtgtgtgtagaggggggcgggaaagaaacgcaccctccgctgccggtcattcccttgcaccggccaagtcctcgccaagcctcccggtgcatccttcctccgccaccccctccccttcttccctcagctgggctcgcgcggcgcagccggagcagccagtgagagcaacatcctggaaagaggggggagcaccgccgccccccaaaagggaaaaaaggccccaccctgacacgttttgctgtttgcaagtccctcgcacgccccccgcacctcctcctcgcgcttgcggccccccccacccccagcccgctgcgcgcac

SEQ ID NO: 55842 - DNA, 30 bp, Homo sapiens; identical to SEQ ID NO: 35193
  misc_feature 1..30: note = chr14:33407749-33407779
  misc_feature 1..30: note = hyper
  source 1..30: mol_type = genomic DNA

SEQ ID NO: 55843 - DNA, 60 bp, Homo sapiens; identical to SEQ ID NO: 35194
  misc_feature 1..60: note = chr14:33408303-33408363
  misc_feature 1..60: note = hyper
  source 1..60: mol_type = genomic DNA

SEQ ID NO: 55844 - DNA, 55 bp, Homo sapiens; identical to SEQ ID NO: 35195
  misc_feature 1..55: note = chr14:33408623-33408678
  misc_feature 1..55: note = hyper
  source 1..55: mol_type = genomic DNA

SEQ ID NO: 55845 - DNA, 177 bp, Homo sapiens; identical to SEQ ID NO: 35196
  misc_feature 1..177: note = chr14:34419561-34419738
  misc_feature 1..177: note = hyper
  source 1..177: mol_type = genomic DNA

SEQ ID NO: 55846 - DNA, 182 bp, Homo sapiens; identical to SEQ ID NO: 35197
  misc_feature 1..182: note = chr14:34529691-34529873
  misc_feature 1..182: note = hyper
  source 1..182: mol_type = genomic DNA

SEQ ID NO: 55847 - DNA, 131 bp, Homo sapiens
  misc_feature 1..131: note = chr14:36003826-36003957
  misc_feature 1..131: note = hyper
  source 1..131: mol_type = genomic DNA
gttcctggagcgctgcctcagctcgcccgtctccgccgagtctttccccgggggcgccgccgccgtggccgctttctcctgctccgtggcgccagcagccgcaccgaccccgggggagcagtttctgctgc

SEQ ID NO: 55848 - DNA, 218 bp, Homo sapiens; identical to SEQ ID NO: 21798
  misc_feature 1..218: note = chr14:36004493-36004711
  misc_feature 1..218: note = hyper
  source 1..218: mol_type = genomic DNA

SEQ ID NO: 55849 - DNA, 97 bp, Homo sapiens
  misc_feature 1..97: note = chr14:36972706-36972803
  misc_feature 1..97: note = hyper
  source 1..97: mol_type = genomic DNA
ctgactttattcttacggaattaaacacaataatttttttaaaatatcttctttgaggcaagtgaccacgagagcacctgttatttaaaagtttatt

SEQ ID NO: 55850 - DNA, 12 bp, Homo sapiens
  misc_feature 1..12: note = chr14:36973210-36973222
  misc_feature 1..12: note = hyper
  source 1..12: mol_type = genomic DNA
ccctgcgcagcc

SEQ ID NO: 55851 - DNA, 328 bp, Homo sapiens
  misc_feature 1..328: note = chr14:36973538-36973866
  misc_feature 1..328: note = hyper
  source 1..328: mol_type = genomic DNA
tgctccgccgcaggaagaaagacgcccgacaggcgcccactgcccgaacccacgcgggggccagtcagccagcgggccgtgttgggaaagctccgcgcggcggcgggacataggatccccatcggggacctgggcgacggcctgagcttgggcgcccctccagctgggcgtcatctccacacagttcttcccttgcgccgcgaattcagcccctgtgaagacgctttgggcattggcgagcaacaggggaaaaaacgagtcacttaaatgggagaaggaaggggatggtcatgaggacttggaggaaaccacacggaaaagaaatcct

SEQ ID NO: 55852 - DNA, 247 bp, Homo sapiens
  misc_feature 1..247: note = chr14:36974982-36975229
  misc_feature 1..247: note = hyper
  source 1..247: mol_type = genomic DNA
tattaaaagggttgtgctgcagctaaaatatctcacagtgtgtgtgaacctcataaaagggaggacccggattccaagcccctcgaagtccccaagcagcctggagggtgggggactcccctctccttctctccacactgagcccccgggcaagcccaggcctcctcctgcgccggggtccccgggctccgaaactgcgagagccctgcggagcccggccagaggggcagagggtgggggctggggg

SEQ ID NO: 55853 - DNA, 19 bp, Homo sapiens
  misc_feature 1..19: note = chr14:36975280-36975299
  misc_feature 1..19: note = hyper
  source 1..19: mol_type = genomic DNA
cggggagccgggatccgcc

SEQ ID NO: 55854 - DNA, 58 bp, Homo sapiens; identical to SEQ ID NO: 21801
  misc_feature 1..58: note = chr14:36975399-36975457
  misc_feature 1..58: note = hyper
  source 1..58: mol_type = genomic DNA

SEQ ID NO: 55855 - DNA, 142 bp, Homo sapiens; identical to SEQ ID NO: 21802
  misc_feature 1..142: note = chr14:36977503-36977645
  misc_feature 1..142: note = hyper
  source 1..142: mol_type = genomic DNA

SEQ ID NO: 55856 - DNA, 30 bp, Homo sapiens; identical to SEQ ID NO: 35210
  misc_feature 1..30: note = chr14:36978658-36978688
  misc_feature 1..30: note = hyper
  source 1..30: mol_type = genomic DNA

SEQ ID NO: 55857 - DNA, 67 bp, Homo sapiens; identical to SEQ ID NO: 35211
  misc_feature 1..67: note = chr14:36979742-36979809
  misc_feature 1..67: note = hyper
  source 1..67: mol_type = genomic DNA

SEQ ID NO: 55858 - DNA, 244 bp, Homo sapiens; identical to SEQ ID NO: 35212
  misc_feature 1..244: note = chr14:36981839-36982083
  misc_feature 1..244: note = hyper
  source 1..244: mol_type = genomic DNA

SEQ ID NO: 55859 - DNA, 294 bp, Homo sapiens; identical to SEQ ID NO: 35213
  misc_feature 1..294: note = chr14:36982402-36982696
  misc_feature 1..294: note = hyper
  source 1..294: mol_type = genomic DNA

SEQ ID NO: 55860 - DNA, 288 bp, Homo sapiens; identical to SEQ ID NO: 35214
  misc_feature 1..288: note = chr14:36983130-36983418
  misc_feature 1..288: note = hyper
  source 1..288: mol_type = genomic DNA

SEQ ID NO: 55861 - DNA, 30 bp, Homo sapiens
  misc_feature 1..30: note = chr14:36983678-36983708
  misc_feature 1..30: note = hyper
  source 1..30: mol_type = genomic DNA
gagttcacctttccccgggacaagtaaaca

SEQ ID NO: 55862 - DNA, 117 bp, Homo sapiens
  misc_feature 1..117: note = chr14:36984146-36984263
  misc_feature 1..117: note = hyper
  source 1..117: mol_type = genomic DNA
actctcactagacccaaccatcctcttgggaatcttcgagtccctctggctgttggaaactgtgtctcagcagtgaggcccaggtttctgagggagaaagcccggcctagcccacag

SEQ ID NO: 55863 - DNA, 73 bp, Homo sapiens
  misc_feature 1..73: note = chr14:36986228-36986301
  misc_feature 1..73: note = hyper
  source 1..73: mol_type = genomic DNA
ccttgagattggatgcgcttggttgtttttcattttctttttttaaaaaaaaaaacccacaaattttaggggg

SEQ ID NO: 55864 - DNA, 10 bp, Homo sapiens
  misc_feature 1..10: note = chr14:36988143-36988153
  misc_feature 1..10: note = hyper
  source 1..10: mol_type = genomic DNA
ctcctgagct

SEQ ID NO: 55865 - DNA, 38 bp, Homo sapiens; identical to SEQ ID NO: 35220
  misc_feature 1..38: note = chr14:36988606-36988644
  misc_feature 1..38: note = hyper
  source 1..38: mol_type = genomic DNA

SEQ ID NO: 55866 - DNA, 36 bp, Homo sapiens; identical to SEQ ID NO: 35221
  misc_feature 1..36: note = chr14:36989186-36989222
  misc_feature 1..36: note = hyper
  source 1..36: mol_type = genomic DNA

SEQ ID NO: 55867 - DNA, 829 bp, Homo sapiens; identical to SEQ ID NO: 35222
  misc_feature 1..829: note = chr14:36989705-36990534
  misc_feature 1..829: note = hyper
  source 1..829: mol_type = genomic DNA

SEQ ID NO: 55868 - DNA, 323 bp, Homo sapiens
  misc_feature 1..323: note = chr14:36990535-36990858
  misc_feature 1..323: note = hyper
  source 1..323: mol_type = genomic DNA
ctccccggccggccccggcaggtgcctccaagacacccgcgctggtcaaggagcttcttgaatttagtttttgttttcacattttctttcccctccttgtagagaaggagctcctgatcatgacgaacaggcagttttgagctacttaattcatccgggctccctttttttattaatagcaattacagtagagaaagttttatttatttttaaagatttcagccctctccttgaagagagctcttactccctcaatacaaagccaacttctataataacattcgcttttctcaccgcctaccttctttaccagggtaaagaaa

SEQ ID NO: 55869 - DNA, 22 bp, Homo sapiens
  misc_feature 1..22: note = chr14:36991177-36991199
  misc_feature 1..22: note = hyper
  source 1..22: mol_type = genomic DNA
tgagtcccgaatggggtctaat

SEQ ID NO: 55870 - DNA, 165 bp, Homo sapiens; identical to SEQ ID NO: 21808
  misc_feature 1..165: note = chr14:36991613-36991778
  misc_feature 1..165: note = hyper
  source 1..165: mol_type = genomic DNA

SEQ ID NO: 55871 - DNA, 84 bp, Homo sapiens
  misc_feature 1..84: note = chr14:36992417-36992501
  misc_feature 1..84: note = hyper
  source 1..84: mol_type = genomic DNA
ggggcgcaggcccaggctcggccctagatgcgcggaatcgccatcagcctttgcttacaccagcgtggccgcagggaaactcct

SEQ ID NO: 55872 - DNA, 35 bp, Homo sapiens; identical to SEQ ID NO: 21809
  misc_feature 1..35: note = chr14:36993438-36993473
  misc_feature 1..35: note = hyper
  source 1..35: mol_type = genomic DNA

SEQ ID NO: 55873 - DNA, 10 bp, Homo sapiens
  misc_feature 1..10: note = chr14:36994999-36995009
  misc_feature 1..10: note = hyper
  source 1..10: mol_type = genomic DNA
catcatccac

SEQ ID NO: 55874 - DNA, 63 bp, Homo sapiens; identical to SEQ ID NO: 35231
  misc_feature 1..63: note = chr14:36995010-36995073
  misc_feature 1..63: note = hyper
  source 1..63: mol_type = genomic DNA

SEQ ID NO: 55875 - DNA, 84 bp, Homo sapiens; identical to SEQ ID NO: 35232
  misc_feature 1..84: note = chr14:37051112-37051196
  misc_feature 1..84: note = hyper
  source 1..84: mol_type = genomic DNA

SEQ ID NO: 55876 - DNA, 30 bp, Homo sapiens; identical to SEQ ID NO: 35233
  misc_feature 1..30: note = chr14:37051599-37051629
  misc_feature 1..30: note = hyper
  source 1..30: mol_type = genomic DNA

SEQ ID NO: 55877 - DNA, 30 bp, Homo sapiens; identical to SEQ ID NO: 35234
  misc_feature 1..30: note = chr14:37051933-37051963
  misc_feature 1..30: note = hyper
  source 1..30: mol_type = genomic DNA

SEQ ID NO: 55878 - DNA, 387 bp, Homo sapiens; identical to SEQ ID NO: 11829
  misc_feature 1..387: note = chr14:37116983-37117370
  misc_feature 1..387: note = hyper
  source 1..387: mol_type = genomic DNA

SEQ ID NO: 55879 - skipped

SEQ ID NO: 55880 - DNA, 107 bp, Homo sapiens; identical to SEQ ID NO: 21813
  misc_feature 1..107: note = chr14:37125545-37125652
  misc_feature 1..107: note = hyper
  source 1..107: mol_type = genomic DNA

SEQ ID NO: 55881 - DNA, 165 bp, Homo sapiens; identical to SEQ ID NO: 35240
  misc_feature 1..165: note = chr14:37125763-37125928
  misc_feature 1..165: note = hyper
  source 1..165: mol_type = genomic DNA

SEQ ID NO: 55882 - DNA, 85 bp, Homo sapiens; identical to SEQ ID NO: 21814
  misc_feature 1..85: note = chr14:37126156-37126241
  misc_feature 1..85: note = hyper
  source 1..85: mol_type = genomic DNA

SEQ ID NO: 55883 - DNA, 269 bp, Homo sapiens
  misc_feature 1..269: note = chr14:37126297-37126566
  misc_feature 1..269: note = hyper
  source 1..269: mol_type = genomic DNA
cttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgc

SEQ ID NO: 55884 - DNA, 317 bp, Homo sapiens
  misc_feature 1..317: note = chr14:37126964-37127281
  misc_feature 1..317: note = hyper
  source 1..317: mol_type = genomic DNA
cgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagctt

SEQ ID NO: 55885 - DNA, 344 bp, Homo sapiens
  misc_feature 1..344: note = chr14:37127311-37127655
  misc_feature 1..344: note = hyper
  source 1..344: mol_type = genomic DNA
gaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgctt

SEQ ID NO: 55886 - DNA, 323 bp, Homo sapiens
  misc_feature 1..323: note = chr14:37130260-37130583
  misc_feature 1..323: note = hyper
  source 1..323: mol_type = genomic DNA
caggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatgg

SEQ ID NO: 55887 - DNA, 30 bp, Homo sapiens; identical to SEQ ID NO: 35244
  misc_feature 1..30: note = chr14:37131143-37131173
  misc_feature 1..30: note = hyper
  source 1..30: mol_type = genomic DNA

SEQ ID NO: 55888 - DNA, 85 bp, Homo sapiens; identical to SEQ ID NO: 21820
  misc_feature 1..85: note = chr14:37132290-37132375
  misc_feature 1..85: note = hyper
  source 1..85: mol_type = genomic DNA

SEQ ID NO: 55889 - DNA, 306 bp, Homo sapiens
  misc_feature 1..306: note = chr14:37132695-37133001
  misc_feature 1..306: note = hyper
  source 1..306: mol_type = genomic DNA
acatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttcca

SEQ ID NO: 55890 - DNA, 247 bp, Homo sapiens
  misc_feature 1..247: note = chr14:37133052-37133299
  misc_feature 1..247: note = hyper
  source 1..247: mol_type = genomic DNA
gagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttca

SEQ ID NO: 55891 - DNA, 86 bp, Homo sapiens; identical to SEQ ID NO: 35247
  misc_feature 1..86: note = chr14:37133668-37133754
  misc_feature 1..86: note = hyper
  source 1..86: mol_type = genomic DNA

SEQ ID NO: 55892 - DNA, 12 bp, Homo sapiens
  misc_feature 1..12: note = chr14:37135739-37135751
  misc_feature 1..12: note = hyper
  source 1..12: mol_type = genomic DNA
cgccgccccgca

SEQ ID NO: 55893 - DNA, 243 bp, Homo sapiens
  misc_feature 1..243: note = chr14:37136345-37136588
  misc_feature 1..243: note = hyper
  source 1..243: mol_type = genomic DNA
gcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaa

SEQ ID NO: 55894 - DNA, 170 bp, Homo sapiens; identical to SEQ ID NO: 35250
  misc_feature 1..170: note = chr14:37666822-37666992
  misc_feature 1..170: note = hyper
  source 1..170: mol_type = genomic DNA

SEQ ID NO: 55895 - DNA, 112 bp, Homo sapiens; identical to SEQ ID NO: 35251
  misc_feature 1..112: note = chr14:38052852-38052964
  misc_feature 1..112: note = hyper
  source 1..112: mol_type = genomic DNA

SEQ ID NO: 55896 - DNA, 95 bp, Homo sapiens; identical to SEQ ID NO: 35252
  misc_feature 1..95: note = chr14:38057238-38057333
  misc_feature 1..95: note = hyper
  source 1..95: mol_type = genomic DNA

SEQ ID NO: 55897 - DNA, 33 bp, Homo sapiens
  misc_feature 1..33: note = chr14:38060644-38060677
  misc_feature 1..33: note = hyper
  source 1..33: mol_type = genomic DNA
gctcctggtggtcaccgaggcgctgcctagagg

SEQ ID NO: 55898 - skipped

SEQ ID NO: 55899 - DNA, 45 bp, Homo sapiens; identical to SEQ ID NO: 35254
  misc_feature 1..45: note = chr14:38062015-38062060
  misc_feature 1..45: note = hyper
  source 1..45: mol_type = genomic DNA

SEQ ID NO: 55900 - DNA, 128 bp, Homo sapiens; identical to SEQ ID NO: 35255
  misc_feature 1..128: note = chr14:38072551-38072679
  misc_feature 1..128: note = hyper
  source 1..128: mol_type = genomic DNA

SEQ ID NO: 55901 - DNA, 42 bp, Homo sapiens; identical to SEQ ID NO: 35256
  misc_feature 1..42: note = chr14:38677446-38677488
  misc_feature 1..42: note = hyper
  source 1..42: mol_type = genomic DNA

SEQ ID NO: 55902 - DNA, 30 bp, Homo sapiens; identical to SEQ ID NO: 35257
  misc_feature 1..30: note = chr14:38678172-38678202
  misc_feature 1..30: note = hyper
  source 1..30: mol_type = genomic DNA

SEQ ID NO: 55903 - DNA, 52 bp, Homo sapiens; identical to SEQ ID NO: 35258
  misc_feature 1..52: note = chr14:38678631-38678683
  misc_feature 1..52: note = hyper
  source 1..52: mol_type = genomic DNA

SEQ ID NO: 55904 - DNA, 142 bp, Homo sapiens; identical to SEQ ID NO: 35259
  misc_feature 1..142: note = chr14:38679118-38679260
  misc_feature 1..142: note = hyper
  source 1..142: mol_type = genomic DNA

SEQ ID NO: 55905 - DNA, 136 bp, Homo sapiens; identical to SEQ ID NO: 35260
  misc_feature 1..136: note = chr14:38679744-38679880
  misc_feature 1..136: note = hyper
  source 1..136: mol_type = genomic DNA

SEQ ID NO: 55906 - DNA, 102 bp, Homo sapiens; identical to SEQ ID NO: 21826
  misc_feature 1..102: note = chr14:38725258-38725360
  misc_feature 1..102: note = hyper
  source 1..102: mol_type = genomic DNA

SEQ ID NO: 55907 - DNA, 30 bp, Homo sapiens; identical to SEQ ID NO: 35263
  misc_feature 1..30: note = chr14:42074229-42074259
  misc_feature 1..30: note = hyper
  source 1..30: mol_type = genomic DNA

SEQ ID NO: 55908 - DNA, 70 bp, Homo sapiens
  misc_feature 1..70: note = chr14:42074474-42074544
  misc_feature 1..70: note = hyper
  source 1..70: mol_type = genomic DNA
tctgtggtcttcctgcgcagtccctcagcggctcggagtttggccttccagctctccaactcagatcctg

SEQ ID NO: 55909 - DNA, 183 bp, Homo sapiens; identical to SEQ ID NO: 11850
  misc_feature 1..183: note = chr14:42075097-42075280
  misc_feature 1..183: note = hyper
  source 1..183: mol_type = genomic DNA

SEQ ID NO: 55910 - DNA, 108 bp, Homo sapiens
  misc_feature 1..108: note = chr14:42075480-42075588
  misc_feature 1..108: note = hyper
  source 1..108: mol_type = genomic DNA
accaactgcagtattcgtaatgtctgatgctgagctgagttgattcccaaatataaatgttcttttcagaatccgctcccatctgattagtaagcaaatcaccaccca

SEQ ID NO: 55911 - DNA, 20 bp, Homo sapiens
  misc_feature 1..20: note = chr14:42076803-42076823
  misc_feature 1..20: note = hyper
  source 1..20: mol_type = genomic DNA
gcaaatgtgttaactcggcg

SEQ ID NO: 55912 - DNA, 377 bp, Homo sapiens
  misc_feature 1..377: note = chr14:42076853-42077230
  misc_feature 1..377: note = hyper
  source 1..377: mol_type = genomic DNA
ctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtca

SEQ ID NO: 55913 - DNA, 100 bp, Homo sapiens
  misc_feature 1..100: note = chr14:42077268-42077368
  misc_feature 1..100: note = hyper
  source 1..100: mol_type = genomic DNA
cttgaaggaaacgtgattaaagggctatgcgagaacgctctctttgctgcccgcggtccggtgggcttcgaagccaatcgtgagaaggaccggttccctc

SEQ ID NO: 55914 - DNA, 200 bp, Homo sapiens; identical to SEQ ID NO: 35270
  misc_feature 1..200: note = chr14:42077488-42077688
  misc_feature 1..200: note = hyper
  source 1..200: mol_type = genomic DNA

SEQ ID NO: 55915 - DNA, 490 bp, Homo sapiens
  misc_feature 1..490: note = chr14:42078799-42079289
  misc_feature 1..490: note = hyper
  source 1..490: mol_type = genomic DNA
cgaagacattagaattaacaagataaagcacttccaaagtagtctcatcaatgttttattccatagtgaagacggtctgaataatttaactaaggagtgttcgtttgtctcccgcctttgggagctgcttgctggctacattcagcggaggatttggcccagccaagctcagggtgccctgcttcaggaggcagtgactggggctgctggggggcggggggttctctttgctaacgccgtttaggaagtgtaggggcgctgcctgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacgg

SEQ ID NO: 55916 - DNA, 161 bp, Homo sapiens
  misc_feature 1..161: note = chr14:42079328-42079489
  misc_feature 1..161: note = hyper
  source 1..161: mol_type = genomic DNA
gaccccctggcagacagcaagcgcatcgtggccgaggcggccgcctggatgcgagaggagggagatgcccagagccacagaggagcgtggagggcggtggtgtcctgtctttgcctgcaaaacctttctctctctctccctccccgcgacaatgaatattg

SEQ ID NO: 55917 - DNA, 486 bp, Homo sapiens; identical to SEQ ID NO: 35272
  misc_feature 1..486: note = chr14:48143051-48143537
  misc_feature 1..486: note = hyper
  source 1..486: mol_type = genomic DNA

SEQ ID NO: 55918 - DNA, 102 bp, Homo sapiens; identical to SEQ ID NO: 11855
  misc_feature 1..102: note = chr14:48143617-48143719
  misc_feature 1..102: note = hyper
  source 1..102: mol_type = genomic DNA

SEQ ID NO: 55919 - DNA, 76 bp, Homo sapiens
  misc_feature 1..76: note = chr14:48144623-48144699
  misc_feature 1..76: note = hyper
  source 1..76: mol_type = genomic DNA
gggtccaacagggagcggagtgtgcgtctggagctcgcttgggcacaccagcccagccgccaccgccaccgctctc

SEQ ID NO: 55920 - DNA, 105 bp, Homo sapiens; identical to SEQ ID NO: 21834
  misc_feature 1..105: note = chr14:48145257-48145362
  misc_feature 1..105: note = hyper
  source 1..105: mol_type = genomic DNA

SEQ ID NO: 55921 - DNA, 197 bp, Homo sapiens; identical to SEQ ID NO: 4105
  misc_feature 1..197: note = chr14:48145469-48145666
  misc_feature 1..197: note = hyper
  source 1..197: mol_type = genomic DNA

SEQ ID NO: 55922 - DNA, 171 bp, Homo sapiens; identical to SEQ ID NO: 35279
  misc_feature 1..171: note = chr14:50155136-50155307
  misc_feature 1..171: note = hyper
  source 1..171: mol_type = genomic DNA

SEQ ID NO: 55923 - DNA, 154 bp, Homo sapiens; identical to SEQ ID NO: 35280
  misc_feature 1..154: note = chr14:51026705-51026859
  misc_feature 1..154: note = hyper
  source 1..154: mol_type = genomic DNA

SEQ ID NO: 55924 - DNA, 17 bp, Homo sapiens
  misc_feature 1..17: note = chr14:51338713-51338730
  misc_feature 1..17: note = hyper
  source 1..17: mol_type = genomic DNA
gcgaacagcctgacccg

SEQ ID NO: 55925 - DNA, 49 bp, Homo sapiens; identical to SEQ ID NO: 35282
  misc_feature 1..49: note = chr14:51410296-51410345
  misc_feature 1..49: note = hyper
  source 1..49: mol_type = genomic DNA

SEQ ID NO: 55926 - DNA, 94 bp, Homo sapiens; identical to SEQ ID NO: 35283
  misc_feature 1..94: note = chr14:51410569-51410663
  misc_feature 1..94: note = hyper
  source 1..94: mol_type = genomic DNA

SEQ ID NO: 55927 - DNA, 210 bp, Homo sapiens
  misc_feature 1..210: note = chr14:51561428-51561638
  misc_feature 1..210: note = hyper
  source 1..210: mol_type = genomic DNA
cgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaact

SEQ ID NO: 55928 - DNA, 425 bp, Homo sapiens; identical to SEQ ID NO: 35288
  misc_feature 1..425: note = chr14:51562235-51562660
  misc_feature 1..425: note = hyper
  source 1..425: mol_type = genomic DNA

SEQ ID NO: 55929 - DNA, 17 bp, Homo sapiens
  misc_feature 1..17: note = chr14:52534631-52534648
  misc_feature 1..17: note = hyper
  source 1..17: mol_type = genomic DNA
aggtggccaggaaggcg

SEQ ID NO: 55930 - DNA, 221 bp, Homo sapiens; identical to SEQ ID NO: 21839
  misc_feature 1..221: note = chr14:52534791-52535012
  misc_feature 1..221: note = hyper
  source 1..221: mol_type = genomic DNA

SEQ ID NO: 55931 - DNA, 220 bp, Homo sapiens
  misc_feature 1..220: note = chr14:52734557-52734777
  misc_feature 1..220: note = hyper
  source 1..220: mol_type = genomic DNA
agaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggt

SEQ ID NO: 55932 - DNA, 169 bp, Homo sapiens
  misc_feature 1..169: note = chr14:52735255-52735424
  misc_feature 1..169: note = hyper
  source 1..169: mol_type = genomic DNA
gactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggc

SEQ ID NO: 55933 - DNA, 20 bp, Homo sapiens
  misc_feature 1..20: note = chr14:52735451-52735471
  misc_feature 1..20: note = hyper
  source 1..20: mol_type = genomic DNA
cggatcgggatggacgcggc

SEQ ID NO: 55934 - DNA, 97 bp, Homo sapiens
  misc_feature 1..97: note = chr14:52781428-52781525
  misc_feature 1..97: note = hyper
  source 1..97: mol_type = genomic DNA
gggtgcagcgccggccgcaggagctccctctccttgttccacgtgctggtgaccgagctggtgttcaccgacctgctcgggacctgcctcatcagcc

SEQ ID NO: 55935 - DNA, 61 bp, Homo sapiens
  misc_feature 1..61: note = chr14:52781916-52781977
  misc_feature 1..61: note = hyper
  source 1..61: mol_type = genomic DNA
tgtcattctcaacctcatccgcatgcaccgccgaagccggagaagccgctgcggaccttcc

SEQ ID NO: 55936 - DNA, 233 bp, Homo sapiens; identical to SEQ ID NO: 35302
  misc_feature 1..233: note = chr14:53417159-53417392
  misc_feature 1..233: note = hyper
  source 1..233: mol_type = genomic DNA

SEQ ID NO: 55937 - DNA, 220 bp, Homo sapiens; identical to SEQ ID NO: 21840
  misc_feature 1..220: note = chr14:54422431-54422651
  misc_feature 1..220: note = hyper
  source 1..220: mol_type = genomic DNA

SEQ ID NO: 55938 - DNA, 34 bp, Homo sapiens; identical to SEQ ID NO: 11874
  misc_feature 1..34: note = chr14:54422926-54422960
  misc_feature 1..34: note = hyper
  source 1..34: mol_type = genomic DNA

SEQ ID NO: 55939 - DNA, 57 bp, Homo sapiens; identical to SEQ ID NO: 35305
  misc_feature 1..57: note = chr14:54423406-54423463
  misc_feature 1..57: note = hyper
  source 1..57: mol_type = genomic DNA

SEQ ID NO: 55940 - DNA, 387 bp, Homo sapiens; identical to SEQ ID NO: 35306
  misc_feature 1..387: note = chr14:54430156-54430543
  misc_feature 1..387: note = hyper
  source 1..387: mol_type = genomic DNA

SEQ ID NO: 55941 - DNA, 35 bp, Homo sapiens; identical to SEQ ID NO: 35307
  misc_feature 1..35: note = chr14:54687254-54687289
  misc_feature 1..35: note = hyper
  source 1..35: mol_type = genomic DNA

SEQ ID NO: 55942 - DNA, 83 bp, Homo sapiens
  misc_feature 1..83: note = chr14:57260863-57260946
  misc_feature 1..83: note = hyper
  source 1..83: mol_type = genomic DNA
cattttaggccaattcgttaaaccagccgtctaaacgggccctggcactgggtatccgaccgctccacgcgccagctggtgag

SEQ ID NO: 55943 - DNA, 59 bp, Homo sapiens
  misc_feature 1..59: note = chr14:57261821-57261880
  misc_feature 1..59: note = hyper
  source 1..59: mol_type = genomic DNA
gcaccggagcccgaagtcttccccaccgctggcaggagagccccgcgagctctcccgga

SEQ ID NO: 55944 - DNA, 107 bp, Homo sapiens
  misc_feature 1..107: note = chr14:57261965-57262072
  misc_feature 1..107: note = hyper
  source 1..107: mol_type = genomic DNA
cgcgaaggaggcctcaaccttaggacaacccgggcgtcccgggcgaaggtctcgatctgccggagccactgcctttcaggcatcgctccattaaagccagggaggag

SEQ ID NO: 55945 - DNA, 248 bp, Homo sapiens
  misc_feature 1..248: note = chr14:57263831-57264079
  misc_feature 1..248: note = hyper
  source 1..248: mol_type = genomic DNA
tatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcc

SEQ ID NO: 55946 - DNA, 42 bp, Homo sapiens
  misc_feature 1..42: note = chr14:57265240-57265282
  misc_feature 1..42: note = hyper
  source 1..42: mol_type = genomic DNA
gccagcccagagagaaaggggaaaacccggcaaggcaagagc

SEQ ID NO: 55947 - DNA, 160 bp, Homo sapiens; identical to SEQ ID NO: 35315
  misc_feature 1..160: note = chr14:57265517-57265677
  misc_feature 1..160: note = hyper
  source 1..160: mol_type = genomic DNA

SEQ ID NO: 55948 - DNA, 30 bp, Homo sapiens; identical to SEQ ID NO: 35318
  misc_feature 1..30: note = chr14:57271654-57271684
  misc_feature 1..30: note = hyper
  source 1..30: mol_type = genomic DNA

SEQ ID NO: 55949 - DNA, 37 bp, Homo sapiens
  misc_feature 1..37: note = chr14:57272067-57272104
  misc_feature 1..37: note = hyper
  source 1..37: mol_type = genomic DNA
gctcacttacccgggtagcccacggaggggtgcagca

SEQ ID NO: 55950 - DNA, 77 bp, Homo sapiens; identical to SEQ ID NO: 35320
  misc_feature 1..77: note = chr14:57272324-57272401
  misc_feature 1..77: note = hyper
  source 1..77: mol_type = genomic DNA

SEQ ID NO: 55951 - DNA, 30 bp, Homo sapiens; identical to SEQ ID NO: 11888
  misc_feature 1..30: note = chr14:57273051-57273081
  misc_feature 1..30: note = hyper
  source 1..30: mol_type = genomic DNA

SEQ ID NO: 55952 - DNA, 69 bp, Homo sapiens; identical to SEQ ID NO: 21848
  misc_feature 1..69: note = chr14:57274417-57274486
  misc_feature 1..69: note = hyper
  source 1..69: mol_type = genomic DNA

SEQ ID NO: 55953 - DNA, 291 bp, Homo sapiens
  misc_feature 1..291: note = chr14:57275305-57275596
  misc_feature 1..291: note = hyper
  source 1..291: mol_type = genomic DNA
gtctaccttactctggggggaggagttccctctcctactcccctctgttgctaataacttttggtgcctgtaaaaagtcccgagctgagcaggagaaatcctgaccccgaagctctaggatggaggggagaatttctaggagcgacttccccgtcccctccccaagcaatccaccaccgcagggtcggcgccgctcggccttcgctccccgcgcaccagttctatctgtgaaggaagcaaaagccaactcggtggaatcctgacaggggacttgggtttccaaaaatatgt

SEQ ID NO: 55954 - DNA, 336 bp, Homo sapiens; identical to SEQ ID NO: 21850
  misc_feature 1..336: note = chr14:57276104-57276440
  misc_feature 1..336: note = hyper
  source 1..336: mol_type = genomic DNA

SEQ ID NO: 55955 - DNA, 214 bp, Homo sapiens
  misc_feature 1..214: note = chr14:57276666-57276880
  misc_feature 1..214: note = hyper
  source 1..214: mol_type = genomic DNA
tcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttacctta

SEQ ID NO: 55956 - DNA, 126 bp, Homo sapiens; identical to SEQ ID NO: 35328
  misc_feature 1..126: note = chr14:57281138-57281264
  misc_feature 1..126: note = hyper
  source 1..126: mol_type = genomic DNA

SEQ ID NO: 55957 - DNA, 15 bp, Homo sapiens
  misc_feature 1..15: note = chr14:57283299-57283314
  misc_feature 1..15: note = hyper
  source 1..15: mol_type = genomic DNA
catacctgagataca

SEQ ID NO: 55958 - DNA, 82 bp, Homo sapiens
  misc_feature 1..82: note = chr14:58332215-58332297
  misc_feature 1..82: note = hyper
  source 1..82: mol_type = genomic DNA
ctgggcgcacccagccgggccccttgccctctcacggttcagcaccgaggacagcggacatacttttctccccggggggtcc

SEQ ID NO: 55959 - DNA, 68 bp, Homo sapiens; identical to SEQ ID NO: 11902
  misc_feature 1..68: note = chr14:58332640-58332708
  misc_feature 1..68: note = hyper
  source 1..68: mol_type = genomic DNA

SEQ ID NO: 55960 - DNA, 100 bp, Homo sapiens; identical to SEQ ID NO: 35334
  misc_feature 1..100: note = chr14:58618341-58618441
  misc_feature 1..100: note = hyper
  source 1..100: mol_type = genomic DNA

SEQ ID NO: 55961 - DNA, 158 bp, Homo sapiens; identical to SEQ ID NO: 35335
  misc_feature 1..158: note = chr14:59931281-59931439
  misc_feature 1..158: note = hyper
  source 1..158: mol_type = genomic DNA

SEQ ID NO: 55962 - DNA, 334 bp, Homo sapiens; identical to SEQ ID NO: 35336
  misc_feature 1..334: note = chr14:60043273-60043607
  misc_feature 1..334: note = hyper
  source 1..334: mol_type = genomic DNA

SEQ ID NO: 55963 - DNA, 44 bp, Homo sapiens; identical to SEQ ID NO: 21856
  misc_feature 1..44: note = chr14:60097566-60097610
  misc_feature 1..44: note = hyper
  source 1..44: mol_type = genomic DNA

SEQ ID NO: 55964 - DNA, 77 bp, Homo sapiens; identical to SEQ ID NO: 35339
  misc_feature 1..77: note = chr14:60336952-60337029
  misc_feature 1..77: note = hyper
  source 1..77: mol_type = genomic DNA

SEQ ID NO: 55965 - DNA, 16 bp, Homo sapiens
  misc_feature 1..16: note = chr14:60386034-60386050
  misc_feature 1..16: note = hyper
  source 1..16: mol_type = genomic DNA
atccagagaacgacac

SEQ ID NO: 55966 - DNA, 156 bp, Homo sapiens
  misc_feature 1..156: note = chr14:60386051-60386207
  misc_feature 1..156: note = hyper
  source 1..156: mol_type = genomic DNA
agacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaa

SEQ ID NO: 55967 - DNA, 386 bp, Homo sapiens
  misc_feature 1..386: note = chr14:60386252-60386638
  misc_feature 1..386: note = hyper
  source 1..386: mol_type = genomic DNA
ttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctg

SEQ ID NO: 55968 - DNA, 18 bp, Homo sapiens
  misc_feature 1..18: note = chr14:60386701-60386719
  misc_feature 1..18: note = hyper
  source 1..18: mol_type = genomic DNA
ttccgctgattggttgga

SEQ ID NO: 55969 - DNA, 162 bp, Homo sapiens; identical to SEQ ID NO: 21859
  misc_feature 1..162: note = chr14:60794473-60794635
  misc_feature 1..162: note = hyper
  source 1..162: mol_type = genomic DNA

SEQ ID NO: 55970 - DNA, 164 bp, Homo sapiens
  misc_feature 1..164: note = chr14:60794667-60794831
  misc_feature 1..164: note = hyper
  source 1..164: mol_type = genomic DNA
gcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctcc

SEQ ID NO: 55971 - DNA, 373 bp, Homo sapiens
  misc_feature 1..373: note = chr14:60973324-60973697
  misc_feature 1..373: note = hyper
  source 1..373: mol_type = genomic DNA
ttgggttaataaaattaaatcaagtcccttgcgatggcgaagatggatctcctgatagtagtccccaacctccaggcacttctcagtcccttcctgccaagccaccagacagtgctcctactctgccacacgcagcccgcacccttctggcggctcccgcgaggccaactcagactctcagttccagttgcccgcgagcctcagacacgcagaagctaaagcgccctcatctaattatttgcagaactattatccaagaaatgggccatgggataaatattcccatttcctggatggggcccctagactgtccacttgctcacaaagattaagggtaagaaaccagctctccccgaatgtgccgcttccaaac

SEQ ID NO: 55972 - DNA, 15 bp, Homo sapiens
  misc_feature 1..15: note = chr14:60974077-60974092
  misc_feature 1..15: note = hyper
  source 1..15: mol_type = genomic DNA
cgatgtttctttcta

SEQ ID NO: 55973 - DNA, 12 bp, Homo sapiens
  misc_feature 1..12: note = chr14:60974403-60974415
  misc_feature 1..12: note = hyper
  source 1..12: mol_type = genomic DNA
cacctccaacca

SEQ ID NO: 55974 - DNA, 96 bp, Homo sapiens
  misc_feature 1..96: note = chr14:60976514-60976610
  misc_feature 1..96: note = hyper
  source 1..96: mol_type = genomic DNA
ctgcttcaaggagcgcacgcggcacctgctacgcgagtggtacctgcaggatccataccctaaccccagcaaaaaacgtgagctcgcccaggcaac

SEQ ID NO: 55975 - DNA, 142 bp, Homo sapiens
  misc_feature 1..142: note = chr14:60978147-60978289
  misc_feature 1..142: note = hyper
  source 1..142: mol_type = genomic DNA
ggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattc

SEQ ID NO: 55976 - DNA, 408 bp, Homo sapiens; identical to SEQ ID NO: 21862
  misc_feature 1..408: note = chr14:60981268-60981676
  misc_feature 1..408: note = hyper
  source 1..408: mol_type = genomic DNA

SEQ ID NO: 55977 - DNA, 20 bp, Homo sapiens
  misc_feature 1..20: note = chr14:60981793-60981813
  misc_feature 1..20: note = hyper
  source 1..20: mol_type = genomic DNA
tcattgtccgcgcgctggcc

SEQ ID NO: 55978 - DNA, 138 bp, Homo sapiens
  misc_feature 1..138: note = chr14:60981972-60982110
  misc_feature 1..138: note = hyper
  source 1..138: mol_type = genomic DNA
cggtccgctcccaaagagaagcccagactgggcccacagtacccgggaaggtgagtccttactcgggggcccagatctccccacggaggccacagatctgggtccccgaggaaggagagccccccttttcgcgcaccc

SEQ ID NO: 55979 - DNA, 219 bp, Homo sapiens
  misc_feature 1..219: note = chr14:60982622-60982841
  misc_feature 1..219: note = hyper
  source 1..219: mol_type = genomic DNA
accgcatgttcgcgatagcacatttgagccctggcaggccacctgggccgccttctttcggaaaccttgcggggtttccaagcaaggtttacaatgggaaactttatttcccattgtaagctcttacaaatctcctctggctagatccttccttgcagctctctttgctaggatttatattcccaaacttcttcagacgtgccctaccgcgagggaacg

SEQ ID NO: 55980 - DNA, 88 bp, Homo sapiens
  misc_feature 1..88: note = chr14:60982911-60982999
  misc_feature 1..88: note = hyper
  source 1..88: mol_type = genomic DNA
acaagcagtttcacgcctccctgcccgctcatgctgtttccgcttgccctgtggtttgctctgcctggaacgccgccccctacctcaa

SEQ ID NO: 55981 - DNA, 15 bp, Homo sapiens
  misc_feature 1..15: note = chr14:61104140-61104155
  misc_feature 1..15: note = hyper
  source 1..15: mol_type = genomic DNA
cctaccccccagtgc

SEQ ID NO: 55982 - DNA, 50 bp, Homo sapiens; identical to SEQ ID NO: 21864
  misc_feature 1..50: note = chr14:61104241-61104291
  misc_feature 1..50: note = hyper
  source 1..50: mol_type = genomic DNA

SEQ ID NO: 55983 - DNA, 369 bp, Homo sapiens
  misc_feature 1..369: note = chr14:61109470-61109839
  misc_feature 1..369: note = hyper
  source 1..369: mol_type = genomic DNA
caatggcaagaacagcctccgaagtgcgcggatgacaggaaaagatcttcagttcttctgccgctagagaagtgcgggatacaagcctctattggatccacaacctggagtcctgccttcggactttgccaaagacttgcaggcggtggggaggcagtaggaaatgaagccccctccagcctcagccgccgccgcgttcggtgcagcagcagcagtgccactgccacagagcagaggaaggcccgctccgcgcgagttctgtgccaggtgtcccgttggccctcagcggacaagggagagccgctaataagggtcgctgctcagcaaactcagagctcatccataagtgccaacgccactgcttctttc

SEQ ID NO: 55984 - DNA, 25 bp, Homo sapiens
  misc_feature 1..25: note = chr14:61110243-61110268
  misc_feature 1..25: note = hyper
  source 1..25: mol_type = genomic DNA
agaggagaaacgaaaagtggcttta

SEQ ID NO: 55985 - DNA, 266 bp, Homo sapiens
  misc_feature 1..266: note = chr14:61114456-61114722
  misc_feature 1..266: note = hyper
  source 1..266: mol_type = genomic DNA
gccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgaggatcaaccctt

SEQ ID NO: 55986 - DNA, 314 bp, Homo sapiens; identical to SEQ ID NO: 21867
  misc_feature 1..314: note = chr14:61114997-61115311
  misc_feature 1..314: note = hyper
  source 1..314: mol_type = genomic DNA

SEQ ID NO: 55987 - DNA, 532 bp, Homo sapiens
  misc_feature 1..532: note = chr14:61115517-61116049
  misc_feature 1..532: note = hyper
  source 1..532: mol_type = genomic DNA
gcagtagctggtctcctcgccgtcccagatggtgcgcggcagtggaaattttcggcgcacccgatatttgcccacggcgcccaggggtcggccgcgcagcttctcggcctccacgtaatgcgccttcagccacagttgctgcagtttggggtggttgtgaggcgagaactggtggctctccaggatcttgtagagctcacggaagttgccgcggtggaaggcgaccaccgccttggccttgagtacgctctcgttcttgtgcaggtggtcgcaggcgggcagtgaccacaggaacctgcccaggcgctccaggtttccgccttgctgcagaacctcgcacacgcacgccacttgctcctgcgtaaagccaaacgacggcagcatcgacatggctggggcctgccggggcgcacggcccaggcgcacgcggcagggagcagagccgagaggcagggggcggcggccgcagggaggggggcgcggctgttcctaacctcctccttaggctttgcaaaggcgaaaaccggagtcg

SEQ ID NO: 55988 - DNA, 122 bp, Homo sapiens; identical to SEQ ID NO: 35362
  misc_feature 1..122: note = chr14:61116488-61116610
  misc_feature 1..122: note = hyper
  source 1..122: mol_type = genomic DNA

SEQ ID NO: 55989 - DNA, 153 bp, Homo sapiens; identical to SEQ ID NO: 35363
  misc_feature 1..153: note = chr14:61116875-61117028
  misc_feature 1..153: note = hyper
  source 1..153: mol_type = genomic DNA

SEQ ID NO: 55990 - DNA, 187 bp, Homo sapiens
  misc_feature 1..187: note = chr14:61118778-61118965
  misc_feature 1..187: note = hyper
  source 1..187: mol_type = genomic DNA
aggccgtgactgggccggccaacatttttcctcccgcttaatccaatagatcgcgtaactggaaagggaaagtgctatgcgctttataccaaggagtctacctgctatttcgatccctcggttaggggaaccaattgttataaatgttaattattggctcggatatataaggtttcccaaaatggaa

SEQ ID NO: 55991 - DNA, 70 bp, Homo sapiens; identical to SEQ ID NO: 35365
  misc_feature 1..70: note = chr14:61124556-61124626
  misc_feature 1..70: note = hyper
  source 1..70: mol_type = genomic DNA

SEQ ID NO: 55992 - DNA, 155 bp, Homo sapiens; identical to SEQ ID NO: 35366
  misc_feature 1..155: note = chr14:61188472-61188627
  misc_feature 1..155: note = hyper
  source 1..155: mol_type = genomic DNA

SEQ ID NO: 55993 - DNA, 50 bp, Homo sapiens; identical to SEQ ID NO: 35367
  misc_feature 1..50: note = chr14:61655782-61655832
  misc_feature 1..50: note = hyper
  source 1..50: mol_type = genomic DNA

SEQ ID NO: 55994 - DNA, 39 bp, Homo sapiens; identical to SEQ ID NO: 35368
  misc_feature 1..39: note = chr14:61748115-61748154
  misc_feature 1..39: note = hyper
  source 1..39: mol_type = genomic DNA

SEQ ID NO: 55995 - DNA, 42 bp, Homo sapiens; identical to SEQ ID NO: 35369
  misc_feature 1..42: note = chr14:61788181-61788223
  misc_feature 1..42: note = hyper
  source 1..42: mol_type = genomic DNA

SEQ ID NO: 55996 - DNA, 483 bp, Homo sapiens; identical to SEQ ID NO: 35370
  misc_feature 1..483: note = chr14:61788722-61789205
  misc_feature 1..483: note = hyper
  source 1..483: mol_type = genomic DNA

SEQ ID NO: 55997 - DNA, 154 bp, Homo sapiens; identical to SEQ ID NO: 4151
  misc_feature 1..154: note = chr14:62279322-62279476
  misc_feature 1..154: note = hyper
  source 1..154: mol_type = genomic DNA

SEQ ID NO: 55998 - DNA, 59 bp, Homo sapiens; identical to SEQ ID NO: 21873
  misc_feature 1..59: note = chr14:62279519-62279578
  misc_feature 1..59: note = hyper
  source 1..59: mol_type = genomic DNA

SEQ ID NO: 55999 - DNA, 95 bp, Homo sapiens
  misc_feature 1..95: note = chr14:62583714-62583809
  misc_feature 1..95: note = hyper
  source 1..95: mol_type = genomic DNA
ccctctccccaaacccgacctccgtaggggacaccgagccaaggcctgcagcgagtgacctgcccggggaggcgcgggaccgaggctcacctacc

SEQ ID NO: 56000 - DNA, 360 bp, Homo sapiens; identical to SEQ ID NO: 35376
  misc_feature 1..360: note = chr14:62583918-62584278
  misc_feature 1..360: note = hyper
  source 1..360: mol_type = genomic DNA

SEQ ID NO: 56001 - DNA, 13 bp, Homo sapiens
  misc_feature 1..13: note = chr14:62584279-62584292
  misc_feature 1..13: note = hyper
  source 1..13: mol_type = genomic DNA
atctggtgagtgg

SEQ ID NO: 56002 - DNA, 151 bp, Homo sapiens; identical to SEQ ID NO: 35378
  misc_feature 1..151: note = chr14:63511856-63512007
  misc_feature 1..151: note = hyper
  source 1..151: mol_type = genomic DNA

SEQ ID NO: 56003 - DNA, 37 bp, Homo sapiens; identical to SEQ ID NO: 21877
  misc_feature 1..37: note = chr14:63512063-63512100
  misc_feature 1..37: note = hyper
  source 1..37: mol_type = genomic DNA

SEQ ID NO: 56004 - DNA, 282 bp, Homo sapiens; identical to SEQ ID NO: 21878
  misc_feature 1..282: note = chr14:63512291-63512573
  misc_feature 1..282: note = hyper
  source 1..282: mol_type = genomic DNA

SEQ ID NO: 56005 - DNA, 308 bp, Homo sapiens
  misc_feature 1..308: note = chr14:63512816-63513124
  misc_feature 1..308: note = hyper
  source 1..308: mol_type = genomic DNA
ccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgcca

SEQ ID NO: 56006 - DNA, 30 bp, Homo sapiens; identical to SEQ ID NO: 35381
  misc_feature 1..30: note = chr14:63670862-63670892
  misc_feature 1..30: note = hyper
  source 1..30: mol_type = genomic DNA

SEQ ID NO: 56007 - DNA, 30 bp, Homo sapiens; identical to SEQ ID NO: 35382
  misc_feature 1..30: note = chr14:64760774-64760804
  misc_feature 1..30: note = hyper
  source 1..30: mol_type = genomic DNA

SEQ ID NO: 56008 - DNA, 66 bp, Homo sapiens; identical to SEQ ID NO: 11941
  misc_feature 1..66: note = chr14:64761073-64761139
  misc_feature 1..66: note = hyper
  source 1..66: mol_type = genomic DNA

SEQ ID NO: 56009 - DNA, 226 bp, Homo sapiens; identical to SEQ ID NO: 35384
  misc_feature 1..226: note = chr14:65007311-65007537
  misc_feature 1..226: note = hyper
  source 1..226: mol_type = genomic DNA

SEQ ID NO: 56010 - DNA, 39 bp, Homo sapiens; identical to SEQ ID NO: 35385
  misc_feature 1..39: note = chr14:65007552-65007591
  misc_feature 1..39: note = hyper
  source 1..39: mol_type = genomic DNA

SEQ ID NO: 56011 - DNA, 62 bp, Homo sapiens
  misc_feature 1..62: note = chr14:65009193-65009255
  misc_feature 1..62: note = hyper
  source 1..62: mol_type = genomic DNA
aacgccctggagtcctatacctacaacatcaagcagacggtggaagacgagaaactgagggg

SEQ ID NO: 56012 - DNA, 315 bp, Homo sapiens; identical to SEQ ID NO: 35387
  misc_feature 1..315: note = chr14:65016501-65016816
  misc_feature 1..315: note = hyper
  source 1..315: mol_type = genomic DNA

SEQ ID NO: 56013 - DNA, 30 bp, Homo sapiens; identical to SEQ ID NO: 35388
  misc_feature 1..30: note = chr14:65170683-65170713
  misc_feature 1..30: note = hyper
  source 1..30: mol_type = genomic DNA

SEQ ID NO: 56014 - DNA, 52 bp, Homo sapiens; identical to SEQ ID NO: 35389
  misc_feature 1..52: note = chr14:65170984-65171036
  misc_feature 1..52: note = hyper
  source 1..52: mol_type = genomic DNA

SEQ ID NO: 56015 - DNA, 38 bp, Homo sapiens; identical to SEQ ID NO: 35390
  misc_feature 1..38: note = chr14:65345951-65345989
  misc_feature 1..38: note = hyper
  source 1..38: mol_type = genomic DNA

SEQ ID NO: 56016 - DNA, 30 bp, Homo sapiens; identical to SEQ ID NO: 35391
  misc_feature 1..30: note = chr14:67878885-67878915
  misc_feature 1..30: note = hyper
  source 1..30: mol_type = genomic DNA

SEQ ID NO: 56017 - DNA, 308 bp, Homo sapiens; identical to SEQ ID NO: 35392
  misc_feature 1..308: note = chr14:69726355-69726663
  misc_feature 1..308: note = hyper
  source 1..308: mol_type = genomic DNA

SEQ ID NO: 56018 - DNA, 521 bp, Homo sapiens; identical to SEQ ID NO: 35393
  misc_feature 1..521: note = chr14:69727096-69727617
  misc_feature 1..521: note = hyper
  source 1..521: mol_type = genomic DNA

SEQ ID NO: 56019 - DNA, 81 bp, Homo sapiens; identical to SEQ ID NO: 35394
  misc_feature 1..81: note = chr14:69727831-69727912
  misc_feature 1..81: note = hyper
  source 1..81: mol_type = genomic DNA

SEQ ID NO: 56020 - DNA, 58 bp, Homo sapiens; identical to SEQ ID NO: 35395
  misc_feature 1..58: note = chr14:69950779-69950837
  misc_feature 1..58: note = hyper
  source 1..58: mol_type = genomic DNA

SEQ ID NO: 56021 - DNA, 30 bp, Homo sapiens; identical to SEQ ID NO: 35396
  misc_feature 1..30: note = chr14:69951121-69951151
  misc_feature 1..30: note = hyper
  source 1..30: mol_type = genomic DNA

SEQ ID NO: 56022 - DNA, 100 bp, Homo sapiens
  misc_feature 1..100: note = chr14:70014623-70014723
  misc_feature 1..100: note = hyper
  source 1..100: mol_type = genomic DNA
agggtgggcgagacacggccgccttccttcacatccaacgccggtgaggctcagcactcattgtctcactggcagcacagacaaagccttgcgggctcca

SEQ ID NO: 56023 - DNA, 116 bp, Homo sapiens; identical to SEQ ID NO: 21888
  misc_feature 1..116: note = chr14:70346020-70346136
  misc_feature 1..116: note = hyper
  source 1..116: mol_type = genomic DNA

SEQ ID NO: 56024 - DNA, 39 bp, Homo sapiens; identical to SEQ ID NO: 21889
  misc_feature 1..39: note = chr14:70346491-70346530
  misc_feature 1..39: note = hyper
  source 1..39: mol_type = genomic DNA

SEQ ID NO: 56025 - DNA, 40 bp, Homo sapiens; identical to SEQ ID NO: 35399
  misc_feature 1..40: note = chr14:70346833-70346873
  misc_feature 1..40: note = hyper
  source 1..40: mol_type = genomic DNA

SEQ ID NO: 56026 - DNA, 147 bp, Homo sapiens; identical to SEQ ID NO: 35400
  misc_feature 1..147: note = chr14:70653698-70653845
  misc_feature 1..147: note = hyper
  source 1..147: mol_type = genomic DNA

SEQ ID NO: 56027 - DNA, 227 bp, Homo sapiens; identical to SEQ ID NO: 35401
  misc_feature 1..227: note = chr14:70654063-70654290
  misc_feature 1..227: note = hyper
  source 1..227: mol_type = genomic DNA

SEQ ID NO: 56028 - DNA, 42 bp, Homo sapiens; identical to SEQ ID NO: 35402
  misc_feature 1..42: note = chr14:70654291-70654333
  misc_feature 1..42: note = hyper
  source 1..42: mol_type = genomic DNA

SEQ ID NO: 56029 - DNA, 74 bp, Homo sapiens; identical to SEQ ID NO: 21893
  misc_feature 1..74: note = chr14:70654713-70654787
  misc_feature 1..74: note = hyper
  source 1..74: mol_type = genomic DNA

SEQ ID NO: 56030 - DNA, 498 bp, Homo sapiens; identical to SEQ ID NO: 21894
  misc_feature 1..498: note = chr14:70655032-70655530
  misc_feature 1..498: note = hyper
  source 1..498: mol_type = genomic DNA

SEQ ID NO: 56031 - DNA, 40 bp, Homo sapiens
  misc_feature 1..40: note = chr14:70656090-70656130
  misc_feature 1..40: note = hyper
  source 1..40: mol_type = genomic DNA
cctcaggagacgctgcctgcaattccgaaattaagtctcc

SEQ ID NO: 56032 - DNA, 112 bp, Homo sapiens
  misc_feature 1..112: note = chr14:72398631-72398743
  misc_feature 1..112: note = hyper
  source 1..112: mol_type = genomic DNA
aatacataaaaatgacgaggttaggaacaatatcgctgacggtcgcggtgtcccgttttaatttagagggcgccagcaacacgtcagtgagggagattcagaagccgccggg

SEQ ID NO: 56033 - DNA, 214 bp, Homo sapiens; identical to SEQ ID NO: 21896
  misc_feature 1..214: note = chr14:72399019-72399233
  misc_feature 1..214: note = hyper
  source 1..214: mol_type = genomic DNA

SEQ ID NO: 56034 - DNA, 149 bp, Homo sapiens
  misc_feature 1..149: note = chr14:72399780-72399929
  misc_feature 1..149: note = hyper
  source 1..149: mol_type = genomic DNA
tgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctggg

SEQ ID NO: 56035 - DNA, 210 bp, Homo sapiens
  misc_feature 1..210: note = chr14:72400029-72400239
  misc_feature 1..210: note = hyper
  source 1..210: mol_type = genomic DNA
tttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaaga

SEQ ID NO: 56036 - DNA, 76 bp, Homo sapiens; identical to SEQ ID NO: 35411
  misc_feature 1..76: note = chr14:73358964-73359040
  misc_feature 1..76: note = hyper
  source 1..76: mol_type = genomic DNA

SEQ ID NO: 56037 - DNA, 88 bp, Homo sapiens; identical to SEQ ID NO: 35412
  misc_feature 1..88: note = chr14:74208209-74208297
  misc_feature 1..88: note = hyper
  source 1..88: mol_type = genomic DNA

SEQ ID NO: 56038 - DNA, 176 bp, Homo sapiens; identical to SEQ ID NO: 35413
  misc_feature 1..176: note = chr14:74254402-74254578
  misc_feature 1..176: note = hyper
  source 1..176: mol_type = genomic DNA

SEQ ID NO: 56039 - DNA, 175 bp, Homo sapiens; identical to SEQ ID NO: 21898
  misc_feature 1..175: note = chr14:74706222-74706397
  misc_feature 1..175: note = hyper
  source 1..175: mol_type = genomic DNA

SEQ ID NO: 56040 - DNA, 38 bp, Homo sapiens; identical to SEQ ID NO: 21899
  misc_feature 1..38: note = chr14:74707873-74707911
  misc_feature 1..38: note = hyper
  source 1..38: mol_type = genomic DNA

SEQ ID NO: 56041 - DNA, 464 bp, Homo sapiens; identical to SEQ ID NO: 35418
  misc_feature 1..464: note = chr14:74707912-74708376
  misc_feature 1..464: note = hyper
  source 1..464: mol_type = genomic DNA

SEQ ID NO: 56042 - DNA, 88 bp, Homo sapiens
  misc_feature 1..88: note = chr14:74708774-74708862
  misc_feature 1..88: note = hyper
  source 1..88: mol_type = genomic DNA
cccttccgcaccagccgcactgctaccagttccttgggtacatttgtaaggtggttttcaaggaaataaaggagaaagaaccaaaaat

SEQ ID NO: 56043 - DNA, 137 bp, Homo sapiens
  misc_feature 1..137: note = chr14:74708955-74709092
  misc_feature 1..137: note = hyper
  source 1..137: mol_type = genomic DNA
gggccgccacagactctgcgccctttcaagacatttctccactagggcgttctctggcacccccgccgccacatcgttttctcccaccctaatttgttttcagcctctttgcaccctctctgcgcttttctatgctt

SEQ ID NO: 56044 - DNA, 30 bp, Homo sapiens; identical to SEQ ID NO: 35420
  misc_feature 1..30: note = chr14:74725251-74725281
  misc_feature 1..30: note = hyper
  source 1..30: mol_type = genomic DNA

SEQ ID NO: 56045 - DNA, 182 bp, Homo sapiens; identical to SEQ ID NO: 35421
  misc_feature 1..182: note = chr14:74892589-74892771
  misc_feature 1..182: note = hyper
  source 1..182: mol_type = genomic DNA

SEQ ID NO: 56046 - DNA, 18 bp, Homo sapiens
  misc_feature 1..18: note = chr14:74892798-74892816
  misc_feature 1..18: note = hyper
  source 1..18: mol_type = genomic DNA
cgccgccgcccgccccgc

SEQ ID NO: 56047 - DNA, 17 bp, Homo sapiens
  misc_feature 1..17: note = chr14:74893057-74893074
  misc_feature 1..17: note = hyper
  source 1..17: mol_type = genomic DNA
gaagtcgggggagcccg

SEQ ID NO: 56048 - DNA, 275 bp, Homo sapiens
  misc_feature 1..275: note = chr14:75077895-75078170
  misc_feature 1..275: note = hyper
  source 1..275: mol_type = genomic DNA
tgcgaaaggatttaacgtcggggctccgggagagttggtaagaaaggatgaggatgatgatctatctgccttcaactcttcgaaagcggatcaaatcttccaatcccgattttggaacctcggggctgtttcccgaagtactaaagacagagggacgagggtatgagagcggcgccctctcctctcgcctgcacgcccctccacaaatgagccctggctcccctctgtaccctccaaacttccctctcccatgctcaccccgtgagccgccctcg

SEQ ID NO: 56049 - DNA, 247 bp, Homo sapiens; identical to SEQ ID NO: 35425
  misc_feature 1..247: note = chr14:75078651-75078898
  misc_feature 1..247: note = hyper
  source 1..247: mol_type = genomic DNA

SEQ ID NO: 56050 - DNA, 107 bp, Homo sapiens
  misc_feature 1..107: note = chr14:76604575-76604682
  misc_feature 1..107: note = hyper
  source 1..107: mol_type = genomic DNA
tagagagattcagcccggacaatcagggttggcttcacggaggagggggtatctgagctgagctttgatgaatacgtcagatttgggggaaaggttgctgctggata

SEQ ID NO: 56051 - DNA, 89 bp, Homo sapiens; identical to SEQ ID NO: 21905
  misc_feature 1..89: note = chr14:76604716-76604805
  misc_feature 1..89: note = hyper
  source 1..89: mol_type = genomic DNA

SEQ ID NO: 56052 - DNA, 32 bp, Homo sapiens; identical to SEQ ID NO: 21906
  misc_feature 1..32: note = chr14:76605040-76605072
  misc_feature 1..32: note = hyper
  source 1..32: mol_type = genomic DNA

SEQ ID NO: 56053 - DNA, 89 bp, Homo sapiens
  misc_feature 1..89: note = chr14:76605376-76605465
  misc_feature 1..89: note = hyper
  source 1..89: mol_type = genomic DNA
cactcccaggggcccagggaaaatttgcagttattatgaaggagatgagacagattaaaagcccttgtgttcgccgctttgccccttta

SEQ ID NO: 56054 - DNA, 109 bp, Homo sapiens; identical to SEQ ID NO: 35428
  misc_feature 1..109: note = chr14:76795936-76796045
  misc_feature 1..109: note = hyper
  source 1..109: mol_type = genomic DNA

SEQ ID NO: 56055 - DNA, 92 bp, Homo sapiens; identical to SEQ ID NO: 11971
  misc_feature 1..92: note = chr14:76819300-76819392
  misc_feature 1..92: note = hyper
  source 1..92: mol_type = genomic DNA

SEQ ID NO: 56056 - DNA, 84 bp, Homo sapiens; identical to SEQ ID NO: 35430
  misc_feature 1..84: note = chr14:76842636-76842720
  misc_feature 1..84: note = hyper
  source 1..84: mol_type = genomic DNA

SEQ ID NO: 56057 - DNA, 202 bp, Homo sapiens; identical to SEQ ID NO: 35431
  misc_feature 1..202: note = chr14:76843184-76843386
  misc_feature 1..202: note = hyper
  source 1..202: mol_type = genomic DNA

SEQ ID NO: 56058 - DNA, 10 bp, Homo sapiens
  misc_feature 1..10: note = chr14:76843732-76843742
  misc_feature 1..10: note = hyper
  source 1..10: mol_type = genomic DNA
cgctccacct

SEQ ID NO: 56059 - DNA, 41 bp, Homo sapiens; identical to SEQ ID NO: 21909
  misc_feature 1..41: note = chr14:76843953-76843994
  misc_feature 1..41: note = hyper
  source 1..41: mol_type = genomic DNA

SEQ ID NO: 56060 - DNA, 187 bp, Homo sapiens; identical to SEQ ID NO: 35433
  misc_feature 1..187: note = chr14:77227599-77227786
  misc_feature 1..187: note = hyper
  source 1..187: mol_type = genomic DNA

SEQ ID NO: 56061 - DNA, 239 bp, Homo sapiens; identical to SEQ ID NO: 35434
  misc_feature 1..239: note = chr14:77228556-77228795
  misc_feature 1..239: note = hyper
  source 1..239: mol_type = genomic DNA

SEQ ID NO: 56062 - DNA, 308 bp, Homo sapiens; identical to SEQ ID NO: 35435
  misc_feature 1..308: note = chr14:77591237-77591545
  misc_feature 1..308: note = hyper
  source 1..308: mol_type = genomic DNA

SEQ ID NO: 56063 - DNA, 104 bp, Homo sapiens; identical to SEQ ID NO: 35436
  misc_feature 1..104: note = chr14:77600264-77600368
  misc_feature 1..104: note = hyper
  source 1..104: mol_type = genomic DNA

SEQ ID NO: 56064 - DNA, 87 bp, Homo sapiens; identical to SEQ ID NO: 35437
  misc_feature 1..87: note = chr14:77606262-77606349
  misc_feature 1..87: note = hyper
  source 1..87: mol_type = genomic DNA

SEQ ID NO: 56065 - DNA, 99 bp, Homo sapiens; identical to SEQ ID NO: 35438
  misc_feature 1..99: note = chr14:77606757-77606856
  misc_feature 1..99: note = hyper
  source 1..99: mol_type = genomic DNA

SEQ ID NO: 56066 - DNA, 1081 bp, Homo sapiens
  misc_feature 1..1081: note = chr14:77607236-77608317
  misc_feature 1..1081: note = hyper
  source 1..1081: mol_type = genomic DNA
ttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggag

SEQ ID NO: 56067 - DNA, 127 bp, Homo sapiens; identical to SEQ ID NO: 35440
  misc_feature 1..127: note = chr14:77737019-77737146
  misc_feature 1..127: note = hyper
  source 1..127: mol_type = genomic DNA

SEQ ID NO: 56068 - DNA, 65 bp, Homo sapiens; identical to SEQ ID NO: 21917
  misc_feature 1..65: note = chr14:77737147-77737212
  misc_feature 1..65: note = hyper
  source 1..65: mol_type = genomic DNA

SEQ ID NO: 56069 - DNA, 549 bp, Homo sapiens; identical to SEQ ID NO: 35442
  misc_feature 1..549: note = chr14:77964498-77965047
  misc_feature 1..549: note = hyper
  source 1..549: mol_type = genomic DNA

SEQ ID NO: 56070 - DNA, 190 bp, Homo sapiens; identical to SEQ ID NO: 35443
  misc_feature 1..190: note = chr14:77965493-77965683
  misc_feature 1..190: note = hyper
  source 1..190: mol_type = genomic DNA

SEQ ID NO: 56071 - DNA, 30 bp, Homo sapiens; identical to SEQ ID NO: 11983
  misc_feature 1..30: note = chr14:78624601-78624631
  misc_feature 1..30: note = hyper
  source 1..30: mol_type = genomic DNA

SEQ ID NO: 56072 - DNA, 30 bp, Homo sapiens; identical to SEQ ID NO: 35445
  misc_feature 1..30: note = chr14:79745212-79745242
  misc_feature 1..30: note = hyper
  source 1..30: mol_type = genomic DNA

SEQ ID NO: 56073 - DNA, 36 bp, Homo sapiens; identical to SEQ ID NO: 35447
  misc_feature 1..36: note = chr14:85997566-85997602
  misc_feature 1..36: note = hyper
  source 1..36: mol_type = genomic DNA

SEQ ID NO: 56074 - DNA, 10 bp, Homo sapiens
  misc_feature 1..10: note = chr14:85999522-85999532
  misc_feature 1..10: note = hyper
  source 1..10: mol_type = genomic DNA
gctccaggag

SEQ ID NO: 56075 - DNA, 117 bp, Homo sapiens
  misc_feature 1..117: note = chr14:85999613-85999730
  misc_feature 1..117: note = hyper
  source 1..117: mol_type = genomic DNA
aaacatatccgggggtgtcaggaggggtaggggtgggggccgcggcgcctacattagcccggccgcgtcggattgaggcagtagtgtggtctgagcagcctccagacccacgccggg

SEQ ID NO: 56076 - DNA, 59 bp, Homo sapiens; identical to SEQ ID NO: 35453
  misc_feature 1..59: note = chr14:85999838-85999897
  misc_feature 1..59: note = hyper
  source 1..59: mol_type = genomic DNA

SEQ ID NO: 56077 - DNA, 35 bp, Homo sapiens; identical to SEQ ID NO: 35454
  misc_feature 1..35: note = chr14:86000128-86000163
  misc_feature 1..35: note = hyper
  source 1..35: mol_type = genomic DNA

SEQ ID NO: 56078 - DNA, 262 bp, Homo sapiens; identical to SEQ ID NO: 35456
  misc_feature 1..262: note = chr14:88789384-88789646
  misc_feature 1..262: note = hyper
  source 1..262: mol_type = genomic DNA

SEQ ID NO: 56079 - DNA, 171 bp, Homo sapiens; identical to SEQ ID NO: 35457
  misc_feature 1..171: note = chr14:88790076-88790247
  misc_feature 1..171: note = hyper
  source 1..171: mol_type = genomic DNA

SEQ ID NO: 56080 - DNA, 236 bp, Homo sapiens; identical to SEQ ID NO: 35458
  misc_feature 1..236: note = chr14:88790298-88790534
  misc_feature 1..236: note = hyper
  source 1..236: mol_type = genomic DNA

SEQ ID NO: 56081 - DNA, 447 bp, Homo sapiens; identical to SEQ ID NO: 35459
  misc_feature 1..447: note = chr14:88792916-88793363
  misc_feature 1..447: note = hyper
  source 1..447: mol_type = genomic DNA

SEQ ID NO: 56082 - DNA, 30 bp, Homo sapiens; identical to SEQ ID NO: 35460
  misc_feature 1..30: note = chr14:89493162-89493192
  misc_feature 1..30: note = hyper
  source 1..30: mol_type = genomic DNA

SEQ ID NO: 56083 - DNA, 30 bp, Homo sapiens; identical to SEQ ID NO: 35461
  misc_feature 1..30: note = chr14:89493428-89493458
  misc_feature 1..30: note = hyper
  source 1..30: mol_type = genomic DNA

SEQ ID NO: 56084 - DNA, 548 bp, Homo sapiens; identical to SEQ ID NO: 35463
  misc_feature 1..548: note = chr14:90084100-90084648
  misc_feature 1..548: note = hyper
  source 1..548: mol_type = genomic DNA

SEQ ID NO: 56085 - DNA, 110 bp, Homo sapiens; identical to SEQ ID NO: 35464
  misc_feature 1..110: note = chr14:90085840-90085950
  misc_feature 1..110: note = hyper
  source 1..110: mol_type = genomic DNA

SEQ ID NO: 56086 - DNA, 625 bp, Homo sapiens; identical to SEQ ID NO: 35465
  misc_feature 1..625: note = chr14:90526555-90527180
  misc_feature 1..625: note = hyper
  source 1..625: mol_type = genomic DNA

SEQ ID NO: 56087 - DNA, 163 bp, Homo sapiens
  misc_feature 1..163: note = chr14:90527551-90527714
  misc_feature 1..163: note = hyper
  source 1..163: mol_type = genomic DNA
gagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgc

SEQ ID NO: 56088 - DNA, 173 bp, Homo sapiens; identical to SEQ ID NO: 21928
  misc_feature 1..173: note = chr14:90527758-90527931
  misc_feature 1..173: note = hyper
  source 1..173: mol_type = genomic DNA

SEQ ID NO: 56089 - DNA, 519 bp, Homo sapiens; identical to SEQ ID NO: 35467
  misc_feature 1..519: note = chr14:90528183-90528702
  misc_feature 1..519: note = hyper
  source 1..519: mol_type = genomic DNA

SEQ ID NO: 56090 - DNA, 213 bp, Homo sapiens; identical to SEQ ID NO: 35468
  misc_feature 1..213: note = chr14:90528934-90529147
  misc_feature 1..213: note = hyper
  source 1..213: mol_type = genomic DNA

SEQ ID NO: 56091 - DNA, 295 bp, Homo sapiens; identical to SEQ ID NO: 35469
  misc_feature 1..295: note = chr14:90850099-90850394
  misc_feature 1..295: note = hyper
  source 1..295: mol_type = genomic DNA

SEQ ID NO: 56092 - DNA, 53 bp, Homo sapiens; identical to SEQ ID NO: 12000
  misc_feature 1..53: note = chr14:91580352-91580405
  misc_feature 1..53: note = hyper
  source 1..53: mol_type = genomic DNA

SEQ ID NO: 56093 - DNA, 30 bp, Homo sapiens; identical to SEQ ID NO: 35471
  misc_feature 1..30: note = chr14:91581588-91581618
  misc_feature 1..30: note = hyper
  source 1..30: mol_type = genomic DNA

SEQ ID NO: 56094 - DNA, 30 bp, Homo sapiens; identical to SEQ ID NO: 35472
  misc_feature 1..30: note = chr14:91720177-91720207
  misc_feature 1..30: note = hyper
  source 1..30: mol_type = genomic DNA

SEQ ID NO: 56095 - DNA, 416 bp, Homo sapiens; identical to SEQ ID NO: 35473
  misc_feature 1..416: note = chr14:92040467-92040883
  misc_feature 1..416: note = hyper
  source 1..416: mol_type = genomic DNA

SEQ ID NO: 56096 - DNA, 232 bp, Homo sapiens
  misc_feature 1..232: note = chr14:92789280-92789512
  misc_feature 1..232: note = hyper
  source 1..232: mol_type = genomic DNA
ggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagac

SEQ ID NO: 56097 - DNA, 280 bp, Homo sapiens
  misc_feature 1..280: note = chr14:92789542-92789822
  misc_feature 1..280: note = hyper
  source 1..280: mol_type = genomic DNA
aaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagc

SEQ ID NO: 56098 - DNA, 201 bp, Homo sapiens; identical to SEQ ID NO: 21935
  misc_feature 1..201: note = chr14:92790436-92790637
  misc_feature 1..201: note = hyper
  source 1..201: mol_type = genomic DNA

SEQ ID NO: 56099 - DNA, 91 bp, Homo sapiens
  misc_feature 1..91: note = chr14:92790703-92790794
  misc_feature 1..91: note = hyper
  source 1..91: mol_type = genomic DNA
tgcgtctcgcccctgccctggttcaaaggggtcccctgggtgccctgaggtgtttgttcttcccaaaccctaaaggcgttggggcagtctg

SEQ ID NO: 56100 - DNA, 306 bp, Homo sapiens
  misc_feature 1..306: note = chr14:92979611-92979917
  misc_feature 1..306: note = hyper
  source 1..306: mol_type = genomic DNA
gcatccaagaggaggcggcgtgcacatctgtcaggaatgtggaggaggcgccctggctctggtctgaggttgcccttgaacgatttcgaggctccctcgggcaaggctgtggctccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcgg

SEQ ID NO: 56101 - DNA, 779 bp, Homo sapiens
  misc_feature 1..779: note = chr14:92979991-92980770
  misc_feature 1..779: note = hyper
  source 1..779: mol_type = genomic DNA
ggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccc

SEQ ID NO: 56102 - DNA, 62 bp, Homo sapiens; identical to SEQ ID NO: 35478
  misc_feature 1..62: note = chr14:93389271-93389333
  misc_feature 1..62: note = hyper
  source 1..62: mol_type = genomic DNA

SEQ ID NO: 56103 - DNA, 160 bp, Homo sapiens
  misc_feature 1..160: note = chr14:93389776-93389936
  misc_feature 1..160: note = hyper
  source 1..160: mol_type = genomic DNA
agagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccaca

SEQ ID NO: 56104 - DNA, 269 bp, Homo sapiens; identical to SEQ ID NO: 35481
  misc_feature 1..269: note = chr14:93897179-93897448
  misc_feature 1..269: note = hyper
  source 1..269: mol_type = genomic DNA

SEQ ID NO: 56105 - DNA, 30 bp, Homo sapiens; identical to SEQ ID NO: 35482
  misc_feature 1..30: note = chr14:94226381-94226411
  misc_feature 1..30: note = hyper
  source 1..30: mol_type = genomic DNA

SEQ ID NO: 56106 - DNA, 95 bp, Homo sapiens
  misc_feature 1..95: note = chr14:94254294-94254389
  misc_feature 1..95: note = hyper
  source 1..95: mol_type = genomic DNA
acatccccagagccccgcgtgtacactttagctccgcgcacagctccagaatactgcgtgcataccttggccccatggacacctccagaaacagc

SEQ ID NO: 56107 - DNA, 466 bp, Homo sapiens
  misc_feature 1..466: note = chr14:94254513-94254979
  misc_feature 1..466: note = hyper
  source 1..466: mol_type = genomic DNA
atccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagt

SEQ ID NO: 56108 - skipped

SEQ ID NO: 56109 - DNA, 59 bp, Homo sapiens; identical to SEQ ID NO: 35486
  misc_feature 1..59: note = chr14:94255304-94255363
  misc_feature 1..59: note = hyper
  source 1..59: mol_type = genomic DNA

SEQ ID NO: 56110 - DNA, 23 bp, Homo sapiens
  misc_feature 1..23: note = chr14:94255584-94255607
  misc_feature 1..23: note = hyper
  source 1..23: mol_type = genomic DNA
cccccaagcctctcccgaggctg

SEQ ID NO: 56111 - DNA, 46 bp, Homo sapiens; identical to SEQ ID NO: 12016
  misc_feature 1..46: note = chr14:94255669-94255715
  misc_feature 1..46: note = hyper
  source 1..46: mol_type = genomic DNA

SEQ ID NO: 56112 - DNA, 74 bp, Homo sapiens
  misc_feature 1..74: note = chr14:94405660-94405734
  misc_feature 1..74: note = hyper
  source 1..74: mol_type = genomic DNA
ataggcgtcgatgttcgcgccgtggtccagcagcagctgcattgtgcgcaggcagccgtggcggatggccacga

SEQ ID NO: 56113 - DNA, 243 bp, Homo sapiens
  misc_feature 1..243: note = chr14:94405785-94406028
  misc_feature 1..243: note = hyper
  source 1..243: mol_type = genomic DNA
gctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtc

SEQ ID NO: 56114 - DNA, 85 bp, Homo sapiens; identical to SEQ ID NO: 35490
  misc_feature 1..85: note = chr14:94641576-94641661
  misc_feature 1..85: note = hyper
  source 1..85: mol_type = genomic DNA

SEQ ID NO: 56115 - DNA, 66 bp, Homo sapiens; identical to SEQ ID NO: 35491
  misc_feature 1..66: note = chr14:95233491-95233557
  misc_feature 1..66: note = hyper
  source 1..66: mol_type = genomic DNA

SEQ ID NO: 56116 - DNA, 30 bp, Homo sapiens; identical to SEQ ID NO: 35492
  misc_feature 1..30: note = chr14:95234025-95234055
  misc_feature 1..30: note = hyper
  source 1..30: mol_type = genomic DNA

SEQ ID NO: 56117 - DNA, 94 bp, Homo sapiens
  misc_feature 1..94: note = chr14:95234549-95234643
  misc_feature 1..94: note = hyper
  source 1..94: mol_type = genomic DNA
gtggcccgtctacatcgccatcactttattgtactgtcacccttaatttaactataaatactacggtgggggctagtcgcgggcggcctcgggc

SEQ ID NO: 56118 - DNA, 14 bp, Homo sapiens
  misc_feature 1..14: note = chr14:95235369-95235383
  misc_feature 1..14: note = hyper
  source 1..14: mol_type = genomic DNA
ctggaagaggttct

SEQ ID NO: 56119 - DNA, 182 bp, Homo sapiens; identical to SEQ ID NO: 35495
  misc_feature 1..182: note = chr14:95235513-95235695
  misc_feature 1..182: note = hyper
  source 1..182: mol_type = genomic DNA

SEQ ID NO: 56120 - DNA, 395 bp, Homo sapiens
  misc_feature 1..395: note = chr14:95236111-95236506
  misc_feature 1..395: note = hyper
  source 1..395: mol_type = genomic DNA
tgtagccgaggcgggagccgctgaccgcggccgggaggcccgcgccgccgggggccacggggcgcgggtagaaggcgccatagtccgaggaggcgccgccgctggcgccgtagagcgagtccccgtgcagggccgggaagacgacgggagccgccgcgctgtgcgccaccggcaacaccgagtccttgcagcgcggccgggcggctaggatgttgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccg

SEQ ID NO: 56121 - DNA, 125 bp, Homo sapiens; identical to SEQ ID NO: 35497
  misc_feature 1..125: note = chr14:95237011-95237136
  misc_feature 1..125: note = hyper
  source 1..125: mol_type = genomic DNA

SEQ ID NO: 56122 - DNA, 55 bp, Homo sapiens; identical to SEQ ID NO: 35498
  misc_feature 1..55: note = chr14:95237867-95237922
  misc_feature 1..55: note = hyper
  source 1..55: mol_type = genomic DNA

SEQ ID NO: 56123 - DNA, 59 bp, Homo sapiens
  misc_feature 1..59: note = chr14:95239633-95239692
  misc_feature 1..59: note = hyper
  source 1..59: mol_type = genomic DNA
gggaggaccgcgagcgtccagaggcagccggcgagcgcttaggtcggaaatgcagtaaa

SEQ ID NO: 56124 - DNA, 30 bp, Homo sapiens; identical to SEQ ID NO: 12023
  misc_feature 1..30: note = chr14:95240484-95240514
  misc_feature 1..30: note = hyper
  source 1..30: mol_type = genomic DNA

SEQ ID NO: 56125 - DNA, 29 bp, Homo sapiens
  misc_feature 1..29: note = chr14:96342281-96342310
  misc_feature 1..29: note = hyper
  source 1..29: mol_type = genomic DNA
gcccaaagccacattcgccacgctcccgc

SEQ ID NO: 56126 - DNA, 26 bp, Homo sapiens
  misc_feature 1..26: note = chr14:96342605-96342631
  misc_feature 1..26: note = hyper
  source 1..26: mol_type = genomic DNA
cgcagcgcgcgtcagcgggggctccc

SEQ ID NO: 56127 - DNA, 18 bp, Homo sapiens
  misc_feature 1..18: note = chr14:96342879-96342897
  misc_feature 1..18: note = hyper
  source 1..18: mol_type = genomic DNA
cgcactgctgtgcttgcg

SEQ ID NO: 56128 - DNA, 110 bp, Homo sapiens
  misc_feature 1..110: note = chr14:96343133-96343243
  misc_feature 1..110: note = hyper
  source 1..110: mol_type = genomic DNA
gggtgcagctctgcgcgttctcatgctgtctctctctctttccctccgcgctgcctctccgaggtcctcccgccgagccccggcgcggggcatgaggagcccccgggtgc

SEQ ID NO: 56129 - DNA, 85 bp, Homo sapiens
  misc_feature 1..85: note = chr14:96343319-96343404
  misc_feature 1..85: note = hyper
  source 1..85: mol_type = genomic DNA
cgcccggcggccagccctatccggcggcggccagcgggtcaacgctgcccgggagaatgaggcaggagccggcggcagcctcctt

SEQ ID NO: 56130 - skipped

SEQ ID NO: 56131 - DNA, 84 bp, Homo sapiens; identical to SEQ ID NO: 21956
  misc_feature 1..84: note = chr14:96343701-96343785
  misc_feature 1..84: note = hyper
  source 1..84: mol_type = genomic DNA

SEQ ID NO: 56132 - DNA, 173 bp, Homo sapiens; identical to SEQ ID NO: 35506
  misc_feature 1..173: note = chr14:96505338-96505511
  misc_feature 1..173: note = hyper
  source 1..173: mol_type = genomic DNA

SEQ ID NO: 56133 - DNA, 153 bp, Homo sapiens; identical to SEQ ID NO: 35507
  misc_feature 1..153: note = chr14:96505900-96506053
  misc_feature 1..153: note = hyper
  source 1..153: mol_type = genomic DNA

SEQ ID NO: 56134 - DNA, 30 bp, Homo sapiens; identical to SEQ ID NO: 35508
  misc_feature 1..30: note = chr14:96506466-96506496
  misc_feature 1..30: note = hyper
  source 1..30: mol_type = genomic DNA

SEQ ID NO: 56135 - DNA, 17 bp, Homo sapiens
  misc_feature 1..17: note = chr14:97059083-97059100
  misc_feature 1..17: note = hyper
  source 1..17: mol_type = genomic DNA
cgcgccccagggcccag

SEQ ID NO: 56136 - DNA, 183 bp, Homo sapiens
  misc_feature 1..183: note = chr14:97499315-97499498
  misc_feature 1..183: note = hyper
  source 1..183: mol_type = genomic DNA
gatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggtt

SEQ ID NO: 56137 - DNA, 83 bp, Homo sapiens
  misc_feature 1..83: note = chr14:97684961-97685044
  misc_feature 1..83: note = hyper
  source 1..83: mol_type = genomic DNA
gaagggccccagtgacgactggattcggaattttcctctcacttcgtggtagtgaagaatttaactacaacagtaacaacact

SEQ ID NO: 56138 - skipped

SEQ ID NO: 56139 - DNA, 312 bp, Homo sapiens
  misc_feature 1..312: note = chr14:97685395-97685707
  misc_feature 1..312: note = hyper
  source 1..312: mol_type = genomic DNA
cgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggt

SEQ ID NO: 56140 - DNA, 81 bp, Homo sapiens
  misc_feature 1..81: note = chr14:99584664-99584745
  misc_feature 1..81: note = hyper
  source 1..81: mol_type = genomic DNA
agcgttcccggcccaccgcaccatattgtgcaaggcgcgggctgaaggaaacagcgtcccgtgtcgcgcagtgtttgtttg

SEQ ID NO: 56141 - DNA, 30 bp, Homo sapiens; identical to SEQ ID NO: 35515
  misc_feature 1..30: note = chr14:99713234-99713264
  misc_feature 1..30: note = hyper
  source 1..30: mol_type = genomic DNA

SEQ ID NO: 56142 - skipped

SEQ ID NO: 56143 - DNA, 30 bp, Homo sapiens; identical to SEQ ID NO: 35517
  misc_feature 1..30: note = chr14:99736401-99736431
  misc_feature 1..30: note = hyper
  source 1..30: mol_type = genomic DNA

SEQ ID NO: 56144 - DNA, 30 bp, Homo sapiens; identical to SEQ ID NO: 35518
  misc_feature 1..30: note = chr14:99736980-99737010
  misc_feature 1..30: note = hyper
  source 1..30: mol_type = genomic DNA

SEQ ID NO: 56145 - DNA, 58 bp, Homo sapiens; identical to SEQ ID NO: 35519
  misc_feature 1..58: note = chr14:99738350-99738408
  misc_feature 1..58: note = hyper
  source 1..58: mol_type = genomic DNA

SEQ ID NO: 56146 - DNA, 70 bp, Homo sapiens; identical to SEQ ID NO: 35520
  misc_feature 1..70: note = chr14:99739091-99739161
  misc_feature 1..70: note = hyper
  source 1..70: mol_type = genomic DNA

SEQ ID NO: 56147 - DNA, 169 bp, Homo sapiens; identical to SEQ ID NO: 35521
  misc_feature 1..169: note = chr14:99739709-99739878
  misc_feature 1..169: note = hyper
  source 1..169: mol_type = genomic DNA

SEQ ID NO: 56148 - DNA, 175 bp, Homo sapiens; identical to SEQ ID NO: 35522
  misc_feature 1..175: note = chr14:99740538-99740713
  misc_feature 1..175: note = hyper
  source 1..175: mol_type = genomic DNA

SEQ ID NO: 56149 - DNA, 49 bp, Homo sapiens; identical to SEQ ID NO: 35523
  misc_feature 1..49: note = chr14:100111198-100111247
  misc_feature 1..49: note = hyper
  source 1..49: mol_type = genomic DNA

SEQ ID NO: 56150 - DNA, 54 bp, Homo sapiens; identical to SEQ ID NO: 35524
  misc_feature 1..54: note = chr14:100111503-100111557
  misc_feature 1..54: note = hyper
  source 1..54: mol_type = genomic DNA

SEQ ID NO: 56151 - DNA, 155 bp, Homo sapiens; identical to SEQ ID NO: 35525
  misc_feature 1..155: note = chr14:100111764-100111919
  misc_feature 1..155: note = hyper
  source 1..155: mol_type = genomic DNA

SEQ ID NO: 56152 - DNA, 363 bp, Homo sapiens; identical to SEQ ID NO: 35526
  misc_feature 1..363: note = chr14:100125656-100126019
  misc_feature 1..363: note = hyper
  source 1..363: mol_type = genomic DNA

SEQ ID NO: 56153 - DNA, 236 bp, Homo sapiens; identical to SEQ ID NO: 35527
  misc_feature 1..236: note = chr14:100260026-100260262
  misc_feature 1..236: note = hyper
  source 1..236: mol_type = genomic DNA

SEQ ID NO: 56154 - DNA, 329 bp, Homo sapiens
  misc_feature 1..329: note = chr14:100437465-100437794
  misc_feature 1..329: note = hyper
  source 1..329: mol_type = genomic DNA
gacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggcc

SEQ ID NO: 56155 - DNA, 204 bp, Homo sapiens; identical to SEQ ID NO: 35529
  misc_feature 1..204: note = chr14:100438017-100438221
  misc_feature 1..204: note = hyper
  source 1..204: mol_type = genomic DNA

SEQ ID NO: 56156 - DNA, 483 bp, Homo sapiens
  misc_feature 1..483: note = chr14:100438222-100438705
  misc_feature 1..483: note = hyper
  source 1..483: mol_type = genomic DNA
cccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcc

SEQ ID NO: 56157 - DNA, 160 bp, Homo sapiens
  misc_feature 1..160: note = chr14:100438811-100438971
  misc_feature 1..160: note = hyper
  source 1..160: mol_type = genomic DNA
tgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgca

SEQ ID NO: 56158 - DNA, 270 bp, Homo sapiens; identical to SEQ ID NO: 35531
  misc_feature 1..270: note = chr14:101033483-101033753
  misc_feature 1..270: note = hyper
  source 1..270: mol_type = genomic DNA

SEQ ID NO: 56159 - DNA, 175 bp, Homo sapiens; identical to SEQ ID NO: 35532
  misc_feature 1..175: note = chr14:101033978-101034153
  misc_feature 1..175: note = hyper
  source 1..175: mol_type = genomic DNA

SEQ ID NO: 56160 - DNA, 601 bp, Homo sapiens; identical to SEQ ID NO: 35533
  misc_feature 1..601: note = chr14:101034879-101035480
  misc_feature 1..601: note = hyper
  source 1..601: mol_type = genomic DNA

SEQ ID NO: 56161 - DNA, 177 bp, Homo sapiens; identical to SEQ ID NO: 35534
  misc_feature 1..177: note = chr14:101193397-101193574
  misc_feature 1..177: note = hyper
  source 1..177: mol_type = genomic DNA

SEQ ID NO: 56162 - DNA, 40 bp, Homo sapiens; identical to SEQ ID NO: 21972
  misc_feature 1..40: note = chr14:101543828-101543868
  misc_feature 1..40: note = hyper
  source 1..40: mol_type = genomic DNA

SEQ ID NO: 56163 - DNA, 18 bp, Homo sapiens
  misc_feature 1..18: note = chr14:101923096-101923114
  misc_feature 1..18: note = hyper
  source 1..18: mol_type = genomic DNA
gttactatattaaagcgc

SEQ ID NO: 56164 - DNA, 17 bp, Homo sapiens
  misc_feature 1..17: note = chr14:101923250-101923267
  misc_feature 1..17: note = hyper
  source 1..17: mol_type = genomic DNA
cgcgccgttgtgagtcc

SEQ ID NO: 56165 - DNA, 79 bp, Homo sapiens
  misc_feature 1..79: note = chr14:101923521-101923600
  misc_feature 1..79: note = hyper
  source 1..79: mol_type = genomic DNA
aagaggagagaaaggcgaggcacagtgggtgcgcaaagaaaaagaggttctcagcggagcgtgtgtgaggcggggggtt

SEQ ID NO: 56166 - DNA, 35 bp, Homo sapiens
  misc_feature 1..35: note = chr14:101924047-101924082
  misc_feature 1..35: note = hyper
  source 1..35: mol_type = genomic DNA
tccccgacgcgcctggagcccgggagggaggcgcg

SEQ ID NO: 56167 - DNA, 15 bp, Homo sapiens
  misc_feature 1..15: note = chr14:101924423-101924438
  misc_feature 1..15: note = hyper
  source 1..15: mol_type = genomic DNA
gaggccatcaaaggc

SEQ ID NO: 56168 - DNA, 33 bp, Homo sapiens; identical to SEQ ID NO: 35540
  misc_feature 1..33: note = chr14:101924457-101924490
  misc_feature 1..33: note = hyper
  source 1..33: mol_type = genomic DNA

SEQ ID NO: 56169 - DNA, 191 bp, Homo sapiens; identical to SEQ ID NO: 21977
  misc_feature 1..191: note = chr14:101924858-101925049
  misc_feature 1..191: note = hyper
  source 1..191: mol_type = genomic DNA

SEQ ID NO: 56170 - DNA, 91 bp, Homo sapiens
  misc_feature 1..91: note = chr14:101925901-101925992
  misc_feature 1..91: note = hyper
  source 1..91: mol_type = genomic DNA
acccaggaaggacgcccgccgttcccagcaccccagcgtctgaaaaatgaatgtgaactccgcaagcgtgctcccgcggacattttacatg

SEQ ID NO: 56171 - DNA, 166 bp, Homo sapiens
  misc_feature 1..166: note = chr14:102026194-102026360
  misc_feature 1..166: note = hyper
  source 1..166: mol_type = genomic DNA
ggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctggggga

SEQ ID NO: 56172 - DNA, 41 bp, Homo sapiens
  misc_feature 1..41: note = chr14:102026967-102027008
  misc_feature 1..41: note = hyper
  source 1..41: mol_type = genomic DNA
gcacctctcagcccggccccggcggccgctgacccaggaac

SEQ ID NO: 56173 - DNA, 391 bp, Homo sapiens; identical to SEQ ID NO: 35546
  misc_feature 1..391: note = chr14:102029904-102030295
  misc_feature 1..391: note = hyper
  source 1..391: mol_type = genomic DNA

SEQ ID NO: 56174 - DNA, 256 bp, Homo sapiens; identical to SEQ ID NO: 35547
  misc_feature 1..256: note = chr14:102030653-102030909
  misc_feature 1..256: note = hyper
  source 1..256: mol_type = genomic DNA

SEQ ID NO: 56175 - DNA, 120 bp, Homo sapiens; identical to SEQ ID NO: 21982
  misc_feature 1..120: note = chr14:102247792-102247912
  misc_feature 1..120: note = hyper
  source 1..120: mol_type = genomic DNA

SEQ ID NO: 56176 - DNA, 49 bp, Homo sapiens; identical to SEQ ID NO: 21983
  misc_feature 1..49: note = chr14:103021342-103021391
  misc_feature 1..49: note = hyper
  source 1..49: mol_type = genomic DNA

SEQ ID NO: 56177 - DNA, 116 bp, Homo sapiens
  misc_feature 1..116: note = chr14:103022003-103022119
  misc_feature 1..116: note = hyper
  source 1..116: mol_type = genomic DNA
agcttctctggaagacctggtgctggtccgctctcccgggacctcattttccttatgtggacaacgggggcggggtcacagcagcccctcgggcttatagccgggttgttctttcc

SEQ ID NO: 56178 - DNA, 81 bp, Homo sapiens; identical to SEQ ID NO: 35551
  misc_feature 1..81: note = chr14:103389208-103389289
  misc_feature 1..81: note = hyper
  source 1..81: mol_type = genomic DNA

SEQ ID NO: 56179 - DNA, 225 bp, Homo sapiens; identical to SEQ ID NO: 35552
  misc_feature 1..225: note = chr14:103389663-103389888
  misc_feature 1..225: note = hyper
  source 1..225: mol_type = genomic DNA

SEQ ID NO: 56180 - DNA, 30 bp, Homo sapiens; identical to SEQ ID NO: 35553
  misc_feature 1..30: note = chr14:103390143-103390173
  misc_feature 1..30: note = hyper
  source 1..30: mol_type = genomic DNA

SEQ ID NO: 56181 - DNA, 201 bp, Homo sapiens
  misc_feature 1..201: note = chr14:103394683-103394884
  misc_feature 1..201: note = hyper
  source 1..201: mol_type = genomic DNA
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaa

SEQ ID NO: 56182 - DNA, 281 bp, Homo sapiens
  misc_feature 1..281: note = chr14:103395101-103395382
  misc_feature 1..281: note = hyper
  source 1..281: mol_type = genomic DNA
tgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtct

SEQ ID NO: 56183 - DNA, 92 bp, Homo sapiens; identical to SEQ ID NO: 12062
  misc_feature 1..92: note = chr14:103550468-103550560
  misc_feature 1..92: note = hyper
  source 1..92: mol_type = genomic DNA

SEQ ID NO: 56184 - DNA, 45 bp, Homo sapiens; identical to SEQ ID NO: 21989
  misc_feature 1..45: note = chr14:103655601-103655646
  misc_feature 1..45: note = hyper
  source 1..45: mol_type = genomic DNA

SEQ ID NO: 56185 - DNA, 32 bp, Homo sapiens; identical to SEQ ID NO: 35558
  misc_feature 1..32: note = chr14:103673859-103673891
  misc_feature 1..32: note = hyper
  source 1..32: mol_type = genomic DNA

SEQ ID NO: 56186 - DNA, 30 bp, Homo sapiens; identical to SEQ ID NO: 35559
  misc_feature 1..30: note = chr14:103686765-103686795
  misc_feature 1..30: note = hyper
  source 1..30: mol_type = genomic DNA

SEQ ID NO: 56187 - DNA, 170 bp, Homo sapiens
  misc_feature 1..170: note = chr14:103687219-103687389
  misc_feature 1..170: note = hyper
  source 1..170: mol_type = genomic DNA
ccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagc

SEQ ID NO: 56188 - DNA, 44 bp, Homo sapiens
  misc_feature 1..44: note = chr14:103739923-103739967
  misc_feature 1..44: note = hyper
  source 1..44: mol_type = genomic DNA
ctgggttgagcggggcggatctgggactccgaggcttcctacgt

SEQ ID NO: 56189 - DNA, 208 bp, Homo sapiens
  misc_feature 1..208: note = chr14:103740150-103740358
  misc_feature 1..208: note = hyper
  source 1..208: mol_type = genomic DNA
gggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccct

SEQ ID NO: 56190 - skipped

SEQ ID NO: 56191 - DNA, 72 bp, Homo sapiens; identical to SEQ ID NO: 35562
  misc_feature 1..72: note = chr14:103740539-103740611
  misc_feature 1..72: note = hyper
  source 1..72: mol_type = genomic DNA

SEQ ID NO: 56192 - DNA, 35 bp, Homo sapiens; identical to SEQ ID NO: 35563
  misc_feature 1..35: note = chr14:103745329-103745364
  misc_feature 1..35: note = hyper
  source 1..35: mol_type = genomic DNA

SEQ ID NO: 56193 - DNA, 122 bp, Homo sapiens
  misc_feature 1..122: note = chr14:103745577-103745699
  misc_feature 1..122: note = hyper
  source 1..122: mol_type = genomic DNA
gagtgggcaggaccacgctggacacgcagttcgcgtgcggccgctccccgagcagtgcgcggcgtgggcggaggagcggctccgcgaggagatcgaggcgaacgcggcgcccgcgttgctgg

SEQ ID NO: 56194 - DNA, 39 bp, Homo sapiens
  misc_feature 1..39: note = chr14:103745750-103745789
  misc_feature 1..39: note = hyper
  source 1..39: mol_type = genomic DNA
acatccgccacggcgacggctccgcggtgctcccgggcg

SEQ ID NO: 56195 - DNA, 300 bp, Homo sapiens; identical to SEQ ID NO: 35565
  misc_feature 1..300: note = chr14:103989154-103989454
  misc_feature 1..300: note = hyper
  source 1..300: mol_type = genomic DNA

SEQ ID NO: 56196 - DNA, 41 bp, Homo sapiens
  misc_feature 1..41: note = chr14:104601832-104601873
  misc_feature 1..41: note = hyper
  source 1..41: mol_type = genomic DNA
gggcagggtccctgacacttccttaactcccaaagaccttc

SEQ ID NO: 56197 - DNA, 70 bp, Homo sapiens
  misc_feature 1..70: note = chr14:104601963-104602033
  misc_feature 1..70: note = hyper
  source 1..70: mol_type = genomic DNA
cgaggctggggcagcccacaggaggagcgcgggacccgggcttgagtttgcacccaggcagagcgcccac

SEQ ID NO: 56198 - DNA, 40 bp, Homo sapiens
  misc_feature 1..40: note = chr14:104602063-104602103
  misc_feature 1..40: note = hyper
  source 1..40: mol_type = genomic DNA
aagtcgtcgtgcccggcagccagcccgaatcttccagccc

SEQ ID NO: 56199 - DNA, 466 bp, Homo sapiens; identical to SEQ ID NO: 35568
  misc_feature 1..466: note = chr14:104602310-104602776
  misc_feature 1..466: note = hyper
  source 1..466: mol_type = genomic DNA

SEQ ID NO: 56200 - DNA, 267 bp, Homo sapiens; identical to SEQ ID NO: 35569
  misc_feature 1..267: note = chr14:104603085-104603352
  misc_feature 1..267: note = hyper
  source 1..267: mol_type = genomic DNA

SEQ ID NO: 56201 - DNA, 488 bp, Homo sapiens; identical to SEQ ID NO: 35570
  misc_feature 1..488: note = chr14:104604185-104604673
  misc_feature 1..488: note = hyper
  source 1..488: mol_type = genomic DNA

SEQ ID NO: 56202 - DNA, 148 bp, Homo sapiens
  misc_feature 1..148: note = chr14:104604884-104605032
  misc_feature 1..148: note = hyper
  source 1..148: mol_type = genomic DNA
cccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgc

SEQ ID NO: 56203 - DNA, 156 bp, Homo sapiens; identical to SEQ ID NO: 21998
  misc_feature 1..156: note = chr14:104605114-104605270
  misc_feature 1..156: note = hyper
  source 1..156: mol_type = genomic DNA

SEQ ID NO: 56204 - DNA, 244 bp, Homo sapiens; identical to SEQ ID NO: 35572
  misc_feature 1..244: note = chr14:105070950-105071194
  misc_feature 1..244: note = hyper
  source 1..244: mol_type = genomic DNA

SEQ ID NO: 56205 - DNA, 30 bp, Homo sapiens; identical to SEQ ID NO: 35573
  misc_feature 1..30: note = chr14:105292388-105292418
  misc_feature 1..30: note = hyper
  source 1..30: mol_type = genomic DNA

SEQ ID NO: 56206 - DNA, 437 bp, Homo sapiens; identical to SEQ ID NO: 35574
  misc_feature 1..437: note = chr14:105310006-105310443
  misc_feature 1..437: note = hyper
  source 1..437: mol_type = genomic DNA

SEQ ID NO: 56207 - DNA, 349 bp, Homo sapiens; identical to SEQ ID NO: 35575
  misc_feature 1..349: note = chr14:105310485-105310834
  misc_feature 1..349: note = hyper
  source 1..349: mol_type = genomic DNA

SEQ ID NO: 56208 - DNA, 220 bp, Homo sapiens; identical to SEQ ID NO: 35576
  misc_feature 1..220: note = chr14:105433940-105434160
  misc_feature 1..220: note = hyper
  source 1..220: mol_type = genomic DNA

SEQ ID NO: 56209 - DNA, 19 bp, Homo sapiens
  misc_feature 1..19: note = chr14:105434286-105434305
  misc_feature 1..19: note = hyper
  source 1..19: mol_type = genomic DNA
cgcccggcctccggttctc

SEQ ID NO: 56210 - DNA, 23 bp, Homo sapiens
  misc_feature 1..23: note = chr14:105512040-105512063
  misc_feature 1..23: note = hyper
  source 1..23: mol_type = genomic DNA
atgtgcaaaatgttccgcctgcg

SEQ ID NO: 56211 - DNA, 81 bp, Homo sapiens
  misc_feature 1..81: note = chr14:105714334-105714415
  misc_feature 1..81: note = hyper
  source 1..81: mol_type = genomic DNA
gctccagggctgcaggcccagggccagatcctgacttgcccacccgccggctgtgtgaccttcagcgcgcgactaacctct

SEQ ID NO: 56212 - DNA, 67 bp, Homo sapiens
  misc_feature 1..67: note = chr15:23158330-23158397
  misc_feature 1..67: note = hyper
  source 1..67: mol_type = genomic DNA
cgccgggcgggtcaccgcaccccgagatgtgcccccaaggctctttcgaccgccgtgaagtggcggg

SEQ ID NO: 56213 - DNA, 38 bp, Homo sapiens; identical to SEQ ID NO: 22004
  misc_feature 1..38: note = chr15:23158489-23158527
  misc_feature 1..38: note = hyper
  source 1..38: mol_type = genomic DNA

SEQ ID NO: 56214 - DNA, 32 bp, Homo sapiens; identical to SEQ ID NO: 35581
  misc_feature 1..32: note = chr15:25915272-25915304
  misc_feature 1..32: note = hyper
  source 1..32: mol_type = genomic DNA

SEQ ID NO: 56215 - DNA, 31 bp, Homo sapiens
  misc_feature 1..31: note = chr15:26107609-26107640
  misc_feature 1..31: note = hyper
  source 1..31: mol_type = genomic DNA
acagagaggccttggcggcgctgtggcttcg

SEQ ID NO: 56216 - DNA, 236 bp, Homo sapiens; identical to SEQ ID NO: 22005
  misc_feature 1..236: note = chr15:26107860-26108096
  misc_feature 1..236: note = hyper
  source 1..236: mol_type = genomic DNA

SEQ ID NO: 56217 - DNA, 130 bp, Homo sapiens
  misc_feature 1..130: note = chr15:26108701-26108831
  misc_feature 1..130: note = hyper
  source 1..130: mol_type = genomic DNA
gagagaggaaaccgcgaagcgcgagaaaaggcgcccccgtccccaagcagcccgcgcgcccttccaggggccagacctgctccatcctggacggcgaaacgacctcgggagaccccggttaggaccttac

SEQ ID NO: 56218 - DNA, 23 bp, Homo sapiens
  misc_feature 1..23: note = chr15:26327541-26327564
  misc_feature 1..23: note = hyper
  source 1..23: mol_type = genomic DNA
ccctgtctgcgcctgcgcctgcg

SEQ ID NO: 56219 - DNA, 299 bp, Homo sapiens; identical to SEQ ID NO: 35586
  misc_feature 1..299: note = chr15:26327610-26327909
  misc_feature 1..299: note = hyper
  source 1..299: mol_type = genomic DNA

SEQ ID NO: 56220 - DNA, 30 bp, Homo sapiens; identical to SEQ ID NO: 12083
  misc_feature 1..30: note = chr15:27016662-27016692
  misc_feature 1..30: note = hyper
  source 1..30: mol_type = genomic DNA

SEQ ID NO: 56221 - DNA, 161 bp, Homo sapiens; identical to SEQ ID NO: 35588
  misc_feature 1..161: note = chr15:27017654-27017815
  misc_feature 1..161: note = hyper
  source 1..161: mol_type = genomic DNA

SEQ ID NO: 56222 - DNA, 45 bp, Homo sapiens; identical to SEQ ID NO: 35589
  misc_feature 1..45: note = chr15:27018284-27018329
  misc_feature 1..45: note = hyper
  source 1..45: mol_type = genomic DNA

SEQ ID NO: 56223 - DNA, 63 bp, Homo sapiens; identical to SEQ ID NO: 35590
  misc_feature 1..63: note = chr15:27018746-27018809
  misc_feature 1..63: note = hyper
  source 1..63: mol_type = genomic DNA

SEQ ID NO: 56224 - DNA, 146 bp, Homo sapiens; identical to SEQ ID NO: 35591
  misc_feature 1..146: note = chr15:27111977-27112123
  misc_feature 1..146: note = hyper
  source 1..146: mol_type = genomic DNA

SEQ ID NO: 56225 - DNA, 17 bp, Homo sapiens
  misc_feature 1..17: note = chr15:27113012-27113029
  misc_feature 1..17: note = hyper
  source 1..17: mol_type = genomic DNA
cgcgctcccagcccagg

SEQ ID NO: 56226 - DNA, 140 bp, Homo sapiens; identical to SEQ ID NO: 35593
  misc_feature 1..140: note = chr15:27113477-27113617
  misc_feature 1..140: note = hyper
  source 1..140: mol_type = genomic DNA

SEQ ID NO: 56227 - DNA, 16 bp, Homo sapiens
  misc_feature 1..16: note = chr15:27213172-27213188
  misc_feature 1..16: note = hyper
  source 1..16: mol_type = genomic DNA
tcggttgtgagaaccg

SEQ ID NO: 56228 - DNA, 177 bp, Homo sapiens; identical to SEQ ID NO: 35595
  misc_feature 1..177: note = chr15:27216067-27216244
  misc_feature 1..177: note = hyper
  source 1..177: mol_type = genomic DNA

SEQ ID NO: 56229 - DNA, 39 bp, Homo sapiens; identical to SEQ ID NO: 35596
  misc_feature 1..39: note = chr15:27216830-27216869
  misc_feature 1..39: note = hyper
  source 1..39: mol_type = genomic DNA

SEQ ID NO: 56230 - DNA, 30 bp, Homo sapiens; identical to SEQ ID NO: 35597
  misc_feature 1..30: note = chr15:27603952-27603982
  misc_feature 1..30: note = hyper
  source 1..30: mol_type = genomic DNA

SEQ ID NO: 56231 - DNA, 42 bp, Homo sapiens; identical to SEQ ID NO: 35598
  misc_feature 1..42: note = chr15:28339778-28339820
  misc_feature 1..42: note = hyper
  source 1..42: mol_type = genomic DNA

SEQ ID NO: 56232 - DNA, 279 bp, Homo sapiens; identical to SEQ ID NO: 35599
  misc_feature 1..279: note = chr15:28340309-28340588
  misc_feature 1..279: note = hyper
  source 1..279: mol_type = genomic DNA

SEQ ID NO: 56233 - DNA, 55 bp, Homo sapiens
  misc_feature 1..55: note = chr15:28341644-28341699
  misc_feature 1..55: note = hyper
  source 1..55: mol_type = genomic DNA
aggcctgaagaagcccgtccaggggtcagcctcctcctcagccggtcctgggctg

SEQ ID NO: 56234 - DNA, 40 bp, Homo sapiens; identical to SEQ ID NO: 35602
  misc_feature 1..40: note = chr15:28342521-28342561
  misc_feature 1..40: note = hyper
  source 1..40: mol_type = genomic DNA

SEQ ID NO: 56235 - DNA, 39 bp, Homo sapiens
  misc_feature 1..39: note = chr15:28344134-28344173
  misc_feature 1..39: note = hyper
  source 1..39: mol_type = genomic DNA
cgcctggcagagagccggagggggtgctcagggggcagc

SEQ ID NO: 56236 - skipped

SEQ ID NO: 56237 - DNA, 78 bp, Homo sapiens; identical to SEQ ID NO: 35605
  misc_feature 1..78: note = chr15:28344614-28344692
  misc_feature 1..78: note = hyper
  source 1..78: mol_type = genomic DNA

SEQ ID NO: 56238 - DNA, 340 bp, Homo sapiens; identical to SEQ ID NO: 35606
  misc_feature 1..340: note = chr15:28351758-28352098
  misc_feature 1..340: note = hyper
  source 1..340: mol_type = genomic DNA

SEQ ID NO: 56239 - DNA, 22 bp, Homo sapiens
  misc_feature 1..22: note = chr15:28352099-28352121
  misc_feature 1..22: note = hyper
  source 1..22: mol_type = genomic DNA
ggctctggccccacggtgagcc

SEQ ID NO: 56240 - DNA, 88 bp, Homo sapiens; identical to SEQ ID NO: 22018
  misc_feature 1..88: note = chr15:28352152-28352240
  misc_feature 1..88: note = hyper
  source 1..88: mol_type = genomic DNA

SEQ ID NO: 56241 - DNA, 43 bp, Homo sapiens; identical to SEQ ID NO: 35609
  misc_feature 1..43: note = chr15:28352957-28353000
  misc_feature 1..43: note = hyper
  source 1..43: mol_type = genomic DNA

SEQ ID NO: 56242 - DNA, 48 bp, Homo sapiens
  misc_feature 1..48: note = chr15:29077236-29077284
  misc_feature 1..48: note = hyper
  source 1..48: mol_type = genomic DNA
tgagaaactgacttccgtaggagtgcgggtgtgcgtgcgtgccgcgga

SEQ ID NO: 56243 - DNA, 11 bp, Homo sapiens
  misc_feature 1..11: note = chr15:29077383-29077394
  misc_feature 1..11: note = hyper
  source 1..11: mol_type = genomic DNA
gagcggcgaag

SEQ ID NO: 56244 - DNA, 196 bp, Homo sapiens; identical to SEQ ID NO: 35611
  misc_feature 1..196: note = chr15:29077428-29077624
  misc_feature 1..196: note = hyper
  source 1..196: mol_type = genomic DNA

SEQ ID NO: 56245 - DNA, 51 bp, Homo sapiens; identical to SEQ ID NO: 35612
  misc_feature 1..51: note = chr15:29077646-29077697
  misc_feature 1..51: note = hyper
  source 1..51: mol_type = genomic DNA

SEQ ID NO: 56246 - DNA, 79 bp, Homo sapiens
  misc_feature 1..79: note = chr15:29130728-29130807
  misc_feature 1..79: note = hyper
  source 1..79: mol_type = genomic DNA
gccgagcaagcagggcgcggcggccggggcaaggtgcggagcctcgcgttcaccggctctacctgcggagcctcgcgtt

SEQ ID NO: 56247 - DNA, 32 bp, Homo sapiens; identical to SEQ ID NO: 22023
  misc_feature 1..32: note = chr15:29131875-29131907
  misc_feature 1..32: note = hyper
  source 1..32: mol_type = genomic DNA

SEQ ID NO: 56248 - DNA, 174 bp, Homo sapiens; identical to SEQ ID NO: 35616
  misc_feature 1..174: note = chr15:29407300-29407474
  misc_feature 1..174: note = hyper
  source 1..174: mol_type = genomic DNA

SEQ ID NO: 56249 - skipped

SEQ ID NO: 56250 - DNA, 30 bp, Homo sapiens; identical to SEQ ID NO: 35619
  misc_feature 1..30: note = chr15:29561245-29561275
  misc_feature 1..30: note = hyper
  source 1..30: mol_type = genomic DNA

SEQ ID NO: 56251 - DNA, 524 bp, Homo sapiens; identical to SEQ ID NO: 35620
  misc_feature 1..524: note = chr15:29861915-29862439
  misc_feature 1..524: note = hyper
  source 1..524: mol_type = genomic DNA

SEQ ID NO: 56252 - DNA, 43 bp, Homo sapiens; identical to SEQ ID NO: 35621
  misc_feature 1..43: note = chr15:29863048-29863091
  misc_feature 1..43: note = hyper
  source 1..43: mol_type = genomic DNA

SEQ ID NO: 56253 - DNA, 70 bp, Homo sapiens; identical to SEQ ID NO: 35622
  misc_feature 1..70: note = chr15:29863540-29863610
  misc_feature 1..70: note = hyper
  source 1..70: mol_type = genomic DNA

SEQ ID NO: 56254 - DNA, 90 bp, Homo sapiens; identical to SEQ ID NO: 12105
  misc_feature 1..90: note = chr15:30260547-30260637
  misc_feature 1..90: note = hyper
  source 1..90: mol_type = genomic DNA

SEQ ID NO: 56255 - DNA, 331 bp, Homo sapiens; identical to SEQ ID NO: 35624
  misc_feature 1..331: note = chr15:30260871-30261202
  misc_feature 1..331: note = hyper
  source 1..331: mol_type = genomic DNA

SEQ ID NO: 56256 - DNA, 181 bp, Homo sapiens; identical to SEQ ID NO: 35625
  misc_feature 1..181: note = chr15:31775293-31775474
  misc_feature 1..181: note = hyper
  source 1..181: mol_type = genomic DNA

SEQ ID NO: 56257 - DNA, 113 bp, Homo sapiens; identical to SEQ ID NO: 22030
  misc_feature 1..113: note = chr15:31775483-31775596
  misc_feature 1..113: note = hyper
  source 1..113: mol_type = genomic DNA

SEQ ID NO: 56258 - skipped

SEQ ID NO: 56259 - DNA, 67 bp, Homo sapiens; identical to SEQ ID NO: 35629
  misc_feature 1..67: note = chr15:32162215-32162282
  misc_feature 1..67: note = hyper
  source 1..67: mol_type = genomic DNA

SEQ ID NO: 56260 - DNA, 130 bp, Homo sapiens; identical to SEQ ID NO: 35630
  misc_feature 1..130: note = chr15:32322366-32322496
  misc_feature 1..130: note = hyper
  source 1..130: mol_type = genomic DNA

SEQ ID NO: 56261 - DNA, 114 bp, Homo sapiens
  misc_feature 1..114: note = chr15:33009633-33009747
  misc_feature 1..114: note = hyper
  source 1..114: mol_type = genomic DNA
gggcgccggggtcagcgccctcgaagttgggggcctcgggcggggccgccggggagccacgacggccgctcgaccagagcatcccgcagtcccgttccctccagaggggaagaa

SEQ ID NO: 56262 - DNA, 21 bp, Homo sapiens
  misc_feature 1..21: note = chr15:33011348-33011369
  misc_feature 1..21: note = hyper
  source 1..21: mol_type = genomic DNA
agcttgcggagcaaggccata

SEQ ID NO: 56263 - DNA, 38 bp, Homo sapiens
  misc_feature 1..38: note = chr15:33011633-33011671
  misc_feature 1..38: note = hyper
  source 1..38: mol_type = genomic DNA
ctaatgcattcccgggtcgaatccgtctactgccttcc

SEQ ID NO: 56264 - DNA, 30 bp, Homo sapiens; identical to SEQ ID NO: 35637
  misc_feature 1..30: note = chr15:33486950-33486980
  misc_feature 1..30: note = hyper
  source 1..30: mol_type = genomic DNA

SEQ ID NO: 56265 - DNA, 308 bp, Homo sapiens
  misc_feature 1..308: note = chr15:33602886-33603194
  misc_feature 1..308: note = hyper
  source 1..308: mol_type = genomic DNA
cgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgc

SEQ ID NO: 56266 - DNA, 128 bp, Homo sapiens; identical to SEQ ID NO: 35639
  misc_feature 1..128: note = chr15:33603647-33603775
  misc_feature 1..128: note = hyper
  source 1..128: mol_type = genomic DNA

SEQ ID NO: 56267 - DNA, 627 bp, Homo sapiens
  misc_feature 1..627: note = chr15:34728851-34729478
  misc_feature 1..627: note = hyper
  source 1..627: mol_type = genomic DNA
gggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgct

SEQ ID NO: 56268 - DNA, 41 bp, Homo sapiens
  misc_feature 1..41: note = chr15:34729582-34729623
  misc_feature 1..41: note = hyper
  source 1..41: mol_type = genomic DNA
aggttccccagcttacctggccagggcgcggggctgccccg

SEQ ID NO: 56269 - DNA, 89 bp, Homo sapiens; identical to SEQ ID NO: 35641
  misc_feature 1..89: note = chr15:34729954-34730043
  misc_feature 1..89: note = hyper
  source 1..89: mol_type = genomic DNA

SEQ ID NO: 56270 - DNA, 169 bp, Homo sapiens
  misc_feature 1..169: note = chr15:34787304-34787473
  misc_feature 1..169: note = hyper
  source 1..169: mol_type = genomic DNA
cgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatc

SEQ ID NO: 56271 - DNA, 34 bp, Homo sapiens; identical to SEQ ID NO: 12120
  misc_feature 1..34: note = chr15:34806507-34806541
  misc_feature 1..34: note = hyper
  source 1..34: mol_type = genomic DNA

SEQ ID NO: 56272 - DNA, 378 bp, Homo sapiens; identical to SEQ ID NO: 35645
  misc_feature 1..378: note = chr15:34806978-34807356
  misc_feature 1..378: note = hyper
  source 1..378: mol_type = genomic DNA

SEQ ID NO: 56273 - DNA, 40 bp, Homo sapiens; identical to SEQ ID NO: 35646
  misc_feature 1..40: note = chr15:35014171-35014211
  misc_feature 1..40: note = hyper
  source 1..40: mol_type = genomic DNA

SEQ ID NO: 56274 - DNA, 16 bp, Homo sapiens
  misc_feature 1..16: note = chr15:35047133-35047149
  misc_feature 1..16: note = hyper
  source 1..16: mol_type = genomic DNA
ccggcgcggcagcctg

SEQ ID NO: 56275 - DNA, 424 bp, Homo sapiens; identical to SEQ ID NO: 35648
  misc_feature 1..424: note = chr15:35047293-35047717
  misc_feature 1..424: note = hyper
  source 1..424: mol_type = genomic DNA

SEQ ID NO: 56276 - DNA, 12 bp, Homo sapiens
  misc_feature 1..12: note = chr15:35087698-35087710
  misc_feature 1..12: note = hyper
  source 1..12: mol_type = genomic DNA
tgactcaccgtc

SEQ ID NO: 56277 - DNA, 30 bp, Homo sapiens; identical to SEQ ID NO: 35650
  misc_feature 1..30: note = chr15:37175266-37175296
  misc_feature 1..30: note = hyper
  source 1..30: mol_type = genomic DNA

SEQ ID NO: 56278 - DNA, 55 bp, Homo sapiens; identical to SEQ ID NO: 22040
  misc_feature 1..55: note = chr15:37180743-37180798
  misc_feature 1..55: note = hyper
  source 1..55: mol_type = genomic DNA

SEQ ID NO: 56279 - DNA, 44 bp, Homo sapiens; identical to SEQ ID NO: 35652
  misc_feature 1..44: note = chr15:37394668-37394712
  misc_feature 1..44: note = hyper
  source 1..44: mol_type = genomic DNA

SEQ ID NO: 56280 - DNA, 59 bp, Homo sapiens; identical to SEQ ID NO: 35655
  misc_feature 1..59: note = chr15:39873175-39873234
  misc_feature 1..59: note = hyper
  source 1..59: mol_type = genomic DNA

SEQ ID NO: 56281 - DNA, 30 bp, Homo sapiens; identical to SEQ ID NO: 35656
  misc_feature 1..30: note = chr15:39873453-39873483
  misc_feature 1..30: note = hyper
  source 1..30: mol_type = genomic DNA

SEQ ID NO: 56282 - DNA, 58 bp, Homo sapiens
  misc_feature 1..58: note = chr15:40211761-40211819
  misc_feature 1..58: note = hyper
  source 1..58: mol_type = genomic DNA
cacccaggagcattccgccggggccatctgaggagggggactcccgcctggatcccgc

SEQ ID NO: 56283 - DNA, 54 bp, Homo sapiens; identical to SEQ ID NO: 22042
  misc_feature 1..54: note = chr15:40212190-40212244
  misc_feature 1..54: note = hyper
  source 1..54: mol_type = genomic DNA

SEQ ID NO: 56284 - DNA, 30 bp, Homo sapiens; identical to SEQ ID NO: 35658
  misc_feature 1..30: note = chr15:40212680-40212710
  misc_feature 1..30: note = hyper
  source 1..30: mol_type = genomic DNA

SEQ ID NO: 56285 - DNA, 660 bp, Homo sapiens; identical to SEQ ID NO: 35659
  misc_feature 1..660: note = chr15:40544738-40545398
  misc_feature 1..660: note = hyper
  source 1..660: mol_type = genomic DNA

SEQ ID NO: 56286 - DNA, 117 bp, Homo sapiens
  misc_feature 1..117: note = chr15:40575513-40575630
  misc_feature 1..117: note = hyper
  source 1..117: mol_type = genomic DNA
gagcggttcctcctccgcgctcccctgggaatgcggcggcggttgcggggcgggggcgggggctgctcgccgggggccacatgcacccaaccgggccaatcccaaagtcgcagtctt

SEQ ID NO: 56287 - DNA, 53 bp, Homo sapiens
  misc_feature 1..53: note = chr15:40575744-40575797
  misc_feature 1..53: note = hyper
  source 1..53: mol_type = genomic DNA
ggaattgggaccccatgagcgcagaactggaccacgcgcgagctaggggtggc

SEQ ID NO: 56288 - DNA, 156 bp, Homo sapiens; identical to SEQ ID NO: 35661
  misc_feature 1..156: note = chr15:41787106-41787262
  misc_feature 1..156: note = hyper
  source 1..156: mol_type = genomic DNA

SEQ ID NO: 56289 - DNA, 145 bp, Homo sapiens
  misc_feature 1..145: note = chr15:41804733-41804878
  misc_feature 1..145: note = hyper
  source 1..145: mol_type = genomic DNA
gggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgt

SEQ ID NO: 56290 - DNA, 40 bp, Homo sapiens
  misc_feature 1..40: note = chr15:41805772-41805812
  misc_feature 1..40: note = hyper
  source 1..40: mol_type = genomic DNA
aaccactgacacctggcctgttgaccggccacccccaagc

SEQ ID NO: 56291 - DNA, 54 bp, Homo sapiens; identical to SEQ ID NO: 35663
  misc_feature 1..54: note = chr15:41877632-41877686
  misc_feature 1..54: note = hyper
  source 1..54: mol_type = genomic DNA

SEQ ID NO: 56292 - DNA, 45 bp, Homo sapiens; identical to SEQ ID NO: 35664
  misc_feature 1..45: note = chr15:41913327-41913372
  misc_feature 1..45: note = hyper
  source 1..45: mol_type = genomic DNA

SEQ ID NO: 56293 - DNA, 17 bp, Homo sapiens
  misc_feature 1..17: note = chr15:41913733-41913750
  misc_feature 1..17: note = hyper
  source 1..17: mol_type = genomic DNA
tccgggacccgcgagcg

SEQ ID NO: 56294 - DNA, 144 bp, Homo sapiens
  misc_feature 1..144: note = chr15:41913807-41913951
  misc_feature 1..144: note = hyper
  source 1..144: mol_type = genomic DNA
tgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagc

SEQ ID NO: 56295 - DNA, 97 bp, Homo sapiens
  misc_feature 1..97: note = chr15:41952475-41952572
  misc_feature 1..97: note = hyper
  source 1..97: mol_type = genomic DNA
ctgctgctctggggccgtttggactcctggtgttgggggaggggtcagggaggtgctgctcgcgtctccttttgcgcctgcgcggcgggctccgagc

SEQ ID NO: 56296 - DNA, 84 bp, Homo sapiens
  misc_feature 1..84: note = chr15:41952711-41952795
  misc_feature 1..84: note = hyper
  source 1..84: mol_type = genomic DNA
acgccccgcacggtaactctcgggcctgggtggagggcatcgcttagtactggcccgattggagtttttcgagagtttgaagct

SEQ ID NO: 56297 - DNA, 30 bp, Homo sapiens; identical to SEQ ID NO: 35667
  misc_feature 1..30: note = chr15:42868444-42868474
  misc_feature 1..30: note = hyper
  source 1..30: mol_type = genomic DNA

SEQ ID NO: 56298 - DNA, 57 bp, Homo sapiens; identical to SEQ ID NO: 35668
  misc_feature 1..57: note = chr15:43810817-43810874
  misc_feature 1..57: note = hyper
  source 1..57: mol_type = genomic DNA

SEQ ID NO: 56299 - DNA, 170 bp, Homo sapiens; identical to SEQ ID NO: 35669
  misc_feature 1..170: note = chr15:44486726-44486896
  misc_feature 1..170: note = hyper
  source 1..170: mol_type = genomic DNA

SEQ ID NO: 56300 - DNA, 37 bp, Homo sapiens
  misc_feature 1..37: note = chr15:45403599-45403636
  misc_feature 1..37: note = hyper
  source 1..37: mol_type = genomic DNA
cgttctgcccggtggcggggtcgggcgccgcccacat

SEQ ID NO: 56301 - DNA, 52 bp, Homo sapiens
  misc_feature 1..52: note = chr15:45404130-45404182
  misc_feature 1..52: note = hyper
  source 1..52: mol_type = genomic DNA
cacgtcggaaagaacatggtagcctgcgggcatggggcgccaatacgtgaca

SEQ ID NO: 56302 - DNA, 42 bp, Homo sapiens; identical to SEQ ID NO: 22052
  misc_feature 1..42: note = chr15:45405117-45405159
  misc_feature 1..42: note = hyper
  source 1..42: mol_type = genomic DNA

SEQ ID NO: 56303 - DNA, 67 bp, Homo sapiens; identical to SEQ ID NO: 35674
  misc_feature 1..67: note = chr15:45405416-45405483
  misc_feature 1..67: note = hyper
  source 1..67: mol_type = genomic DNA

SEQ ID NO: 56304 - DNA, 239 bp, Homo sapiens; identical to SEQ ID NO: 35675
  misc_feature 1..239: note = chr15:45406627-45406866
  misc_feature 1..239: note = hyper
  source 1..239: mol_type = genomic DNA

SEQ ID NO: 56305 - DNA, 28 bp, Homo sapiens
  misc_feature 1..28: note = chr15:45406867-45406895
  misc_feature 1..28: note = hyper
  source 1..28: mol_type = genomic DNA
ttccactgctcatcgttattctagtgtt

SEQ ID NO: 56306 - DNA, 246 bp, Homo sapiens
  misc_feature 1..246: note = chr15:45421435-45421681
  misc_feature 1..246: note = hyper
  source 1..246: mol_type = genomic DNA
tggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctgg

SEQ ID NO: 56307 - DNA, 140 bp, Homo sapiens; identical to SEQ ID NO: 35678
  misc_feature 1..140: note = chr15:45421706-45421846
  misc_feature 1..140: note = hyper
  source 1..140: mol_type = genomic DNA

SEQ ID NO: 56308 - DNA, 201 bp, Homo sapiens
  misc_feature 1..201: note = chr15:45427410-45427611
  misc_feature 1..201: note = hyper
  source 1..201: mol_type = genomic DNA
cggggacgtggtgctgcccttccagagaagccgctgggaccccgagaccggacggagtcccagcaatccccgggacccggtgaggcggggaaggcggcgggaagggaccgcaccccagccaggtgggacctgggcttcgggcctggcagggcctggaggggagaggcgcccactccccagccgcggacacccgccgggccc

SEQ ID NO: 56309 - DNA, 67 bp, Homo sapiens
  misc_feature 1..67: note = chr15:45427786-45427853
  misc_feature 1..67: note = hyper
  source 1..67: mol_type = genomic DNA
cttttccccgagactcgcagaaccccctgctcatgtgggcggcgcccgaccccgccaccgggcagaa

SEQ ID NO: 56310 - DNA, 14 bp, Homo sapiens
  misc_feature 1..14: note = chr15:45479446-45479460
  misc_feature 1..14: note = hyper
  source 1..14: mol_type = genomic DNA
agagtttggggctt

SEQ ID NO: 56311 - DNA, 59 bp, Homo sapiens; identical to SEQ ID NO: 35682
  misc_feature 1..59: note = chr15:45479774-45479833
  misc_feature 1..59: note = hyper
  source 1..59: mol_type = genomic DNA

SEQ ID NO: 56312 - DNA, 247 bp, Homo sapiens
  misc_feature 1..247: note = chr15:47477018-47477265
  misc_feature 1..247: note = hyper
  source 1..247: mol_type = genomic DNA
ctgggcgagttggatccgggtcggcagccggctgaaccgccacgctgccccgctttttttattttctttttagatacggcatctaattggtgggtgctgggaggcagggctggttgggtgagcacgagtacctgggtgtagggaacgacctaccttcttgctttccttggggtttagaggggaaggggtgggggcacccagagccccgaagcccggagcgtcccgcgctagcgggcttgcgcgcggc

SEQ ID NO: 56313 - DNA, 158 bp, Homo sapiens; identical to SEQ ID NO: 35686
  misc_feature 1..158: note = chr15:47477354-47477512
  misc_feature 1..158: note = hyper
  source 1..158: mol_type = genomic DNA

SEQ ID NO: 56314 - DNA, 146 bp, Homo sapiens; identical to SEQ ID NO: 35687
  misc_feature 1..146: note = chr15:48009524-48009670
  misc_feature 1..146: note = hyper
  source 1..146: mol_type = genomic DNA

SEQ ID NO: 56315 - DNA, 81 bp, Homo sapiens; identical to SEQ ID NO: 35688
  misc_feature 1..81: note = chr15:48009881-48009962
  misc_feature 1..81: note = hyper
  source 1..81: mol_type = genomic DNA

SEQ ID NO: 56316 - DNA, 740 bp, Homo sapiens; identical to SEQ ID NO: 35689
  misc_feature 1..740: note = chr15:48010082-48010822
  misc_feature 1..740: note = hyper
  source 1..740: mol_type = genomic DNA

SEQ ID NO: 56317 - DNA, 49 bp, Homo sapiens; identical to SEQ ID NO: 35690
  misc_feature 1..49: note = chr15:48011314-48011363
  misc_feature 1..49: note = hyper
  source 1..49: mol_type = genomic DNA

SEQ ID NO: 56318 - DNA, 143 bp, Homo sapiens; identical to SEQ ID NO: 35691
  misc_feature 1..143: note = chr15:48470373-48470516
  misc_feature 1..143: note = hyper
  source 1..143: mol_type = genomic DNA

SEQ ID NO: 56319 - DNA, 72 bp, Homo sapiens; identical to SEQ ID NO: 35692
  misc_feature 1..72: note = chr15:48470517-48470589
  misc_feature 1..72: note = hyper
  source 1..72: mol_type = genomic DNA

SEQ ID NO: 56320 - DNA, 225 bp, Homo sapiens; identical to SEQ ID NO: 22061
  misc_feature 1..225: note = chr15:48937987-48938212
  misc_feature 1..225: note = hyper
  source 1..225: mol_type = genomic DNA

SEQ ID NO: 56321 - DNA, 80 bp, Homo sapiens
  misc_feature 1..80: note = chr15:48938510-48938590
  misc_feature 1..80: note = hyper
  source 1..80: mol_type = genomic DNA
tgccgaccgaggagagggctctgccgcccccacttgccctgggtgtcgagagcccactccagacgcggctcttctgaggc

SEQ ID NO: 56322 - DNA, 67 bp, Homo sapiens
  misc_feature 1..67: note = chr15:51385846-51385913
  misc_feature 1..67: note = hyper
  source 1..67: mol_type = genomic DNA
tcagagctgcacaagcgccgggagctgtgggcacgtgaggagggcgagcgggtcctaggtgcgtaga

SEQ ID NO: 56323 - DNA, 39 bp, Homo sapiens
  misc_feature 1..39: note = chr15:51386181-51386220
  misc_feature 1..39: note = hyper
  source 1..39: mol_type = genomic DNA
ccttctccgccggctgcgcggcagcgatggaccctgtgc

SEQ ID NO: 56324 - DNA, 414 bp, Homo sapiens; identical to SEQ ID NO: 12151
  misc_feature 1..414: note = chr15:51559380-51559794
  misc_feature 1..414: note = hyper
  source 1..414: mol_type = genomic DNA

SEQ ID NO: 56325 - DNA, 86 bp, Homo sapiens
  misc_feature 1..86: note = chr15:51633989-51634075
  misc_feature 1..86: note = hyper
  source 1..86: mol_type = genomic DNA
gcgctgtgccagtggcgcgggctgagctcggcgctgcgggctttggaggcgcagcggggccgggagcagcgcgaggacagtgccct

SEQ ID NO: 56326 - DNA, 70 bp, Homo sapiens
  misc_feature 1..70: note = chr15:53075739-53075809
  misc_feature 1..70: note = hyper
  source 1..70: mol_type = genomic DNA
cggcctccgaaggccctttcacccaccccacacaagaggaaacaaagacttctcagctcaaggcctcagg

SEQ ID NO: 56327 - DNA, 165 bp, Homo sapiens; identical to SEQ ID NO: 22065
  misc_feature 1..165: note = chr15:53077361-53077526
  misc_feature 1..165: note = hyper
  source 1..165: mol_type = genomic DNA

SEQ ID NO: 56328 - DNA, 59 bp, Homo sapiens
  misc_feature 1..59: note = chr15:53078005-53078064
  misc_feature 1..59: note = hyper
  source 1..59: mol_type = genomic DNA
ggaatttcctcctgtcgcccttcttccaccagccgctgttatttcgtgaccggaaggcg

SEQ ID NO: 56329 - DNA, 251 bp, Homo sapiens; identical to SEQ ID NO: 35704
  misc_feature 1..251: note = chr15:53078741-53078992
  misc_feature 1..251: note = hyper
  source 1..251: mol_type = genomic DNA

SEQ ID NO: 56330 - DNA, 76 bp, Homo sapiens; identical to SEQ ID NO: 22068
  misc_feature 1..76: note = chr15:53079264-53079340
  misc_feature 1..76: note = hyper
  source 1..76: mol_type = genomic DNA

SEQ ID NO: 56331 - DNA, 38 bp, Homo sapiens
  misc_feature 1..38: note = chr15:53080299-53080337
  misc_feature 1..38: note = hyper
  source 1..38: mol_type = genomic DNA
actgggaccttgggacggtcagcctccctctcctttcc

SEQ ID NO: 56332 - skipped

SEQ ID NO: 56333 - DNA, 243 bp, Homo sapiens; identical to SEQ ID NO: 4229
  misc_feature 1..243: note = chr15:53081054-53081297
  misc_feature 1..243: note = hyper
  source 1..243: mol_type = genomic DNA

SEQ ID NO: 56334 - DNA, 343 bp, Homo sapiens
  misc_feature 1..343: note = chr15:53081677-53082020
  misc_feature 1..343: note = hyper
  source 1..343: mol_type = genomic DNA
gggtggtggtggtgatggtggtggtggtgatggtgggggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggca

SEQ ID NO: 56335 - DNA, 285 bp, Homo sapiens; identical to SEQ ID NO: 35712
  misc_feature 1..285: note = chr15:53082758-53083043
  misc_feature 1..285: note = hyper
  source 1..285: mol_type = genomic DNA

SEQ ID NO: 56336 - DNA, 19 bp, Homo sapiens
  misc_feature 1..19: note = chr15:53083116-53083135
  misc_feature 1..19: note = hyper
  source 1..19: mol_type = genomic DNA
cgttgacccggcacccttc

SEQ ID NO: 56337 - DNA, 13 bp, Homo sapiens
  misc_feature 1..13: note = chr15:53083136-53083149
  misc_feature 1..13: note = hyper
  source 1..13: mol_type = genomic DNA
tcctcccagatac

SEQ ID NO: 56338 - DNA, 1070 bp, Homo sapiens
  misc_feature 1..1070: note = chr15:53095746-53096816
  misc_feature 1..1070: note = hyper
  source 1..1070: mol_type = genomic DNA
tcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtc

SEQ ID NO: 56339 - DNA, 340 bp, Homo sapiens
  misc_feature 1..340: note = chr15:53096891-53097231
  misc_feature 1..340: note = hyper
  source 1..340: mol_type = genomic DNA
tccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatct

SEQ ID NO: 56340 - DNA, 308 bp, Homo sapiens
  misc_feature 1..308: note = chr15:53097261-53097569
  misc_feature 1..308: note = hyper
  source 1..308: mol_type = genomic DNA
gctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgc

SEQ ID NO: 56341 - DNA, 32 bp, Homo sapiens; identical to SEQ ID NO: 22079
  misc_feature 1..32: note = chr15:53098658-53098690
  misc_feature 1..32: note = hyper
  source 1..32: mol_type = genomic DNA

SEQ ID NO: 56342 - DNA, 111 bp, Homo sapiens; identical to SEQ ID NO: 35718
  misc_feature 1..111: note = chr15:54051776-54051887
  misc_feature 1..111: note = hyper
  source 1..111: mol_type = genomic DNA

SEQ ID NO: 56343 - DNA, 190 bp, Homo sapiens; identical to SEQ ID NO: 22081
  misc_feature 1..190: note = chr15:54270707-54270897
  misc_feature 1..190: note = hyper
  source 1..190: mol_type = genomic DNA

SEQ ID NO: 56344 - DNA, 32 bp, Homo sapiens; identical to SEQ ID NO: 35720
  misc_feature 1..32: note = chr15:55879909-55879941
  misc_feature 1..32: note = hyper
  source 1..32: mol_type = genomic DNA

SEQ ID NO: 56345 - DNA, 607 bp, Homo sapiens; identical to SEQ ID NO: 35721
  misc_feature 1..607: note = chr15:55880176-55880783
  misc_feature 1..607: note = hyper
  source 1..607: mol_type = genomic DNA

SEQ ID NO: 56346 - DNA, 42 bp, Homo sapiens; identical to SEQ ID NO: 35723
  misc_feature 1..42: note = chr15:56034387-56034429
  misc_feature 1..42: note = hyper
  source 1..42: mol_type = genomic DNA

SEQ ID NO: 56347 - DNA, 72 bp, Homo sapiens; identical to SEQ ID NO: 35724
  misc_feature 1..72: note = chr15:56034651-56034723
  misc_feature 1..72: note = hyper
  source 1..72: mol_type = genomic DNA

SEQ ID NO: 56348 - DNA, 375 bp, Homo sapiens; identical to SEQ ID NO: 35725
  misc_feature 1..375: note = chr15:56034885-56035260
  misc_feature 1..375: note = hyper
  source 1..375: mol_type = genomic DNA

SEQ ID NO: 56349 - DNA, 206 bp, Homo sapiens; identical to SEQ ID NO: 35726
  misc_feature 1..206: note = chr15:56035304-56035510
  misc_feature 1..206: note = hyper
  source 1..206: mol_type = genomic DNA

SEQ ID NO: 56350 - DNA, 65 bp, Homo sapiens; identical to SEQ ID NO: 35727
  misc_feature 1..65: note = chr15:58357155-58357220
  misc_feature 1..65: note = hyper
  source 1..65: mol_type = genomic DNA

SEQ ID NO: 56351 - DNA, 241 bp, Homo sapiens; identical to SEQ ID NO: 35729
  misc_feature 1..241: note = chr15:58358522-58358763
  misc_feature 1..241: note = hyper
  source 1..241: mol_type = genomic DNA

SEQ ID NO: 56352 - DNA, 159 bp, Homo sapiens; identical to SEQ ID NO: 35730
  misc_feature 1..159: note = chr15:59729656-59729815
  misc_feature 1..159: note = hyper
  source 1..159: mol_type = genomic DNA

SEQ ID NO: 56353 - DNA, 30 bp, Homo sapiens; identical to SEQ ID NO: 35731
  misc_feature 1..30: note = chr15:60286804-60286834
  misc_feature 1..30: note = hyper
  source 1..30: mol_type = genomic DNA

SEQ ID NO: 56354 - DNA, 22 bp, Homo sapiens
  misc_feature 1..22: note = chr15:60288844-60288866
  misc_feature 1..22: note = hyper
  source 1..22: mol_type = genomic DNA
ccccactcgccaaccacctgat

SEQ ID NO: 56355 - DNA, 80 bp, Homo sapiens
  misc_feature 1..80: note = chr15:60289546-60289626
  misc_feature 1..80: note = hyper
  source 1..80: mol_type = genomic DNA
cttagctgggggaggccagcacggatcagccgctttctttcttttctctctttctttttcaaacccgctttgtgggtggc

SEQ ID NO: 56356 - DNA, 30 bp, Homo sapiens; identical to SEQ ID NO: 35736
  misc_feature 1..30: note = chr15:60289876-60289906
  misc_feature 1..30: note = hyper
  source 1..30: mol_type = genomic DNA

SEQ ID NO: 56357 - DNA, 30 bp, Homo sapiens; identical to SEQ ID NO: 35737
  misc_feature 1..30: note = chr15:60292201-60292231
  misc_feature 1..30: note = hyper
  source 1..30: mol_type = genomic DNA

SEQ ID NO: 56358 - DNA, 205 bp, Homo sapiens; identical to SEQ ID NO: 22084
  misc_feature 1..205: note = chr15:60295917-60296122
  misc_feature 1..205: note = hyper
  source 1..205: mol_type = genomic DNA

SEQ ID NO: 56359 - DNA, 62 bp, Homo sapiens
  misc_feature 1..62: note = chr15:60296209-60296271
  misc_feature 1..62: note = hyper
  source 1..62: mol_type = genomic DNA
tcacacggcgcacaccggccggcgcgtccagctgcctgcccagtggccgaggctcttccccc

SEQ ID NO: 56360 - DNA, 115 bp, Homo sapiens
  misc_feature 1..115: note = chr15:60296483-60296598
  misc_feature 1..115: note = hyper
  source 1..115: mol_type = genomic DNA
ttctgctcctgtcaccgcttaaaactatcagatggttcgagggaggacatggaggcagccacctagctcagcggagacgcggagcccacagcagcgccctccggagccctaacac

SEQ ID NO: 56361 - DNA, 228 bp, Homo sapiens
  misc_feature 1..228: note = chr15:60297409-60297637
  misc_feature 1..228: note = hyper
  source 1..228: mol_type = genomic DNA
agggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcg

SEQ ID NO: 56362 - DNA, 71 bp, Homo sapiens
  misc_feature 1..71: note = chr15:60298108-60298179
  misc_feature 1..71: note = hyper
  source 1..71: mol_type = genomic DNA
cctccgccttgcactcggtggcggtgcactgacccgcaggagcccacgccccctctcgttctcctccccac

SEQ ID NO: 56363 - DNA, 49 bp, Homo sapiens; identical to SEQ ID NO: 35743
  misc_feature 1..49: note = chr15:60883305-60883354
  misc_feature 1..49: note = hyper
  source 1..49: mol_type = genomic DNA

SEQ ID NO: 56364 - DNA, 136 bp, Homo sapiens; identical to SEQ ID NO: 35744
  misc_feature 1..136: note = chr15:61519885-61520021
  misc_feature 1..136: note = hyper
  source 1..136: mol_type = genomic DNA

SEQ ID NO: 56365 - DNA, 54 bp, Homo sapiens; identical to SEQ ID NO: 35745
  misc_feature 1..54: note = chr15:61520408-61520462
  misc_feature 1..54: note = hyper
  source 1..54: mol_type = genomic DNA

SEQ ID NO: 56366 - DNA, 143 bp, Homo sapiens
  misc_feature 1..143: note = chr15:61520773-61520916
  misc_feature 1..143: note = hyper
  source 1..143: mol_type = genomic DNA
tcgggcagccagggccgaaactgtcaagaggagaaaaggtaaagcggaaggagggtggccataaacagatttttttgccccttcttaaaaggacactgccgctttaaaagtttctttcccgggcccccactccccgcatctcc

SEQ ID NO: 56367 - DNA, 94 bp, Homo sapiens; identical to SEQ ID NO: 35747
  misc_feature 1..94: note = chr15:61521200-61521294
  misc_feature 1..94: note = hyper
  source 1..94: mol_type = genomic DNA

SEQ ID NO: 56368 - DNA, 161 bp, Homo sapiens; identical to SEQ ID NO: 35748
  misc_feature 1..161: note = chr15:61521311-61521472
  misc_feature 1..161: note = hyper
  source 1..161: mol_type = genomic DNA

SEQ ID NO: 56369 - DNA, 10 bp, Homo sapiens
  misc_feature 1..10: note = chr15:61521937-61521947
  misc_feature 1..10: note = hyper
  source 1..10: mol_type = genomic DNA
ccagcttggg

SEQ ID NO: 56370 - DNA, 32 bp, Homo sapiens; identical to SEQ ID NO: 35750
  misc_feature 1..32: note = chr15:62456269-62456301
  misc_feature 1..32: note = hyper
  source 1..32: mol_type = genomic DNA

SEQ ID NO: 56371 - DNA, 21 bp, Homo sapiens
  misc_feature 1..21: note = chr15:62456901-62456922
  misc_feature 1..21: note = hyper
  source 1..21: mol_type = genomic DNA
cacacggggcaggtgcggcag

SEQ ID NO: 56372 - DNA, 141 bp, Homo sapiens; identical to SEQ ID NO: 35752
  misc_feature 1..141: note = chr15:62457155-62457296
  misc_feature 1..141: note = hyper
  source 1..141: mol_type = genomic DNA

SEQ ID NO: 56373 - DNA, 176 bp, Homo sapiens; identical to SEQ ID NO: 35753
  misc_feature 1..176: note = chr15:63334493-63334669
  misc_feature 1..176: note = hyper
  source 1..176: mol_type = genomic DNA

SEQ ID NO: 56374 - DNA, 30 bp, Homo sapiens; identical to SEQ ID NO: 35754
  misc_feature 1..30: note = chr15:63335974-63336004
  misc_feature 1..30: note = hyper
  source 1..30: mol_type = genomic DNA

SEQ ID NO: 56375 - DNA, 38 bp, Homo sapiens; identical to SEQ ID NO: 35755
  misc_feature 1..38: note = chr15:63673771-63673809
  misc_feature 1..38: note = hyper
  source 1..38: mol_type = genomic DNA

SEQ ID NO: 56376 - DNA, 36 bp, Homo sapiens; identical to SEQ ID NO: 35756
  misc_feature 1..36: note = chr15:65204199-65204235
  misc_feature 1..36: note = hyper
  source 1..36: mol_type = genomic DNA

SEQ ID NO: 56377 - DNA, 121 bp, Homo sapiens; identical to SEQ ID NO: 35757
  misc_feature 1..121: note = chr15:65360172-65360293
  misc_feature 1..121: note = hyper
  source 1..121: mol_type = genomic DNA

SEQ ID NO: 56378 - DNA, 76 bp, Homo sapiens; identical to SEQ ID NO: 35758
  misc_feature 1..76: note = chr15:65360323-65360399
  misc_feature 1..76: note = hyper
  source 1..76: mol_type = genomic DNA

SEQ ID NO: 56379 - DNA, 15 bp, Homo sapiens
  misc_feature 1..15: note = chr15:65648085-65648100
  misc_feature 1..15: note = hyper
  source 1..15: mol_type = genomic DNA
gaatccggcattgtg

SEQ ID NO: 56380 - DNA, 15 bp, Homo sapiens
  misc_feature 1..15: note = chr15:65648136-65648151
  misc_feature 1..15: note = hyper
  source 1..15: mol_type = genomic DNA
cgcacgccaaacgag

SEQ ID NO: 56381 - DNA, 530 bp, Homo sapiens; identical to SEQ ID NO: 35761
  misc_feature 1..530: note = chr15:65669295-65669825
  misc_feature 1..530: note = hyper
  source 1..530: mol_type = genomic DNA

SEQ ID NO: 56382 - DNA, 151 bp, Homo sapiens; identical to SEQ ID NO: 35762
  misc_feature 1..151: note = chr15:65670634-65670785
  misc_feature 1..151: note = hyper
  source 1..151: mol_type = genomic DNA

SEQ ID NO: 56383 - DNA, 185 bp, Homo sapiens; identical to SEQ ID NO: 35763
  misc_feature 1..185: note = chr15:65714138-65714323
  misc_feature 1..185: note = hyper
  source 1..185: mol_type = genomic DNA

SEQ ID NO: 56384 - DNA, 18 bp, Homo sapiens
  misc_feature 1..18: note = chr15:65714819-65714837
  misc_feature 1..18: note = hyper
  source 1..18: mol_type = genomic DNA
ccatggcacgcactgcgg

SEQ ID NO: 56385 - DNA, 38 bp, Homo sapiens; identical to SEQ ID NO: 35765
  misc_feature 1..38: note = chr15:65715098-65715136
  misc_feature 1..38: note = hyper
  source 1..38: mol_type = genomic DNA

SEQ ID NO: 56386 - DNA, 120 bp, Homo sapiens; identical to SEQ ID NO: 35766
  misc_feature 1..120: note = chr15:65715528-65715648
  misc_feature 1..120: note = hyper
  source 1..120: mol_type = genomic DNA

SEQ ID NO: 56387 - DNA, 121 bp, Homo sapiens; identical to SEQ ID NO: 35767
  misc_feature 1..121: note = chr15:68112086-68112207
  misc_feature 1..121: note = hyper
  source 1..121: mol_type = genomic DNA

SEQ ID NO: 56388 - DNA, 59 bp, Homo sapiens
  misc_feature 1..59: note = chr15:68112552-68112611
  misc_feature 1..59: note = hyper
  source 1..59: mol_type = genomic DNA
aacctaattaactgacgaaaactgccgttaattcaactagtaaaagatatgtgcttgcg

SEQ ID NO: 56389 - DNA, 237 bp, Homo sapiens; identical to SEQ ID NO: 35769
  misc_feature 1..237: note = chr15:68113226-68113463
  misc_feature 1..237: note = hyper
  source 1..237: mol_type = genomic DNA

SEQ ID NO: 56390 - DNA, 117 bp, Homo sapiens
  misc_feature 1..117: note = chr15:68113751-68113868
  misc_feature 1..117: note = hyper
  source 1..117: mol_type = genomic DNA
gctaagaataattaccgaacgagattgtaattatggggtgggggagcctgggccgagggagagggaatgagctggcggggacttgggggcagctctcggactgggaaggaaaatagg

SEQ ID NO: 56391 - DNA, 241 bp, Homo sapiens
  misc_feature 1..241: note = chr15:68113898-68114139
  misc_feature 1..241: note = hyper
  source 1..241: mol_type = genomic DNA
aggaaagacagcgggatagttggagcgggacagaggcacagcctgggaaagacacccgaatggaggggccagaggcagaaagaaaggggccgagcgggttccaggactcccctgggagaaaagggaaaggcagggagatccgagacagaaagaccggaaccgaggagggggaagagggcaagaacgcgatctaaaagagaccctcagaggagacagagcccacaaacttgggagaggtttt

SEQ ID NO: 56392 - DNA, 251 bp, Homo sapiens
  misc_feature 1..251: note = chr15:68114195-68114446
  misc_feature 1..251: note = hyper
  source 1..251: mol_type = genomic DNA
ggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcgg

SEQ ID NO: 56393 - DNA, 30 bp, Homo sapiens; identical to SEQ ID NO: 35771
  misc_feature 1..30: note = chr15:68114981-68115011
  misc_feature 1..30: note = hyper
  source 1..30: mol_type = genomic DNA

SEQ ID NO: 56394 - DNA, 1093 bp, Homo sapiens
  misc_feature 1..1093: note = chr15:68115276-68116369
  misc_feature 1..1093: note = hyper
  source 1..1093: mol_type = genomic DNA
caccaccctggccctcgcctgcggccggaaagtgaagtactcctccctgcgcccgttcctcttgagtcccccttagccccatcacccggttttggcccagaccaaaactggctccttggccgggagcactgggccctccccacttcgttcttggggacaaactttatggccccagggcctttcctccctcctggcctctccagctagagcgggacgcaggtgcagggtgctggacgcaggtgtgcggccgcttacctggggcgtgcaggccttgggctgcggggaggcggcgggcgccgcgcgtggcccgcgggcgggcggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccagga

SEQ ID NO: 56395 - DNA, 365 bp, Homo sapiens
  misc_feature 1..365: note = chr15:68117465-68117830
  misc_feature 1..365: note = hyper
  source 1..365: mol_type = genomic DNA
aatctttctgctcaacgaacgcgggcgccagccgtgagaggagaagctcgggtttgtggaaactggcaatgttgtcccctgaagccggctcgggcaccaagctgggtgcggtgggggccgcgctaggtccgggtgcgcaccgagcgctttggagagggtcaggttcagcaccgcgaacagcggtagcctccgcctctctccttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcaga

SEQ ID NO: 56396 - DNA, 41 bp, Homo sapiens
  misc_feature 1..41: note = chr15:68118633-68118674
  misc_feature 1..41: note = hyper
  source 1..41: mol_type = genomic DNA
gcgagaggccgaacgcctgtgcaagtcgttcctgggcgagc

SEQ ID NO: 56397 - DNA, 38 bp, Homo sapiens; identical to SEQ ID NO: 35775
  misc_feature 1..38: note = chr15:68120630-68120668
  misc_feature 1..38: note = hyper
  source 1..38: mol_type = genomic DNA

SEQ ID NO: 56398 - skipped

SEQ ID NO: 56399 - DNA, 174 bp, Homo sapiens
  misc_feature 1..174: note = chr15:68122469-68122643
  misc_feature 1..174: note = hyper
  source 1..174: mol_type = genomic DNA
ggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagcc

SEQ ID NO: 56400 - DNA, 35 bp, Homo sapiens
  misc_feature 1..35: note = chr15:68122673-68122708
  misc_feature 1..35: note = hyper
  source 1..35: mol_type = genomic DNA
ccaggagctgggacccaggtcgcccaggttcccag

SEQ ID NO: 56401 - DNA, 38 bp, Homo sapiens; identical to SEQ ID NO: 22098
  misc_feature 1..38: note = chr15:68125223-68125261
  misc_feature 1..38: note = hyper
  source 1..38: mol_type = genomic DNA

SEQ ID NO: 56402 - DNA, 47 bp, Homo sapiens; identical to SEQ ID NO: 22099
  misc_feature 1..47: note = chr15:68125664-68125711
  misc_feature 1..47: note = hyper
  source 1..47: mol_type = genomic DNA

SEQ ID NO: 56403 - DNA, 297 bp, Homo sapiens; identical to SEQ ID NO: 35780
  misc_feature 1..297: note = chr15:68125947-68126244
  misc_feature 1..297: note = hyper
  source 1..297: mol_type = genomic DNA

SEQ ID NO: 56404 - DNA, 85 bp, Homo sapiens; identical to SEQ ID NO: 35781
  misc_feature 1..85: note = chr15:68126922-68127007
  misc_feature 1..85: note = hyper
  source 1..85: mol_type = genomic DNA

SEQ ID NO: 56405 - DNA, 35 bp, Homo sapiens; identical to SEQ ID NO: 22101
  misc_feature 1..35: note = chr15:68127766-68127801
  misc_feature 1..35: note = hyper
  source 1..35: mol_type = genomic DNA

SEQ ID NO: 56406 - DNA, 152 bp, Homo sapiens
  misc_feature 1..152: note = chr15:68128350-68128502
  misc_feature 1..152: note = hyper
  source 1..152: mol_type = genomic DNA
gggcgggacagcgcgggtgtgggagtttgccggcccctttccccaccgcggattgcacctttggaagctgcacttttcttctctgtaaaatgggcatcaccattaccacccaggcaggaagttccgtggctgcggctcgacagaggagccag

SEQ ID NO: 56407 - DNA, 40 bp, Homo sapiens; identical to SEQ ID NO: 35784
  misc_feature 1..40: note = chr15:68549442-68549482
  misc_feature 1..40: note = hyper
  source 1..40: mol_type = genomic DNA

SEQ ID NO: 56408 - DNA, 65 bp, Homo sapiens; identical to SEQ ID NO: 35785
  misc_feature 1..65: note = chr15:68569420-68569485
  misc_feature 1..65: note = hyper
  source 1..65: mol_type = genomic DNA

SEQ ID NO: 56409 - DNA, 529 bp, Homo sapiens; identical to SEQ ID NO: 35786
  misc_feature 1..529: note = chr15:68723523-68724052
  misc_feature 1..529: note = hyper
  source 1..529: mol_type = genomic DNA

SEQ ID NO: 56410 - DNA, 265 bp, Homo sapiens; identical to SEQ ID NO: 35787
  misc_feature 1..265: note = chr15:68870820-68871085
  misc_feature 1..265: note = hyper
  source 1..265: mol_type = genomic DNA

SEQ ID NO: 56411 - DNA, 173 bp, Homo sapiens; identical to SEQ ID NO: 35788
  misc_feature 1..173: note = chr15:69136224-69136397
  misc_feature 1..173: note = hyper
  source 1..173: mol_type = genomic DNA

SEQ ID NO: 56412 - DNA, 30 bp, Homo sapiens; identical to SEQ ID NO: 35789
  misc_feature 1..30: note = chr15:69366538-69366568
  misc_feature 1..30: note = hyper
  source 1..30: mol_type = genomic DNA

SEQ ID NO: 56413 - DNA, 86 bp, Homo sapiens; identical to SEQ ID NO: 35790
  misc_feature 1..86: note = chr15:70877578-70877664
  misc_feature 1..86: note = hyper
  source 1..86: mol_type = genomic DNA

SEQ ID NO: 56414 - DNA, 43 bp, Homo sapiens; identical to SEQ ID NO: 35791
  misc_feature 1..43: note = chr15:71055227-71055270
  misc_feature 1..43: note = hyper
  source 1..43: mol_type = genomic DNA

SEQ ID NO: 56415 - DNA, 37 bp, Homo sapiens; identical to SEQ ID NO: 35792
  misc_feature 1..37: note = chr15:71055857-71055894
  misc_feature 1..37: note = hyper
  source 1..37: mol_type = genomic DNA

SEQ ID NO: 56416 - DNA, 79 bp, Homo sapiens; identical to SEQ ID NO: 35793
  misc_feature 1..79: note = chr15:71146120-71146199
  misc_feature 1..79: note = hyper
  source 1..79: mol_type = genomic DNA

SEQ ID NO: 56417 - DNA, 131 bp, Homo sapiens; identical to SEQ ID NO: 35794
  misc_feature 1..131: note = chr15:71408456-71408587
  misc_feature 1..131: note = hyper
  source 1..131: mol_type = genomic DNA

SEQ ID NO: 56418 - DNA, 143 bp, Homo sapiens; identical to SEQ ID NO: 35795
  misc_feature 1..143: note = chr15:72476743-72476886
  misc_feature 1..143: note = hyper
  source 1..143: mol_type = genomic DNA

SEQ ID NO: 56419 - DNA, 101 bp, Homo sapiens; identical to SEQ ID NO: 35796
  misc_feature 1..101: note = chr15:72490031-72490132
  misc_feature 1..101: note = hyper
  source 1..101: mol_type = genomic DNA

SEQ ID NO: 56420 - DNA, 211 bp, Homo sapiens; identical to SEQ ID NO: 35797
  misc_feature 1..211: note = chr15:72564738-72564949
  misc_feature 1..211: note = hyper
  source 1..211: mol_type = genomic DNA

SEQ ID NO: 56421 - DNA, 30 bp, Homo sapiens; identical to SEQ ID NO: 35798
  misc_feature 1..30: note = chr15:72565377-72565407
  misc_feature 1..30: note = hyper
  source 1..30: mol_type = genomic DNA

SEQ ID NO: 56422 - DNA, 30 bp, Homo sapiens; identical to SEQ ID NO: 35799
  misc_feature 1..30: note = chr15:73611158-73611188
  misc_feature 1..30: note = hyper
  source 1..30: mol_type = genomic DNA

SEQ ID NO: 56423 - DNA, 404 bp, Homo sapiens; identical to SEQ ID NO: 22108
  misc_feature 1..404: note = chr15:73659600-73660004
  misc_feature 1..404: note = hyper
  source 1..404: mol_type = genomic DNA

SEQ ID NO: 56424 - DNA, 260 bp, Homo sapiens; identical to SEQ ID NO: 22109
  misc_feature 1..260: note = chr15:73660067-73660327
  misc_feature 1..260: note = hyper
  source 1..260: mol_type = genomic DNA

SEQ ID NO: 56425 - DNA, 278 bp, Homo sapiens; identical to SEQ ID NO: 35801
  misc_feature 1..278: note = chr15:73660446-73660724
  misc_feature 1..278: note = hyper
  source 1..278: mol_type = genomic DNA

SEQ ID NO: 56426 - DNA, 132 bp, Homo sapiens; identical to SEQ ID NO: 35802
  misc_feature 1..132: note = chr15:73660793-73660925
  misc_feature 1..132: note = hyper
  source 1..132: mol_type = genomic DNA

SEQ ID NO: 56427 - DNA, 186 bp, Homo sapiens
  misc_feature 1..186: note = chr15:73661666-73661852
  misc_feature 1..186: note = hyper
  source 1..186: mol_type = genomic DNA
tcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcg

SEQ ID NO: 56428 - DNA, 164 bp, Homo sapiens; identical to SEQ ID NO: 35804
  misc_feature 1..164: note = chr15:74044686-74044850
  misc_feature 1..164: note = hyper
  source 1..164: mol_type = genomic DNA

SEQ ID NO: 56429 - DNA, 12 bp, Homo sapiens
  misc_feature 1..12: note = chr15:74045097-74045109
  misc_feature 1..12: note = hyper
  source 1..12: mol_type = genomic DNA
tccgaaaggtcc

SEQ ID NO: 56430 - DNA, 44 bp, Homo sapiens; identical to SEQ ID NO: 35806
  misc_feature 1..44: note = chr15:74045854-74045898
  misc_feature 1..44: note = hyper
  source 1..44: mol_type = genomic DNA

SEQ ID NO: 56431 - DNA, 24 bp, Homo sapiens
  misc_feature 1..24: note = chr15:74421982-74422006
  misc_feature 1..24: note = hyper
  source 1..24: mol_type = genomic DNA
cgctgaaagaaatgtcggggtttc

SEQ ID NO: 56432 - DNA, 471 bp, Homo sapiens; identical to SEQ ID NO: 35808
  misc_feature 1..471: note = chr15:74422386-74422857
  misc_feature 1..471: note = hyper
  source 1..471: mol_type = genomic DNA

SEQ ID NO: 56433 - DNA, 30 bp, Homo sapiens; identical to SEQ ID NO: 12214
  misc_feature 1..30: note = chr15:74428205-74428235
  misc_feature 1..30: note = hyper
  source 1..30: mol_type = genomic DNA

SEQ ID NO: 56434 - DNA, 322 bp, Homo sapiens; identical to SEQ ID NO: 35810
  misc_feature 1..322: note = chr15:74428801-74429123
  misc_feature 1..322: note = hyper
  source 1..322: mol_type = genomic DNA

SEQ ID NO: 56435 - DNA, 56 bp, Homo sapiens
  misc_feature 1..56: note = chr15:74658095-74658151
  misc_feature 1..56: note = hyper
  source 1..56: mol_type = genomic DNA
ctcgggtgaacgcagcgagcgagggcagaggccagcagaggcgaggagtggatgct

SEQ ID NO: 56436 - DNA, 10 bp, Homo sapiens
  misc_feature 1..10: note = chr15:74658587-74658597
  misc_feature 1..10: note = hyper
  source 1..10: mol_type = genomic DNA
gtgctctgac

SEQ ID NO: 56437 - DNA, 140 bp, Homo sapiens; identical to SEQ ID NO: 35814
  misc_feature 1..140: note = chr15:75119374-75119514
  misc_feature 1..140: note = hyper
  source 1..140: mol_type = genomic DNA

SEQ ID NO: 56438 - DNA, 30 bp, Homo sapiens; identical to SEQ ID NO: 35815
  misc_feature 1..30: note = chr15:75250808-75250838
  misc_feature 1..30: note = hyper
  source 1..30: mol_type = genomic DNA

SEQ ID NO: 56439 - DNA, 252 bp, Homo sapiens
  misc_feature 1..252: note = chr15:75251094-75251346
  misc_feature 1..252: note = hyper
  source 1..252: mol_type = genomic DNA
ggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtgg

SEQ ID NO: 56440 - DNA, 32 bp, Homo sapiens
  misc_feature 1..32: note = chr15:75251382-75251414
  misc_feature 1..32: note = hyper
  source 1..32: mol_type = genomic DNA
ttgggctgcacgatcacttggaagggattggg

SEQ ID NO: 56441 - DNA, 194 bp, Homo sapiens
  misc_feature 1..194: note = chr15:75251478-75251672
  misc_feature 1..194: note = hyper
  source 1..194: mol_type = genomic DNA
cggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatg

SEQ ID NO: 56442 - DNA, 25 bp, Homo sapiens
  misc_feature 1..25: note = chr15:75251786-75251811
  misc_feature 1..25: note = hyper
  source 1..25: mol_type = genomic DNA
ggggtgggggcgggagatgcgggga

SEQ ID NO: 56443 - DNA, 15 bp, Homo sapiens
  misc_feature 1..15: note = chr15:75470896-75470911
  misc_feature 1..15: note = hyper
  source 1..15: mol_type = genomic DNA
ctgtggggggtgggg

SEQ ID NO: 56444 - DNA, 15 bp, Homo sapiens
  misc_feature 1..15: note = chr15:75471217-75471232
  misc_feature 1..15: note = hyper
  source 1..15: mol_type = genomic DNA
cggtttccccatctg

SEQ ID NO: 56445 - DNA, 34 bp, Homo sapiens; identical to SEQ ID NO: 35820
  misc_feature 1..34: note = chr15:76005149-76005183
  misc_feature 1..34: note = hyper
  source 1..34: mol_type = genomic DNA

SEQ ID NO: 56446 - DNA, 25 bp, Homo sapiens
  misc_feature 1..25: note = chr15:76627826-76627851
  misc_feature 1..25: note = hyper
  source 1..25: mol_type = genomic DNA
cccacccaggcgcacaccaagttct

SEQ ID NO: 56447 - DNA, 30 bp, Homo sapiens; identical to SEQ ID NO: 35823
  misc_feature 1..30: note = chr15:76628327-76628357
  misc_feature 1..30: note = hyper
  source 1..30: mol_type = genomic DNA

SEQ ID NO: 56448 - DNA, 462 bp, Homo sapiens; identical to SEQ ID NO: 4252
  misc_feature 1..462: note = chr15:76628564-76629026
  misc_feature 1..462: note = hyper
  source 1..462: mol_type = genomic DNA

SEQ ID NO: 56449 - DNA, 162 bp, Homo sapiens
  misc_feature 1..162: note = chr15:76630847-76631009
  misc_feature 1..162: note = hyper
  source 1..162: mol_type = genomic DNA
tctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctg

SEQ ID NO: 56450 - DNA, 74 bp, Homo sapiens; identical to SEQ ID NO: 35829
  misc_feature 1..74: note = chr15:76632517-76632591
  misc_feature 1..74: note = hyper
  source 1..74: mol_type = genomic DNA

SEQ ID NO: 56451 - DNA, 159 bp, Homo sapiens; identical to SEQ ID NO: 35830
  misc_feature 1..159: note = chr15:76634951-76635110
  misc_feature 1..159: note = hyper
  source 1..159: mol_type = genomic DNA

SEQ ID NO: 56452 - DNA, 155 bp, Homo sapiens
  misc_feature 1..155: note = chr15:76638317-76638472
  misc_feature 1..155: note = hyper
  source 1..155: mol_type = genomic DNA
ggtcagctgttagggcgtgggggagggagggggcagggagcagggacgaggaagtggaagaataggggattgtgaggagtgatttctttccagattatcgagactcaagactttccagaacgtggcaaagagccctggaagaaatgtcccaggaa

SEQ ID NO: 56453 - DNA, 120 bp, Homo sapiens; identical to SEQ ID NO: 35832
  misc_feature 1..120: note = chr15:76638855-76638975
  misc_feature 1..120: note = hyper
  source 1..120: mol_type = genomic DNA

SEQ ID NO: 56454 - DNA, 158 bp, Homo sapiens; identical to SEQ ID NO: 35833
  misc_feature 1..158: note = chr15:77924553-77924711
  misc_feature 1..158: note = hyper
  source 1..158: mol_type = genomic DNA

SEQ ID NO: 56455 - DNA, 159 bp, Homo sapiens; identical to SEQ ID NO: 35834
  misc_feature 1..159: note = chr15:77927216-77927375
  misc_feature 1..159: note = hyper
  source 1..159: mol_type = genomic DNA

SEQ ID NO: 56456 - DNA, 429 bp, Homo sapiens; identical to SEQ ID NO: 35835
  misc_feature 1..429: note = chr15:78111440-78111869
  misc_feature 1..429: note = hyper
  source 1..429: mol_type = genomic DNA

SEQ ID NO: 56457 - DNA, 400 bp, Homo sapiens; identical to SEQ ID NO: 35836
  misc_feature 1..400: note = chr15:78111916-78112316
  misc_feature 1..400: note = hyper
  source 1..400: mol_type = genomic DNA

SEQ ID NO: 56458 - DNA, 300 bp, Homo sapiens; identical to SEQ ID NO: 35837
  misc_feature 1..300: note = chr15:78236768-78237068
  misc_feature 1..300: note = hyper
  source 1..300: mol_type = genomic DNA

SEQ ID NO: 56459 - DNA, 113 bp, Homo sapiens; identical to SEQ ID NO: 35838
  misc_feature 1..113: note = chr15:78632556-78632669
  misc_feature 1..113: note = hyper
  source 1..113: mol_type = genomic DNA

SEQ ID NO: 56460 - DNA, 39 bp, Homo sapiens; identical to SEQ ID NO: 35839
  misc_feature 1..39: note = chr15:78632683-78632722
  misc_feature 1..39: note = hyper
  source 1..39: mol_type = genomic DNA

SEQ ID NO: 56461 - DNA, 74 bp, Homo sapiens; identical to SEQ ID NO: 35840
  misc_feature 1..74: note = chr15:78633047-78633121
  misc_feature 1..74: note = hyper
  source 1..74: mol_type = genomic DNA

SEQ ID NO: 56462 - DNA, 50 bp, Homo sapiens
  misc_feature 1..50: note = chr15:78912231-78912281
  misc_feature 1..50: note = hyper
  source 1..50: mol_type = genomic DNA
tcccaggcaggaggtcggttgagagcgtatggcgttctgagtagtgcagg

SEQ ID NO: 56463 - DNA, 182 bp, Homo sapiens; identical to SEQ ID NO: 22123
  misc_feature 1..182: note = chr15:78912441-78912623
  misc_feature 1..182: note = hyper
  source 1..182: mol_type = genomic DNA

SEQ ID NO: 56464 - DNA, 259 bp, Homo sapiens
  misc_feature 1..259: note = chr15:78912653-78912912
  misc_feature 1..259: note = hyper
  source 1..259: mol_type = genomic DNA
tgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagcc

SEQ ID NO: 56465 - DNA, 242 bp, Homo sapiens; identical to SEQ ID NO: 35843
  misc_feature 1..242: note = chr15:78913228-78913470
  misc_feature 1..242: note = hyper
  source 1..242: mol_type = genomic DNA

SEQ ID NO: 56466 - DNA, 55 bp, Homo sapiens; identical to SEQ ID NO: 22125
  misc_feature 1..55: note = chr15:78913480-78913535
  misc_feature 1..55: note = hyper
  source 1..55: mol_type = genomic DNA

SEQ ID NO: 56467 - DNA, 30 bp, Homo sapiens
  misc_feature 1..30: note = chr15:78913651-78913681
  misc_feature 1..30: note = hyper
  source 1..30: mol_type = genomic DNA
atgctattaaataattgttaaatattttag

SEQ ID NO: 56468 - DNA, 253 bp, Homo sapiens; identical to SEQ ID NO: 35845
  misc_feature 1..253: note = chr15:78933391-78933644
  misc_feature 1..253: note = hyper
  source 1..253: mol_type = genomic DNA

SEQ ID NO: 56469 - DNA, 36 bp, Homo sapiens; identical to SEQ ID NO: 35846
  misc_feature 1..36: note = chr15:79103265-79103301
  misc_feature 1..36: note = hyper
  source 1..36: mol_type = genomic DNA

SEQ ID NO: 56470 - DNA, 215 bp, Homo sapiens; identical to SEQ ID NO: 22128
  misc_feature 1..215: note = chr15:79382571-79382786
  misc_feature 1..215: note = hyper
  source 1..215: mol_type = genomic DNA

SEQ ID NO: 56471 - DNA, 11 bp, Homo sapiens
  misc_feature 1..11: note = chr15:79383257-79383268
  misc_feature 1..11: note = hyper
  source 1..11: mol_type = genomic DNA
ggtgcctcctc

SEQ ID NO: 56472 - DNA, 56 bp, Homo sapiens; identical to SEQ ID NO: 35849
  misc_feature 1..56: note = chr15:79383328-79383384
  misc_feature 1..56: note = hyper
  source 1..56: mol_type = genomic DNA

SEQ ID NO: 56473 - DNA, 509 bp, Homo sapiens
  misc_feature 1..509: note = chr15:79383438-79383947
  misc_feature 1..509: note = hyper
  source 1..509: mol_type = genomic DNA
cgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattc

SEQ ID NO: 56474 - DNA, 169 bp, Homo sapiens; identical to SEQ ID NO: 22131
  misc_feature 1..169: note = chr15:79383977-79384146
  misc_feature 1..169: note = hyper
  source 1..169: mol_type = genomic DNA

SEQ ID NO: 56475 - DNA, 147 bp, Homo sapiens
  misc_feature 1..147: note = chr15:79502064-79502211
  misc_feature 1..147: note = hyper
  source 1..147: mol_type = genomic DNA
cgccgggaaatcaaacgtccatttacatcttgtcctgcaaagcttcatcaaaacttctttgccggccagtcacgtccccttatcacttttccagcccagctttgtgactgtaagtgttggacggagaactgataagggtaggtgatt

SEQ ID NO: 56476 - DNA, 499 bp, Homo sapiens
  misc_feature 1..499: note = chr15:79574779-79575278
  misc_feature 1..499: note = hyper
  source 1..499: mol_type = genomic DNA
agaacaaaggggacacgagttcaaattcctgccagggtctgagacctgcaacgtcagactttgggagcgtcccctcacttctccggaccccaggagtggccgcgcctgctccgcgctcaccctcggggagtctaggagccccctgctaagttgctgagcgagtcggagccccaagagctagggtcgagggggtggggcagcaggcgcctctgccgaggctgcaggtaggcacttccccacccccgcggccccctccttcctccttcctcgcagctcgcacacccacacaaccctcgcccgtcgcggctggagagctgctctcggcgccagcgggcagcagcgcgtcgtcagccagcacagccggccgaagaccaagccggaggtctggggctgcgcagagacctgcacacccgcagcgcggaaccgggggcgattcctatctttctttcatgcttctttctttttcttaaaaccaaaccaaaccaaaccaaacccaaaa

SEQ ID NO: 56477 - DNA, 25 bp, Homo sapiens
  misc_feature 1..25: note = chr15:79575474-79575499
  misc_feature 1..25: note = hyper
  source 1..25: mol_type = genomic DNA
gggtgctggacgccccctgattttg

SEQ ID NO: 56478 - DNA, 85 bp, Homo sapiens; identical to SEQ ID NO: 22135
  misc_feature 1..85: note = chr15:79576060-79576145
  misc_feature 1..85: note = hyper
  source 1..85: mol_type = genomic DNA

SEQ ID NO: 56479 - DNA, 35 bp, Homo sapiens
  misc_feature 1..35: note = chr15:79576277-79576312
  misc_feature 1..35: note = hyper
  source 1..35: mol_type = genomic DNA
atctgcttctaactgcttcccgtgactgcagaagg

SEQ ID NO: 56480 - DNA, 15 bp, Homo sapiens
  misc_feature 1..15: note = chr15:79724105-79724120
  misc_feature 1..15: note = hyper
  source 1..15: mol_type = genomic DNA
ccccgcgggtggctc

SEQ ID NO: 56481 - DNA, 151 bp, Homo sapiens; identical to SEQ ID NO: 22137
  misc_feature 1..151: note = chr15:79724351-79724502
  misc_feature 1..151: note = hyper
  source 1..151: mol_type = genomic DNA

SEQ ID NO: 56482 - DNA, 282 bp, Homo sapiens
  misc_feature 1..282: note = chr15:79725140-79725422
  misc_feature 1..282: note = hyper
  source 1..282: mol_type = genomic DNA
gagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttc

SEQ ID NO: 56483 - DNA, 30 bp, Homo sapiens; identical to SEQ ID NO: 35858
  misc_feature 1..30: note = chr15:80543967-80543997
  misc_feature 1..30: note = hyper
  source 1..30: mol_type = genomic DNA

SEQ ID NO: 56484 - DNA, 133 bp, Homo sapiens; identical to SEQ ID NO: 35859
  misc_feature 1..133: note = chr15:80544203-80544336
  misc_feature 1..133: note = hyper
  source 1..133: mol_type = genomic DNA

SEQ ID NO: 56485 - DNA, 302 bp, Homo sapiens; identical to SEQ ID NO: 35860
  misc_feature 1..302: note = chr15:80544364-80544666
  misc_feature 1..302: note = hyper
  source 1..302: mol_type = genomic DNA

SEQ ID NO: 56486 - DNA, 38 bp, Homo sapiens; identical to SEQ ID NO: 35861
  misc_feature 1..38: note = chr15:81073195-81073233
  misc_feature 1..38: note = hyper
  source 1..38: mol_type = genomic DNA

SEQ ID NO: 56487 - DNA, 119 bp, Homo sapiens
  misc_feature 1..119: note = chr15:82336760-82336879
  misc_feature 1..119: note = hyper
  source 1..119: mol_type = genomic DNA
cgcgccgttgagtgccgtgttcttattccgggaggcgcggatcatggagaagtgctcggcagcagagatgatctccctccgagccatggccacatcctccttcctgcccgtcacaacaa

SEQ ID NO: 56488 - DNA, 244 bp, Homo sapiens
  misc_feature 1..244: note = chr15:82336972-82337216
  misc_feature 1..244: note = hyper
  source 1..244: mol_type = genomic DNA
aggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccattggctgcctggccctcccccagtgactgcagtcgtcccgaaccaaac

SEQ ID NO: 56489 - DNA, 166 bp, Homo sapiens
  misc_feature 1..166: note = chr15:82339904-82340070
  misc_feature 1..166: note = hyper
  source 1..166: mol_type = genomic DNA
aacaatgaggccatgcggccgcagccgcacacgggctgactggggagatctcgtggtgccgcggggcggtcccggggctcgaaggcagaggctcccctaggtgtgccctgcctgaccccggctacaggaacgagcgctgtgggcctcggtttctcacccgtaaaat

SEQ ID NO: 56490 - DNA, 30 bp, Homo sapiens; identical to SEQ ID NO: 22141
  misc_feature 1..30: note = chr15:82340157-82340187
  misc_feature 1..30: note = hyper
  source 1..30: mol_type = genomic DNA

SEQ ID NO: 56491 - DNA, 381 bp, Homo sapiens
  misc_feature 1..381: note = chr15:83314955-83315336
  misc_feature 1..381: note = hyper
  source 1..381: mol_type = genomic DNA
agcagacactcttcccgctagcaagggaccgcaccgtcacctgaggggcagccaagaggcgggcggtgcacctgtgccttccagaataggaaccccacccacttgcccctcttccccaccaacgacacagcccagtagttgactcaggtgccaggagagagcgcggggaggctgggcggtagccagggagaccaagggaagcggttgccagagaaatgcggcgtcagtcagggccggggctgcaggcgcggggcgggggaggagagacgcggcctcctcccaggcgggcctggcgggaggcaccccggcttctaagagcgaattcggctcccgactctcttcccccagctgagagcacggtgcaaggggccagggctgcag

SEQ ID NO: 56492 - DNA, 20 bp, Homo sapiens
  misc_feature 1..20: note = chr15:83316231-83316251
  misc_feature 1..20: note = hyper
  source 1..20: mol_type = genomic DNA
cgtgcgacggcagtgtgaga

SEQ ID NO: 56493 - DNA, 322 bp, Homo sapiens
  misc_feature 1..322: note = chr15:83348912-83349234
  misc_feature 1..322: note = hyper
  source 1..322: mol_type = genomic DNA
cgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcg

SEQ ID NO: 56494 - DNA, 50 bp, Homo sapiens
  misc_feature 1..50: note = chr15:83349686-83349736
  misc_feature 1..50: note = hyper
  source 1..50: mol_type = genomic DNA
agagtttccggtagtttttgtgaatcaggtcgatgcgctccgggcagacc

SEQ ID NO: 56495 - DNA, 30 bp, Homo sapiens; identical to SEQ ID NO: 35869
  misc_feature 1..30: note = chr15:83378057-83378087
  misc_feature 1..30: note = hyper
  source 1..30: mol_type = genomic DNA

SEQ ID NO: 56496 - DNA, 30 bp, Homo sapiens; identical to SEQ ID NO: 35870
  misc_feature 1..30: note = chr15:83378625-83378655
  misc_feature 1..30: note = hyper
  source 1..30: mol_type = genomic DNA

SEQ ID NO: 56497 - DNA, 165 bp, Homo sapiens; identical to SEQ ID NO: 12261
  misc_feature 1..165: note = chr15:83378857-83379022
  misc_feature 1..165: note = hyper
  source 1..165: mol_type = genomic DNA

SEQ ID NO: 56498 - DNA, 127 bp, Homo sapiens; identical to SEQ ID NO: 35872
  misc_feature 1..127: note = chr15:83620954-83621081
  misc_feature 1..127: note = hyper
  source 1..127: mol_type = genomic DNA

SEQ ID NO: 56499 - DNA, 28 bp, Homo sapiens
  misc_feature 1..28: note = chr15:83775821-83775849
  misc_feature 1..28: note = hyper
  source 1..28: mol_type = genomic DNA
gccaggtttaaaaaccggatgccggctc

SEQ ID NO: 56500 - DNA, 112 bp, Homo sapiens; identical to SEQ ID NO: 35874
  misc_feature 1..112: note = chr15:83775890-83776002
  misc_feature 1..112: note = hyper
  source 1..112: mol_type = genomic DNA

SEQ ID NO: 56501 - DNA, 116 bp, Homo sapiens; identical to SEQ ID NO: 4273
  misc_feature 1..116: note = chr15:83776022-83776138
  misc_feature 1..116: note = hyper
  source 1..116: mol_type = genomic DNA

SEQ ID NO: 56502 - DNA, 98 bp, Homo sapiens; identical to SEQ ID NO: 22150
  misc_feature 1..98: note = chr15:83776157-83776255
  misc_feature 1..98: note = hyper
  source 1..98: mol_type = genomic DNA

SEQ ID NO: 56503 - DNA, 95 bp, Homo sapiens
  misc_feature 1..95: note = chr15:83776785-83776880
  misc_feature 1..95: note = hyper
  source 1..95: mol_type = genomic DNA
gtcacaggcgtcaatacggccatgcccctgccctggaggggcccaggggccggtggggagcggaacaaacacggacactacgaacctggccgtgt

SEQ ID NO: 56504 - DNA, 182 bp, Homo sapiens
  misc_feature 1..182: note = chr15:83875901-83876083
  misc_feature 1..182: note = hyper
  source 1..182: mol_type = genomic DNA
gccgggagcccttgcctcagccccggcccggtcttcttcgtgccgcgccgccctcagccctcaccacagccggccgcgagctgcgggctcggggctgaggcgatggggaaagggggcgggcgcgccatcatgaaggggaaaatggtgggcgggcgggcccgcgcgcggccgcggtactcacc

SEQ ID NO: 56505 - DNA, 282 bp, Homo sapiens; identical to SEQ ID NO: 35881
  misc_feature 1..282: note = chr15:83876201-83876483
  misc_feature 1..282: note = hyper
  source 1..282: mol_type = genomic DNA

SEQ ID NO: 56506 - DNA, 401 bp, Homo sapiens
  misc_feature 1..401: note = chr15:83876654-83877055
  misc_feature 1..401: note = hyper
  source 1..401: mol_type = genomic DNA
cgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgct

SEQ ID NO: 56507 - DNA, 216 bp, Homo sapiens; identical to SEQ ID NO: 35883
  misc_feature 1..216: note = chr15:83951897-83952113
  misc_feature 1..216: note = hyper
  source 1..216: mol_type = genomic DNA

SEQ ID NO: 56508 - DNA, 54 bp, Homo sapiens; identical to SEQ ID NO: 35884
  misc_feature 1..54: note = chr15:83952768-83952822
  misc_feature 1..54: note = hyper
  source 1..54: mol_type = genomic DNA

SEQ ID NO: 56509 - DNA, 34 bp, Homo sapiens; identical to SEQ ID NO: 35885
  misc_feature 1..34: note = chr15:84034378-84034412
  misc_feature 1..34: note = hyper
  source 1..34: mol_type = genomic DNA

SEQ ID NO: 56510 - DNA, 34 bp, Homo sapiens
  misc_feature 1..34: note = chr15:84115713-84115747
  misc_feature 1..34: note = hyper
  source 1..34: mol_type = genomic DNA
ttgtccctccctaggcgcatttctgagccttcct

SEQ ID NO: 56511 - DNA, 171 bp, Homo sapiens
  misc_feature 1..171: note = chr15:84115966-84116137
  misc_feature 1..171: note = hyper
  source 1..171: mol_type = genomic DNA
gccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcgg

SEQ ID NO: 56512 - DNA, 176 bp, Homo sapiens; identical to SEQ ID NO: 35889
  misc_feature 1..176: note = chr15:84116377-84116553
  misc_feature 1..176: note = hyper
  source 1..176: mol_type = genomic DNA

SEQ ID NO: 56513 - DNA, 113 bp, Homo sapiens; identical to SEQ ID NO: 35890
  misc_feature 1..113: note = chr15:84116651-84116764
  misc_feature 1..113: note = hyper
  source 1..113: mol_type = genomic DNA

SEQ ID NO: 56514 - DNA, 49 bp, Homo sapiens; identical to SEQ ID NO: 35891
  misc_feature 1..49: note = chr15:84116828-84116877
  misc_feature 1..49: note = hyper
  source 1..49: mol_type = genomic DNA

SEQ ID NO: 56515 - DNA, 121 bp, Homo sapiens; identical to SEQ ID NO: 35892
  misc_feature 1..121: note = chr15:84322476-84322597
  misc_feature 1..121: note = hyper
  source 1..121: mol_type = genomic DNA

SEQ ID NO: 56516 - DNA, 47 bp, Homo sapiens
  misc_feature 1..47: note = chr15:84748531-84748578
  misc_feature 1..47: note = hyper
  source 1..47: mol_type = genomic DNA
attatttacctggcccgggtggcattttactttgcatccttgattgg

SEQ ID NO: 56517 - DNA, 138 bp, Homo sapiens
  misc_feature 1..138: note = chr15:84749260-84749398
  misc_feature 1..138: note = hyper
  source 1..138: mol_type = genomic DNA
gggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactt

SEQ ID NO: 56518 - DNA, 316 bp, Homo sapiens
  misc_feature 1..316: note = chr15:88799221-88799537
  misc_feature 1..316: note = hyper
  source 1..316: mol_type = genomic DNA
ggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcaga

SEQ ID NO: 56519 - DNA, 129 bp, Homo sapiens; identical to SEQ ID NO: 22160
  misc_feature 1..129: note = chr15:88800412-88800541
  misc_feature 1..129: note = hyper
  source 1..129: mol_type = genomic DNA

SEQ ID NO: 56520 - DNA, 137 bp, Homo sapiens
  misc_feature 1..137: note = chr15:88801103-88801240
  misc_feature 1..137: note = hyper
  source 1..137: mol_type = genomic DNA
catccgggaaagaagtgtgtgtggggggggccccgcttttgcgctggtagggatttttttcttaataaaacataaagatgccaagtgtgagctgtttgctgaaaaaaaaaaaaacgagcattcgctgtgggaaagga

SEQ ID NO: 56521 - DNA, 30 bp, Homo sapiens; identical to SEQ ID NO: 35901
  misc_feature 1..30: note = chr15:88801449-88801479
  misc_feature 1..30: note = hyper
  source 1..30: mol_type = genomic DNA

SEQ ID NO: 56522 - DNA, 63 bp, Homo sapiens; identical to SEQ ID NO: 35902
  misc_feature 1..63: note = chr15:89147617-89147680
  misc_feature 1..63: note = hyper
  source 1..63: mol_type = genomic DNA

SEQ ID NO: 56523 - DNA, 1447 bp, Homo sapiens
  misc_feature 1..1447: note = chr15:89147722-89149169
  misc_feature 1..1447: note = hyper
  source 1..1447: mol_type = genomic DNA
cgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcag

SEQ ID NO: 56524 - DNA, 325 bp, Homo sapiens
  misc_feature 1..325: note = chr15:89248428-89248753
  misc_feature 1..325: note = hyper
  source 1..325: mol_type = genomic DNA
ggaggctgacgggggcgcagcttttcctcctgagtgttcgctgcccgggctggcggcgcggagccggcccgccgccgtctgcccctctgcccggcccttttttccagcagttctgccaagaggagcggggtgcggggcaggagatgaggaaggaggaggagaagaaaagggagaggagaggaggagacgcaaagggaagggaggggtgggaagggaagaggaggcaaagggtggggagaggaggggaggggaggagaggagaggggaggggagggactggatcgggcgccaatcccgcccgccgcgcgccgcccgggctccctcg

SEQ ID NO: 56525 - DNA, 47 bp, Homo sapiens
  misc_feature 1..47: note = chr15:89346003-89346050
  misc_feature 1..47: note = hyper
  source 1..47: mol_type = genomic DNA
gtccttggtctctcccggggaatttgaagacccagagactcgcagct

SEQ ID NO: 56526 - DNA, 277 bp, Homo sapiens
  misc_feature 1..277: note = chr15:89346393-89346670
  misc_feature 1..277: note = hyper
  source 1..277: mol_type = genomic DNA
ccgccagccccggagctgccgggtccgcgccgccccggggagcgctcctctcccgccctgagcgcaggccggcttccccatcggcgcgccggtccggagccagggtccagcgcgctccagacgcctctgccttcccctccccctgtcggccgcccctcggtccctgggggtggggtttccctttgcgctcgccccctcccgcccccacccctcacgggccctcccctcccccgcccgtccctatgtatgtgtcacagcgcgccatgcccgcccgccc

SEQ ID NO: 56527 - DNA, 360 bp, Homo sapiens
  misc_feature 1..360: note = chr15:89346943-89347303
  misc_feature 1..360: note = hyper
  source 1..360: mol_type = genomic DNA
gcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagcaaactttttggctgttgcagactcagtgaatggggcaaaggaacacgtgaggaggggcacttgtctcctagtccgccaggatgaagga

SEQ ID NO: 56528 - DNA, 58 bp, Homo sapiens; identical to SEQ ID NO: 35908
  misc_feature 1..58: note = chr15:89438805-89438863
  misc_feature 1..58: note = hyper
  source 1..58: mol_type = genomic DNA

SEQ ID NO: 56529 - DNA, 53 bp, Homo sapiens; identical to SEQ ID NO: 22172
  misc_feature 1..53: note = chr15:89903431-89903484
  misc_feature 1..53: note = hyper
  source 1..53: mol_type = genomic DNA

SEQ ID NO: 56530 - DNA, 72 bp, Homo sapiens
  misc_feature 1..72: note = chr15:89903814-89903886
  misc_feature 1..72: note = hyper
  source 1..72: mol_type = genomic DNA
agaaagcactggggggtgaagggagtgagaaaatgcccaggggaaaagttggtaggtcgccctagttgccgc

SEQ ID NO: 56531 - DNA, 131 bp, Homo sapiens; identical to SEQ ID NO: 35910
  misc_feature 1..131: note = chr15:89905759-89905890
  misc_feature 1..131: note = hyper
  source 1..131: mol_type = genomic DNA

SEQ ID NO: 56532 - DNA, 145 bp, Homo sapiens; identical to SEQ ID NO: 35911
  misc_feature 1..145: note = chr15:89906124-89906269
  misc_feature 1..145: note = hyper
  source 1..145: mol_type = genomic DNA

SEQ ID NO: 56533 - DNA, 137 bp, Homo sapiens; identical to SEQ ID NO: 35912
  misc_feature 1..137: note = chr15:89908862-89908999
  misc_feature 1..137: note = hyper
  source 1..137: mol_type = genomic DNA

SEQ ID NO: 56534 - DNA, 30 bp, Homo sapiens; identical to SEQ ID NO: 12296
  misc_feature 1..30: note = chr15:89909322-89909352
  misc_feature 1..30: note = hyper
  source 1..30: mol_type = genomic DNA

SEQ ID NO: 56535 - DNA, 339 bp, Homo sapiens
  misc_feature 1..339: note = chr15:89910748-89911087
  misc_feature 1..339: note = hyper
  source 1..339: mol_type = genomic DNA
ggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggc

SEQ ID NO: 56536 - DNA, 910 bp, Homo sapiens
  misc_feature 1..910: note = chr15:89911186-89912096
  misc_feature 1..910: note = hyper
  source 1..910: mol_type = genomic DNA
ctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcggg

SEQ ID NO: 56537 - DNA, 375 bp, Homo sapiens; identical to SEQ ID NO: 35915
  misc_feature 1..375: note = chr15:89913180-89913555
  misc_feature 1..375: note = hyper
  source 1..375: mol_type = genomic DNA

SEQ ID NO: 56538 - DNA, 96 bp, Homo sapiens
  misc_feature 1..96: note = chr15:89914135-89914231
  misc_feature 1..96: note = hyper
  source 1..96: mol_type = genomic DNA
cgtttgggcttcatttttgtctccggtttgtgctactctttcttcatccaaaaaggcgttggagatcccgagaatctgctgcagcttggaagccag

SEQ ID NO: 56539 - DNA, 345 bp, Homo sapiens; identical to SEQ ID NO: 22178
  misc_feature 1..345: note = chr15:89914895-89915240
  misc_feature 1..345: note = hyper
  source 1..345: mol_type = genomic DNA

SEQ ID NO: 56540 - DNA, 105 bp, Homo sapiens
  misc_feature 1..105: note = chr15:89915369-89915474
  misc_feature 1..105: note = hyper
  source 1..105: mol_type = genomic DNA
ttttgcctagggtcagttcagctgggtcaggcaggggacaaatggatggtgtggaaggggcctgggtaggggcctgggtttgtcctggggcggctcttccacgag

SEQ ID NO: 56541 - DNA, 32 bp, Homo sapiens
  misc_feature 1..32: note = chr15:89922006-89922038
  misc_feature 1..32: note = hyper
  source 1..32: mol_type = genomic DNA
cgcagcccagagctggcatcaggccatcaggc

SEQ ID NO: 56542 - DNA, 201 bp, Homo sapiens; identical to SEQ ID NO: 22179
  misc_feature 1..201: note = chr15:89922546-89922747
  misc_feature 1..201: note = hyper
  source 1..201: mol_type = genomic DNA

SEQ ID NO: 56543 - DNA, 129 bp, Homo sapiens
  misc_feature 1..129: note = chr15:89942626-89942755
  misc_feature 1..129: note = hyper
  source 1..129: mol_type = genomic DNA
cgccccccagcagcccgggccgcgtttgaccactagtagggcagaaccactgaccggcaggcggcgctccccggggctcccggctcgagccccagggcaccgggaggagtaaggaccccgagcgggagg

SEQ ID NO: 56544 - DNA, 465 bp, Homo sapiens
  misc_feature 1..465: note = chr15:89942945-89943410
  misc_feature 1..465: note = hyper
  source 1..465: mol_type = genomic DNA
agcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaagtacaagttcaagttcagggccaggcccgggggggggcgctgagccttacccggccgcctttgttctctggcataatcgctcccacgtccccctcccgggcggggcccagcagagacccccgccccgccccgccccgccgcgccccgcaggagcc

SEQ ID NO: 56545 - DNA, 69 bp, Homo sapiens
  misc_feature 1..69: note = chr15:89943706-89943775
  misc_feature 1..69: note = hyper
  source 1..69: mol_type = genomic DNA
ggctgggcagccccgctgggcctccggtggggtggggggcgcactgtcgctccagggctctggggagta

SEQ ID NO: 56546 - DNA, 109 bp, Homo sapiens; identical to SEQ ID NO: 35921
  misc_feature 1..109: note = chr15:89945180-89945289
  misc_feature 1..109: note = hyper
  source 1..109: mol_type = genomic DNA

SEQ ID NO: 56547 - DNA, 39 bp, Homo sapiens; identical to SEQ ID NO: 35922
  misc_feature 1..39: note = chr15:89949371-89949410
  misc_feature 1..39: note = hyper
  source 1..39: mol_type = genomic DNA

SEQ ID NO: 56548 - DNA, 173 bp, Homo sapiens
  misc_feature 1..173: note = chr15:89951113-89951286
  misc_feature 1..173: note = hyper
  source 1..173: mol_type = genomic DNA
ggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacac

SEQ ID NO: 56549 - DNA, 31 bp, Homo sapiens; identical to SEQ ID NO: 35926
  misc_feature 1..31: note = chr15:89951346-89951377
  misc_feature 1..31: note = hyper
  source 1..31: mol_type = genomic DNA

SEQ ID NO: 56550 - DNA, 352 bp, Homo sapiens
  misc_feature 1..352: note = chr15:89951801-89952153
  misc_feature 1..352: note = hyper
  source 1..352: mol_type = genomic DNA
gcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggag

SEQ ID NO: 56551 - DNA, 63 bp, Homo sapiens
  misc_feature 1..63: note = chr15:89953055-89953118
  misc_feature 1..63: note = hyper
  source 1..63: mol_type = genomic DNA
agggcggggagtagggattccctccagctccgcagggcatctcacaagcgccttcttctgcgc

SEQ ID NO: 56552 - DNA, 151 bp, Homo sapiens
  misc_feature 1..151: note = chr15:89954335-89954486
  misc_feature 1..151: note = hyper
  source 1..151: mol_type = genomic DNA
ctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctg

SEQ ID NO: 56553 - DNA, 89 bp, Homo sapiens; identical to SEQ ID NO: 35931
  misc_feature 1..89: note = chr15:89954753-89954842
  misc_feature 1..89: note = hyper
  source 1..89: mol_type = genomic DNA

SEQ ID NO: 56554 - DNA, 184 bp, Homo sapiens; identical to SEQ ID NO: 35932
  misc_feature 1..184: note = chr15:89955001-89955185
  misc_feature 1..184: note = hyper
  source 1..184: mol_type = genomic DNA

SEQ ID NO: 56555 - DNA, 54 bp, Homo sapiens; identical to SEQ ID NO: 35933
  misc_feature 1..54: note = chr15:89956300-89956354
  misc_feature 1..54: note = hyper
  source 1..54: mol_type = genomic DNA

SEQ ID NO: 56556 - DNA, 123 bp, Homo sapiens
  misc_feature 1..123: note = chr15:89956450-89956573
  misc_feature 1..123: note = hyper
  source 1..123: mol_type = genomic DNA
gctatgagaccacagccctttgtgtcccccacataagctgggcttccccgtaattagaatggtattcccagccattgaggcttttcatgaggcagaacaaaaactccccgagatgaatatccc

SEQ ID NO: 56557 - DNA, 40 bp, Homo sapiens; identical to SEQ ID NO: 35935
  misc_feature 1..40: note = chr15:89959963-89960003
  misc_feature 1..40: note = hyper
  source 1..40: mol_type = genomic DNA

SEQ ID NO: 56558 - DNA, 85 bp, Homo sapiens; identical to SEQ ID NO: 35936
  misc_feature 1..85: note = chr15:89962817-89962902
  misc_feature 1..85: note = hyper
  source 1..85: mol_type = genomic DNA

SEQ ID NO: 56559 - DNA, 121 bp, Homo sapiens
  misc_feature 1..121: note = chr15:90039711-90039832
  misc_feature 1..121: note = hyper
  source 1..121: mol_type = genomic DNA
taatcacctgcaggagcaggcaggtgagcggcagccgccagcggaggttggtgttccaggccatgctgcaggggtgcctggccgggctggcagcgggcggttcggacgctcggaggccggc

SEQ ID NO: 56560 - DNA, 65 bp, Homo sapiens; identical to SEQ ID NO: 35938
  misc_feature 1..65: note = chr15:90293501-90293566
  misc_feature 1..65: note = hyper
  source 1..65: mol_type = genomic DNA

SEQ ID NO: 56561 - DNA, 158 bp, Homo sapiens; identical to SEQ ID NO: 35939
  misc_feature 1..158: note = chr15:90319855-90320013
  misc_feature 1..158: note = hyper
  source 1..158: mol_type = genomic DNA

SEQ ID NO: 56562 - DNA, 25 bp, Homo sapiens
  misc_feature 1..25: note = chr15:90320089-90320114
  misc_feature 1..25: note = hyper
  source 1..25: mol_type = genomic DNA
cgtggccccgcagaggcgcagacgc

SEQ ID NO: 56563 - DNA, 177 bp, Homo sapiens; identical to SEQ ID NO: 12318
  misc_feature 1..177: note = chr15:90357883-90358060
  misc_feature 1..177: note = hyper
  source 1..177: mol_type = genomic DNA

SEQ ID NO: 56564 - DNA, 298 bp, Homo sapiens; identical to SEQ ID NO: 35942
  misc_feature 1..298: note = chr15:90358102-90358400
  misc_feature 1..298: note = hyper
  source 1..298: mol_type = genomic DNA

SEQ ID NO: 56565 - DNA, 156 bp, Homo sapiens; identical to SEQ ID NO: 35943
  misc_feature 1..156: note = chr15:91427788-91427944
  misc_feature 1..156: note = hyper
  source 1..156: mol_type = genomic DNA

SEQ ID NO: 56566 - DNA, 73 bp, Homo sapiens; identical to SEQ ID NO: 35944
  misc_feature 1..73: note = chr15:91642967-91643040
  misc_feature 1..73: note = hyper
  source 1..73: mol_type = genomic DNA

SEQ ID NO: 56567 - DNA, 68 bp, Homo sapiens; identical to SEQ ID NO: 35945
  misc_feature 1..68: note = chr15:91643277-91643345
  misc_feature 1..68: note = hyper
  source 1..68: mol_type = genomic DNA

SEQ ID NO: 56568 - DNA, 142 bp, Homo sapiens; identical to SEQ ID NO: 35946
  misc_feature 1..142: note = chr15:91643657-91643799
  misc_feature 1..142: note = hyper
  source 1..142: mol_type = genomic DNA

SEQ ID NO: 56569 - DNA, 45 bp, Homo sapiens; identical to SEQ ID NO: 35947
  misc_feature 1..45: note = chr15:92936662-92936707
  misc_feature 1..45: note = hyper
  source 1..45: mol_type = genomic DNA

SEQ ID NO: 56570 - DNA, 231 bp, Homo sapiens
  misc_feature 1..231: note = chr15:92936922-92937153
  misc_feature 1..231: note = hyper
  source 1..231: mol_type = genomic DNA
ctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccg

SEQ ID NO: 56571 - DNA, 280 bp, Homo sapiens
  misc_feature 1..280: note = chr15:92937374-92937654
  misc_feature 1..280: note = hyper
  source 1..280: mol_type = genomic DNA
gatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggact

SEQ ID NO: 56572 - DNA, 39 bp, Homo sapiens; identical to SEQ ID NO: 35949
  misc_feature 1..39: note = chr15:92937696-92937735
  misc_feature 1..39: note = hyper
  source 1..39: mol_type = genomic DNA

SEQ ID NO: 56573 - DNA, 191 bp, Homo sapiens; identical to SEQ ID NO: 22197
  misc_feature 1..191: note = chr15:92937736-92937927
  misc_feature 1..191: note = hyper
  source 1..191: mol_type = genomic DNA

SEQ ID NO: 56574 - DNA, 53 bp, Homo sapiens; identical to SEQ ID NO: 35951
  misc_feature 1..53: note = chr15:92938325-92938378
  misc_feature 1..53: note = hyper
  source 1..53: mol_type = genomic DNA

SEQ ID NO: 56575 - DNA, 305 bp, Homo sapiens; identical to SEQ ID NO: 35952
  misc_feature 1..305: note = chr15:93198707-93199012
  misc_feature 1..305: note = hyper
  source 1..305: mol_type = genomic DNA

SEQ ID NO: 56576 - DNA, 35 bp, Homo sapiens; identical to SEQ ID NO: 35953
  misc_feature 1..35: note = chr15:93257618-93257653
  misc_feature 1..35: note = hyper
  source 1..35: mol_type = genomic DNA

SEQ ID NO: 56577 - DNA, 465 bp, Homo sapiens; identical to SEQ ID NO: 35954
  misc_feature 1..465: note = chr15:93615914-93616379
  misc_feature 1..465: note = hyper
  source 1..465: mol_type = genomic DNA

SEQ ID NO: 56578 - DNA, 257 bp, Homo sapiens; identical to SEQ ID NO: 35955
  misc_feature 1..257: note = chr15:93616396-93616653
  misc_feature 1..257: note = hyper
  source 1..257: mol_type = genomic DNA

SEQ ID NO: 56579 - DNA, 107 bp, Homo sapiens; identical to SEQ ID NO: 22201
  misc_feature 1..107: note = chr15:93631632-93631739
  misc_feature 1..107: note = hyper
  source 1..107: mol_type = genomic DNA

SEQ ID NO: 56580 - DNA, 646 bp, Homo sapiens
  misc_feature 1..646: note = chr15:93632014-93632660
  misc_feature 1..646: note = hyper
  source 1..646: mol_type = genomic DNA
aatgtgggcaagatgggagcaagatgagacgcggggctaaggaagaccaaagcagcgccgtggccccggcatgtgtcggcggcgcctcggagatgtcagagccgggtctgcccggctcccgacccgcgcttaccttggcggctgcatgagcccctgcggcccgcggggggtggcgctggcggggctgcgggagaagagggggtgtcggggcgccgctcgtctgccccggggcaaggtgggaggggctccgctggcgctggtccccgccgccccggccggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagca

SEQ ID NO: 56581 - DNA, 33 bp, Homo sapiens; identical to SEQ ID NO: 22203
  misc_feature 1..33: note = chr15:93633233-93633266
  misc_feature 1..33: note = hyper
  source 1..33: mol_type = genomic DNA

SEQ ID NO: 56582 - DNA, 64 bp, Homo sapiens; identical to SEQ ID NO: 35958
  misc_feature 1..64: note = chr15:95388665-95388729
  misc_feature 1..64: note = hyper
  source 1..64: mol_type = genomic DNA

SEQ ID NO: 56583 - DNA, 144 bp, Homo sapiens; identical to SEQ ID NO: 35959
  misc_feature 1..144: note = chr15:96865078-96865222
  misc_feature 1..144: note = hyper
  source 1..144: mol_type = genomic DNA

SEQ ID NO: 56584 - DNA, 51 bp, Homo sapiens; identical to SEQ ID NO: 35960
  misc_feature 1..51: note = chr15:96874282-96874333
  misc_feature 1..51: note = hyper
  source 1..51: mol_type = genomic DNA

SEQ ID NO: 56585 - DNA, 74 bp, Homo sapiens; identical to SEQ ID NO: 35961
  misc_feature 1..74: note = chr15:96884425-96884499
  misc_feature 1..74: note = hyper
  source 1..74: mol_type = genomic DNA

SEQ ID NO: 56586 - DNA, 30 bp, Homo sapiens; identical to SEQ ID NO: 35962
  misc_feature 1..30: note = chr15:96897398-96897428
  misc_feature 1..30: note = hyper
  source 1..30: mol_type = genomic DNA

SEQ ID NO: 56587 - DNA, 81 bp, Homo sapiens
  misc_feature 1..81: note = chr15:96897853-96897934
  misc_feature 1..81: note = hyper
  source 1..81: mol_type = genomic DNA
ccgtgcggctggctgcgcctaggagttccgccacgggtccgacggggcaccctgggtccccgcagcccgtcacaggcgttt

SEQ ID NO: 56588 - DNA, 193 bp, Homo sapiens
  misc_feature 1..193: note = chr15:96911366-96911559
  misc_feature 1..193: note = hyper
  source 1..193: mol_type = genomic DNA
gctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctct

SEQ ID NO: 56589 - DNA, 198 bp, Homo sapiens; identical to SEQ ID NO: 35965
  misc_feature 1..198: note = chr15:96911763-96911961
  misc_feature 1..198: note = hyper
  source 1..198: mol_type = genomic DNA

SEQ ID NO: 56590 - DNA, 50 bp, Homo sapiens
  misc_feature 1..50: note = chr15:96952646-96952696
  misc_feature 1..50: note = hyper
  source 1..50: mol_type = genomic DNA
ccggcggggcagggccggggagctggggacggggtggtctttagggtggc

SEQ ID NO: 56591 - DNA, 11 bp, Homo sapiens
  misc_feature 1..11: note = chr15:96959719-96959730
  misc_feature 1..11: note = hyper
  source 1..11: mol_type = genomic DNA
cgaatttcggg

SEQ ID NO: 56592 - DNA, 36 bp, Homo sapiens; identical to SEQ ID NO: 35970
  misc_feature 1..36: note = chr15:96960508-96960544
  misc_feature 1..36: note = hyper
  source 1..36: mol_type = genomic DNA

SEQ ID NO: 56593 - DNA, 43 bp, Homo sapiens
  misc_feature 1..43: note = chr15:98504144-98504187
  misc_feature 1..43: note = hyper
  source 1..43: mol_type = genomic DNA
gagcctgggtctggtgttcgaggacgagcgcaagggctgctat

SEQ ID NO: 56594 - DNA, 157 bp, Homo sapiens; identical to SEQ ID NO: 22208
  misc_feature 1..157: note = chr15:98836021-98836178
  misc_feature 1..157: note = hyper
  source 1..157: mol_type = genomic DNA

SEQ ID NO: 56595 - DNA, 109 bp, Homo sapiens; identical to SEQ ID NO: 35974
  misc_feature 1..109: note = chr15:98965273-98965382
  misc_feature 1..109: note = hyper
  source 1..109: mol_type = genomic DNA

SEQ ID NO: 56596 - DNA, 267 bp, Homo sapiens; identical to SEQ ID NO: 35975
  misc_feature 1..267: note = chr15:98971698-98971965
  misc_feature 1..267: note = hyper
  source 1..267: mol_type = genomic DNA

SEQ ID NO: 56597 - DNA, 138 bp, Homo sapiens; identical to SEQ ID NO: 35976
  misc_feature 1..138: note = chr15:99193529-99193667
  misc_feature 1..138: note = hyper
  source 1..138: mol_type = genomic DNA

SEQ ID NO: 56598 - DNA, 32 bp, Homo sapiens; identical to SEQ ID NO: 35978
  misc_feature 1..32: note = chr15:100346202-100346234
  misc_feature 1..32: note = hyper
  source 1..32: mol_type = genomic DNA

SEQ ID NO: 56599 - DNA, 581 bp, Homo sapiens; identical to SEQ ID NO: 35979
  misc_feature 1..581: note = chr15:100881263-100881844
  misc_feature 1..581: note = hyper
  source 1..581: mol_type = genomic DNA

SEQ ID NO: 56600 - DNA, 126 bp, Homo sapiens; identical to SEQ ID NO: 35980
  misc_feature 1..126: note = chr15:100881966-100882092
  misc_feature 1..126: note = hyper
  source 1..126: mol_type = genomic DNA

SEQ ID NO: 56601 - DNA, 12 bp, Homo sapiens
  misc_feature 1..12: note = chr15:100914039-100914051
  misc_feature 1..12: note = hyper
  source 1..12: mol_type = genomic DNA
cgggagggaggg

SEQ ID NO: 56602 - DNA, 15 bp, Homo sapiens
  misc_feature 1..15: note = chr15:101420369-101420384
  misc_feature 1..15: note = hyper
  source 1..15: mol_type = genomic DNA
tttcgcgggacgtct

SEQ ID NO: 56603 - DNA, 96 bp, Homo sapiens
  misc_feature 1..96: note = chr15:101420425-101420521
  misc_feature 1..96: note = hyper
  source 1..96: mol_type = genomic DNA
cgaagccgggaaaccgaggccgtccagcgcccgcgcggggccgggccgcccgcatccctgcgaggccccgacgtgtccctgcgctgcccgctttga

SEQ ID NO: 56604 - DNA, 55 bp, Homo sapiens
  misc_feature 1..55: note = chr15:101420610-101420665
  misc_feature 1..55: note = hyper
  source 1..55: mol_type = genomic DNA
tggacgagtctggctttgagagggtcggagggtccgagagcgccaagagagagtc

SEQ ID NO: 56605 - DNA, 126 bp, Homo sapiens; identical to SEQ ID NO: 35985
  misc_feature 1..126: note = chr15:101420734-101420860
  misc_feature 1..126: note = hyper
  source 1..126: mol_type = genomic DNA

SEQ ID NO: 56606 - DNA, 62 bp, Homo sapiens; identical to SEQ ID NO: 35987
  misc_feature 1..62: note = chr15:101459070-101459132
  misc_feature 1..62: note = hyper
  source 1..62: mol_type = genomic DNA

SEQ ID NO: 56607 - DNA, 221 bp, Homo sapiens; identical to SEQ ID NO: 35988
  misc_feature 1..221: note = chr15:101460044-101460265
  misc_feature 1..221: note = hyper
  source 1..221: mol_type = genomic DNA

SEQ ID NO: 56608 - DNA, 41 bp, Homo sapiens; identical to SEQ ID NO: 35989
  misc_feature 1..41: note = chr16:204480-204521
  misc_feature 1..41: note = hyper
  source 1..41: mol_type = genomic DNA

SEQ ID NO: 56609 - DNA, 266 bp, Homo sapiens
  misc_feature 1..266: note = chr16:215150-215416
  misc_feature 1..266: note = hyper
  source 1..266: mol_type = genomic DNA
gctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagct

SEQ ID NO: 56610 - DNA, 22 bp, Homo sapiens
  misc_feature 1..22: note = chr16:216224-216246
  misc_feature 1..22: note = hyper
  source 1..22: mol_type = genomic DNA
acgcagccgccctcctccccgg

SEQ ID NO: 56611 - DNA, 93 bp, Homo sapiens; identical to SEQ ID NO: 22213
  misc_feature 1..93: note = chr16:216583-216676
  misc_feature 1..93: note = hyper
  source 1..93: mol_type = genomic DNA

SEQ ID NO: 56612 - DNA, 208 bp, Homo sapiens; identical to SEQ ID NO: 35994
  misc_feature 1..208: note = chr16:223321-223529
  misc_feature 1..208: note = hyper
  source 1..208: mol_type = genomic DNA

SEQ ID NO: 56613 - DNA, 62 bp, Homo sapiens
  misc_feature 1..62: note = chr16:230203-230265
  misc_feature 1..62: note = hyper
  source 1..62: mol_type = genomic DNA
cgccactgcactcaccgcacccggccaatttttgtgtttttagtagagactaaataccatat

SEQ ID NO: 56614 - DNA, 442 bp, Homo sapiens
  misc_feature 1..442: note = chr16:230610-231052
  misc_feature 1..442: note = hyper
  source 1..442: mol_type = genomic DNA
gggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtc

SEQ ID NO: 56615 - DNA, 337 bp, Homo sapiens; identical to SEQ ID NO: 35997
  misc_feature 1..337: note = chr16:609979-610316
  misc_feature 1..337: note = hyper
  source 1..337: mol_type = genomic DNA

SEQ ID NO: 56616 - DNA, 158 bp, Homo sapiens; identical to SEQ ID NO: 35998
  misc_feature 1..158: note = chr16:610343-610501
  misc_feature 1..158: note = hyper
  source 1..158: mol_type = genomic DNA

SEQ ID NO: 56617 - DNA, 185 bp, Homo sapiens; identical to SEQ ID NO: 35999
  misc_feature 1..185: note = chr16:680959-681144
  misc_feature 1..185: note = hyper
  source 1..185: mol_type = genomic DNA

SEQ ID NO: 56618 - DNA, 564 bp, Homo sapiens; identical to SEQ ID NO: 36000
  misc_feature 1..564: note = chr16:725381-725945
  misc_feature 1..564: note = hyper
  source 1..564: mol_type = genomic DNA

SEQ ID NO: 56619 - DNA, 1028 bp, Homo sapiens; identical to SEQ ID NO: 36001
  misc_feature 1..1028: note = chr16:750383-751411
  misc_feature 1..1028: note = hyper
  source 1..1028: mol_type = genomic DNA

SEQ ID NO: 56620 - DNA, 38 bp, Homo sapiens; identical to SEQ ID NO: 36002
  misc_feature 1..38: note = chr16:863839-863877
  misc_feature 1..38: note = hyper
  source 1..38: mol_type = genomic DNA

SEQ ID NO: 56621 - DNA, 104 bp, Homo sapiens
  misc_feature 1..104: note = chr16:1030655-1030759
  misc_feature 1..104: note = hyper
  source 1..104: mol_type = genomic DNA
tccgagccaccctcggggacggccgggccgaggccacctcgcggggcggccttgggcggggacccggacccgcggttggacgttcgcctcggggggggcaatgt

SEQ ID NO: 56622 - DNA, 161 bp, Homo sapiens; identical to SEQ ID NO: 36004
  misc_feature 1..161: note = chr16:1031121-1031282
  misc_feature 1..161: note = hyper
  source 1..161: mol_type = genomic DNA

SEQ ID NO: 56623 - DNA, 100 bp, Homo sapiens; identical to SEQ ID NO: 36005
  misc_feature 1..100: note = chr16:1031402-1031502
  misc_feature 1..100: note = hyper
  source 1..100: mol_type = genomic DNA

SEQ ID NO: 56624 - DNA, 378 bp, Homo sapiens; identical to SEQ ID NO: 36006
  misc_feature 1..378: note = chr16:1031741-1032119
  misc_feature 1..378: note = hyper
  source 1..378: mol_type = genomic DNA

SEQ ID NO: 56625 - DNA, 34 bp, Homo sapiens; identical to SEQ ID NO: 36007
  misc_feature 1..34: note = chr16:1032389-1032423
  misc_feature 1..34: note = hyper
  source 1..34: mol_type = genomic DNA

SEQ ID NO: 56626 - DNA, 519 bp, Homo sapiens; identical to SEQ ID NO: 36008
  misc_feature 1..519: note = chr16:1203265-1203784
  misc_feature 1..519: note = hyper
  source 1..519: mol_type = genomic DNA

SEQ ID NO: 56627 - DNA, 156 bp, Homo sapiens; identical to SEQ ID NO: 36009
  misc_feature 1..156: note = chr16:1203807-1203963
  misc_feature 1..156: note = hyper
  source 1..156: mol_type = genomic DNA

SEQ ID NO: 56628 - DNA, 77 bp, Homo sapiens; identical to SEQ ID NO: 22225
  misc_feature 1..77: note = chr16:1204034-1204111
  misc_feature 1..77: note = hyper
  source 1..77: mol_type = genomic DNA

SEQ ID NO: 56629 - DNA, 180 bp, Homo sapiens; identical to SEQ ID NO: 36011
  misc_feature 1..180: note = chr16:1204128-1204308
  misc_feature 1..180: note = hyper
  source 1..180: mol_type = genomic DNA

SEQ ID NO: 56630 - DNA, 324 bp, Homo sapiens; identical to SEQ ID NO: 36012
  misc_feature 1..324: note = chr16:1382374-1382698
  misc_feature 1..324: note = hyper
  source 1..324: mol_type = genomic DNA

SEQ ID NO: 56631 - DNA, 83 bp, Homo sapiens
  misc_feature 1..83: note = chr16:1382818-1382901
  misc_feature 1..83: note = hyper
  source 1..83: mol_type = genomic DNA
ttgcagcgagtggagatggtgccactgcgctccaacctggttgagagctatttttgagagctttttcgagactctgtctgaaa

SEQ ID NO: 56632 - DNA, 202 bp, Homo sapiens
  misc_feature 1..202: note = chr16:1382940-1383142
  misc_feature 1..202: note = hyper
  source 1..202: mol_type = genomic DNA
ttcgggaccagcgggttggggacaggacccatcaatgccttaacaaaccctgcaggagaccgcgggcccgctggggttccaggacagcgcagcggaggaagagcggggagccacccgggaggggctggcggggtccagtgcagaccccaggggctccgggggctctggccggctgtgaccccacaagcgccaactgggccct

SEQ ID NO: 56633 - DNA, 49 bp, Homo sapiens; identical to SEQ ID NO: 36014
  misc_feature 1..49: note = chr16:1383733-1383782
  misc_feature 1..49: note = hyper
  source 1..49: mol_type = genomic DNA

SEQ ID NO: 56634 - DNA, 50 bp, Homo sapiens; identical to SEQ ID NO: 36015
  misc_feature 1..50: note = chr16:1384020-1384070
  misc_feature 1..50: note = hyper
  source 1..50: mol_type = genomic DNA

SEQ ID NO: 56635 - DNA, 254 bp, Homo sapiens; identical to SEQ ID NO: 36016
  misc_feature 1..254: note = chr16:1384494-1384748
  misc_feature 1..254: note = hyper
  source 1..254: mol_type = genomic DNA

SEQ ID NO: 56636 - DNA, 197 bp, Homo sapiens; identical to SEQ ID NO: 36017
  misc_feature 1..197: note = chr16:1922108-1922305
  misc_feature 1..197: note = hyper
  source 1..197: mol_type = genomic DNA

SEQ ID NO: 56637 - DNA, 453 bp, Homo sapiens; identical to SEQ ID NO: 36018
  misc_feature 1..453: note = chr16:1968132-1968585
  misc_feature 1..453: note = hyper
  source 1..453: mol_type = genomic DNA

SEQ ID NO: 56638 - DNA, 67 bp, Homo sapiens; identical to SEQ ID NO: 22230
  misc_feature 1..67: note = chr16:2040847-2040914
  misc_feature 1..67: note = hyper
  source 1..67: mol_type = genomic DNA

SEQ ID NO: 56639 - DNA, 40 bp, Homo sapiens; identical to SEQ ID NO: 22231
  misc_feature 1..40: note = chr16:2042160-2042200
  misc_feature 1..40: note = hyper
  source 1..40: mol_type = genomic DNA

SEQ ID NO: 56640 - DNA, 39 bp, Homo sapiens; identical to SEQ ID NO: 36023
  misc_feature 1..39: note = chr16:2042464-2042503
  misc_feature 1..39: note = hyper
  source 1..39: mol_type = genomic DNA

SEQ ID NO: 56641 - DNA, 114 bp, Homo sapiens; identical to SEQ ID NO: 36024
  misc_feature 1..114: note = chr16:2069994-2070108
  misc_feature 1..114: note = hyper
  source 1..114: mol_type = genomic DNA

SEQ ID NO: 56642 - DNA, 47 bp, Homo sapiens; identical to SEQ ID NO: 36025
  misc_feature 1..47: note = chr16:2070147-2070194
  misc_feature 1..47: note = hyper
  source 1..47: mol_type = genomic DNA

SEQ ID NO: 56643 - DNA, 32 bp, Homo sapiens; identical to SEQ ID NO: 36026
  misc_feature 1..32: note = chr16:2287088-2287120
  misc_feature 1..32: note = hyper
  source 1..32: mol_type = genomic DNA

SEQ ID NO: 56644 - DNA, 30 bp, Homo sapiens; identical to SEQ ID NO: 36027
  misc_feature 1..30: note = chr16:2287491-2287521
  misc_feature 1..30: note = hyper
  source 1..30: mol_type = genomic DNA

SEQ ID NO: 56645 - DNA, 15 bp, Homo sapiens
  misc_feature 1..15: note = chr16:2892527-2892542
  misc_feature 1..15: note = hyper
  source 1..15: mol_type = genomic DNA
gctccccactgttgt

SEQ ID NO: 56646 - DNA, 57 bp, Homo sapiens; identical to SEQ ID NO: 36030
  misc_feature 1..57: note = chr16:3016793-3016850
  misc_feature 1..57: note = hyper
  source 1..57: mol_type = genomic DNA

SEQ ID NO: 56647 - DNA, 229 bp, Homo sapiens
  misc_feature 1..229: note = chr16:3068201-3068430
  misc_feature 1..229: note = hyper
  source 1..229: mol_type = genomic DNA
ggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggcagacgtccagactcacccagggtgagggcgccaggcttagggtagaacagagcttgagactccgcttcaccacttaa

SEQ ID NO: 56648 - DNA, 73 bp, Homo sapiens; identical to SEQ ID NO: 36033
  misc_feature 1..73: note = chr16:3096869-3096942
  misc_feature 1..73: note = hyper
  source 1..73: mol_type = genomic DNA

SEQ ID NO: 56649 - DNA, 248 bp, Homo sapiens; identical to SEQ ID NO: 36034
  misc_feature 1..248: note = chr16:3209117-3209365
  misc_feature 1..248: note = hyper
  source 1..248: mol_type = genomic DNA

SEQ ID NO: 56650 - DNA, 119 bp, Homo sapiens; identical to SEQ ID NO: 36035
  misc_feature 1..119: note = chr16:3220438-3220557
  misc_feature 1..119: note = hyper
  source 1..119: mol_type = genomic DNA

SEQ ID NO: 56651 - DNA, 232 bp, Homo sapiens; identical to SEQ ID NO: 36039
  misc_feature 1..232: note = chr16:3224952-3225184
  misc_feature 1..232: note = hyper
  source 1..232: mol_type = genomic DNA

SEQ ID NO: 56652 - DNA, 12 bp, Homo sapiens
  misc_feature 1..12: note = chr16:3225459-3225471
  misc_feature 1..12: note = hyper
  source 1..12: mol_type = genomic DNA
acactcaggagg

SEQ ID NO: 56653 - DNA, 17 bp, Homo sapiens
  misc_feature 1..17: note = chr16:3232618-3232635
  misc_feature 1..17: note = hyper
  source 1..17: mol_type = genomic DNA
ttttggaccaaaaaccg

SEQ ID NO: 56654 - DNA, 44 bp, Homo sapiens
  misc_feature 1..44: note = chr16:3232695-3232739
  misc_feature 1..44: note = hyper
  source 1..44: mol_type = genomic DNA
accaacgagccacacgccccgtagcctccggcttgtctttgtgg

SEQ ID NO: 56655 - DNA, 31 bp, Homo sapiens
  misc_feature 1..31: note = chr16:3237826-3237857
  misc_feature 1..31: note = hyper
  source 1..31: mol_type = genomic DNA
tatatcataccagcacgacattgaaaccacc

SEQ ID NO: 56656 - DNA, 447 bp, Homo sapiens; identical to SEQ ID NO: 22239
  misc_feature 1..447: note = chr16:3238546-3238993
  misc_feature 1..447: note = hyper
  source 1..447: mol_type = genomic DNA

SEQ ID NO: 56657 - DNA, 35 bp, Homo sapiens; identical to SEQ ID NO: 36049
  misc_feature 1..35: note = chr16:3241024-3241059
  misc_feature 1..35: note = hyper
  source 1..35: mol_type = genomic DNA

SEQ ID NO: 56658 - DNA, 48 bp, Homo sapiens
  misc_feature 1..48: note = chr16:3241501-3241549
  misc_feature 1..48: note = hyper
  source 1..48: mol_type = genomic DNA
cccggctagctcagtcggtagagcatgggactcttaatctcagggtcg

SEQ ID NO: 56659 - DNA, 46 bp, Homo sapiens
  misc_feature 1..46: note = chr16:3241663-3241709
  misc_feature 1..46: note = hyper
  source 1..46: mol_type = genomic DNA
tcccctcaatgattgaattttggtctccgcgcgctcccagcagcaa

SEQ ID NO: 56660 - DNA, 37 bp, Homo sapiens; identical to SEQ ID NO: 36051
  misc_feature 1..37: note = chr16:3355197-3355234
  misc_feature 1..37: note = hyper
  source 1..37: mol_type = genomic DNA

SEQ ID NO: 56661 - DNA, 29 bp, Homo sapiens
  misc_feature 1..29: note = chr16:3355250-3355279
  misc_feature 1..29: note = hyper
  source 1..29: mol_type = genomic DNA
cgcagaacagacgcggcagtgcgacgcct

SEQ ID NO: 56662 - DNA, 135 bp, Homo sapiens
  misc_feature 1..135: note = chr16:3355718-3355853
  misc_feature 1..135: note = hyper
  source 1..135: mol_type = genomic DNA
attttccgtaggcggtggccgcggcgcttccgggccgcgcggctggagcctgaggcggggccaccgtcgggcacgagaaaccattctctccccgcttttcgcagctgtatcccagaggcgcggctgaagctcgct

SEQ ID NO: 56663 - DNA, 18 bp, Homo sapiens
  misc_feature 1..18: note = chr16:3551488-3551506
  misc_feature 1..18: note = hyper
  source 1..18: mol_type = genomic DNA
aaccgaacagcaggccgg

SEQ ID NO: 56664 - DNA, 160 bp, Homo sapiens; identical to SEQ ID NO: 36054
  misc_feature 1..160: note = chr16:4363920-4364080
  misc_feature 1..160: note = hyper
  source 1..160: mol_type = genomic DNA

SEQ ID NO: 56665 - DNA, 505 bp, Homo sapiens; identical to SEQ ID NO: 36055
  misc_feature 1..505: note = chr16:4377915-4378420
  misc_feature 1..505: note = hyper
  source 1..505: mol_type = genomic DNA

SEQ ID NO: 56666 - DNA, 186 bp, Homo sapiens; identical to SEQ ID NO: 36056
  misc_feature 1..186: note = chr16:4587903-4588089
  misc_feature 1..186: note = hyper
  source 1..186: mol_type = genomic DNA

SEQ ID NO: 56667 - DNA, 453 bp, Homo sapiens; identical to SEQ ID NO: 36057
  misc_feature 1..453: note = chr16:4588308-4588761
  misc_feature 1..453: note = hyper
  source 1..453: mol_type = genomic DNA

SEQ ID NO: 56668 - DNA, 382 bp, Homo sapiens
  misc_feature 1..382: note = chr16:5037518-5037900
  misc_feature 1..382: note = hyper
  source 1..382: mol_type = genomic DNA
cccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggc

SEQ ID NO: 56669 - DNA, 21 bp, Homo sapiens
  misc_feature 1..21: note = chr16:5038004-5038025
  misc_feature 1..21: note = hyper
  source 1..21: mol_type = genomic DNA
tgggtccgggctgggtgggcg

SEQ ID NO: 56670 - DNA, 44 bp, Homo sapiens; identical to SEQ ID NO: 36059
  misc_feature 1..44: note = chr16:6069508-6069552
  misc_feature 1..44: note = hyper
  source 1..44: mol_type = genomic DNA

SEQ ID NO: 56671 - DNA, 61 bp, Homo sapiens; identical to SEQ ID NO: 36060
  misc_feature 1..61: note = chr16:6070141-6070202
  misc_feature 1..61: note = hyper
  source 1..61: mol_type = genomic DNA

SEQ ID NO: 56672 - DNA, 289 bp, Homo sapiens; identical to SEQ ID NO: 36061
  misc_feature 1..289: note = chr16:6533425-6533714
  misc_feature 1..289: note = hyper
  source 1..289: mol_type = genomic DNA

SEQ ID NO: 56673 - DNA, 33 bp, Homo sapiens; identical to SEQ ID NO: 36062
  misc_feature 1..33: note = chr16:7354091-7354124
  misc_feature 1..33: note = hyper
  source 1..33: mol_type = genomic DNA

SEQ ID NO: 56674 - DNA, 75 bp, Homo sapiens; identical to SEQ ID NO: 36064
  misc_feature 1..75: note = chr16:10133426-10133501
  misc_feature 1..75: note = hyper
  source 1..75: mol_type = genomic DNA

SEQ ID NO: 56675 - DNA, 64 bp, Homo sapiens; identical to SEQ ID NO: 36065
  misc_feature 1..64: note = chr16:10133502-10133566
  misc_feature 1..64: note = hyper
  source 1..64: mol_type = genomic DNA

SEQ ID NO: 56676 - DNA, 100 bp, Homo sapiens
  misc_feature 1..100: note = chr16:10274299-10274399
  misc_feature 1..100: note = hyper
  source 1..100: mol_type = genomic DNA
agtgagaggcagggccgcggtgagcaaggcgaccagaagaaagggattaccaacttggcttcctgctctaggagccaggcatggaactcagcagcaggat

SEQ ID NO: 56677 - DNA, 596 bp, Homo sapiens
  misc_feature 1..596: note = chr16:10274429-10275025
  misc_feature 1..596: note = hyper
  source 1..596: mol_type = genomic DNA
gtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttc

SEQ ID NO: 56678 - DNA, 60 bp, Homo sapiens
  misc_feature 1..60: note = chr16:10275248-10275308
  misc_feature 1..60: note = hyper
  source 1..60: mol_type = genomic DNA
ctagcctttctactgcgggcgctgttgccaagtcctaggtgcacgtgggcagtgggccgc

SEQ ID NO: 56679 - DNA, 106 bp, Homo sapiens; identical to SEQ ID NO: 22249
  misc_feature 1..106: note = chr16:10275392-10275498
  misc_feature 1..106: note = hyper
  source 1..106: mol_type = genomic DNA

SEQ ID NO: 56680 - DNA, 19 bp, Homo sapiens
  misc_feature 1..19: note = chr16:10276341-10276360
  misc_feature 1..19: note = hyper
  source 1..19: mol_type = genomic DNA
agggggagggaaggacgcg

SEQ ID NO: 56681 - DNA, 239 bp, Homo sapiens; identical to SEQ ID NO: 36073
  misc_feature 1..239: note = chr16:10480064-10480303
  misc_feature 1..239: note = hyper
  source 1..239: mol_type = genomic DNA

SEQ ID NO: 56682 - DNA, 69 bp, Homo sapiens; identical to SEQ ID NO: 36074
  misc_feature 1..69: note = chr16:12897833-12897902
  misc_feature 1..69: note = hyper
  source 1..69: mol_type = genomic DNA

SEQ ID NO: 56683 - DNA, 325 bp, Homo sapiens
  misc_feature 1..325: note = chr16:12994737-12995062
  misc_feature 1..325: note = hyper
  source 1..325: mol_type = genomic DNA
gctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtc

SEQ ID NO: 56684 - DNA, 44 bp, Homo sapiens
  misc_feature 1..44: note = chr16:12995593-12995637
  misc_feature 1..44: note = hyper
  source 1..44: mol_type = genomic DNA
ctccacccccgcctcacccagtggccggccggacctgcaccccg

SEQ ID NO: 56685 - DNA, 289 bp, Homo sapiens; identical to SEQ ID NO: 22254
  misc_feature 1..289: note = chr16:12996328-12996617
  misc_feature 1..289: note = hyper
  source 1..289: mol_type = genomic DNA

SEQ ID NO: 56686 - DNA, 228 bp, Homo sapiens
  misc_feature 1..228: note = chr16:12996720-12996948
  misc_feature 1..228: note = hyper
  source 1..228: mol_type = genomic DNA
gtgtgactctgctccctcaccctctggccgcctcctcccgctggtgactgaggcggacttgagacacgtagcctgggagcccgtggccccgaaatcttcgggtttggggagagggtccatggcacccctcggattccaggtgctagctttttggtaaacaggggcaggcgagcccgaaaggggaggggggcgtgtgtgagcccgagcgcgcgtgtgtgaaggagggag

SEQ ID NO: 56687 - DNA, 375 bp, Homo sapiens
  misc_feature 1..375: note = chr16:12997011-12997386
  misc_feature 1..375: note = hyper
  source 1..375: mol_type = genomic DNA
gaggggagggcgagaacaaaagccttgcttggagcggccgcctcgctttcccagagcttcgccgtccctggatttgggacctcagctgcccccgcccctttacccacctcatccctttctctggccaccacttctccctgcccggggccgtggccatcgctgcagattgagccccttgccctggctggcgtggactccgggggcccgagccccctcctcgcgcgccctcacttccaagcaccctgatttcgtcaactttcgggtttgccttgttcattatgcaagccccagcaccagctagttccagcagatgggagaaggctttgggggattaatggagctatttgccttttgctttttttaaattttttttat

SEQ ID NO: 56688 - DNA, 764 bp, Homo sapiens; identical to SEQ ID NO: 36077
  misc_feature 1..764: note = chr16:15528335-15529099
  misc_feature 1..764: note = hyper
  source 1..764: mol_type = genomic DNA

SEQ ID NO: 56689 - DNA, 484 bp, Homo sapiens; identical to SEQ ID NO: 36078
  misc_feature 1..484: note = chr16:15950853-15951337
  misc_feature 1..484: note = hyper
  source 1..484: mol_type = genomic DNA

SEQ ID NO: 56690 - DNA, 80 bp, Homo sapiens; identical to SEQ ID NO: 36079
  misc_feature 1..80: note = chr16:15952285-15952365
  misc_feature 1..80: note = hyper
  source 1..80: mol_type = genomic DNA

SEQ ID NO: 56691 - DNA, 30 bp, Homo sapiens; identical to SEQ ID NO: 36080
  misc_feature 1..30: note = chr16:19422447-19422477
  misc_feature 1..30: note = hyper
  source 1..30: mol_type = genomic DNA

SEQ ID NO: 56692 - DNA, 137 bp, Homo sapiens
  misc_feature 1..137: note = chr16:19567065-19567202
  misc_feature 1..137: note = hyper
  source 1..137: mol_type = genomic DNA
ttggtaaggaagcagcggcgggtgggctttggagaggggctgtccttacttgtgatggggtcggcctgggtctgagagtgtgaattcctctctgtcgggttctggtggtcgaccggccacccccaagttgtcttgac

SEQ ID NO: 56693 - DNA, 78 bp, Homo sapiens
  misc_feature 1..78: note = chr16:19567449-19567527
  misc_feature 1..78: note = hyper
  source 1..78: mol_type = genomic DNA
ttggtcagtttcctcagctcctctgttcacctggagacttgcttttctcatctgtaaaatggccgccattcatcctat

SEQ ID NO: 56694 - DNA, 251 bp, Homo sapiens; identical to SEQ ID NO: 36082
  misc_feature 1..251: note = chr16:20084648-20084899
  misc_feature 1..251: note = hyper
  source 1..251: mol_type = genomic DNA

SEQ ID NO: 56695 - DNA, 118 bp, Homo sapiens; identical to SEQ ID NO: 36083
  misc_feature 1..118: note = chr16:20085303-20085421
  misc_feature 1..118: note = hyper
  source 1..118: mol_type = genomic DNA

SEQ ID NO: 56696 - DNA, 372 bp, Homo sapiens; identical to SEQ ID NO: 36084
  misc_feature 1..372: note = chr16:21294924-21295296
  misc_feature 1..372: note = hyper
  source 1..372: mol_type = genomic DNA

SEQ ID NO: 56697 - DNA, 34 bp, Homo sapiens; identical to SEQ ID NO: 36085
  misc_feature 1..34: note = chr16:21295340-21295374
  misc_feature 1..34: note = hyper
  source 1..34: mol_type = genomic DNA

SEQ ID NO: 56698 - DNA, 116 bp, Homo sapiens; identical to SEQ ID NO: 36086
  misc_feature 1..116: note = chr16:21675345-21675461
  misc_feature 1..116: note = hyper
  source 1..116: mol_type = genomic DNA

SEQ ID NO: 56699 - DNA, 50 bp, Homo sapiens
  misc_feature 1..50: note = chr16:21831571-21831621
  misc_feature 1..50: note = hyper
  source 1..50: mol_type = genomic DNA
agctttggtcccagacgcgcagaaggaagcggcctgaatcttacccagtc

SEQ ID NO: 56700 - DNA, 195 bp, Homo sapiens; identical to SEQ ID NO: 36088
  misc_feature 1..195: note = chr16:22173697-22173892
  misc_feature 1..195: note = hyper
  source 1..195: mol_type = genomic DNA

SEQ ID NO: 56701 - DNA, 377 bp, Homo sapiens; identical to SEQ ID NO: 12422
  misc_feature 1..377: note = chr16:22203596-22203973
  misc_feature 1..377: note = hyper
  source 1..377: mol_type = genomic DNA

SEQ ID NO: 56702 - DNA, 228 bp, Homo sapiens
  misc_feature 1..228: note = chr16:22824473-22824701
  misc_feature 1..228: note = hyper
  source 1..228: mol_type = genomic DNA
tctggacatggtcaccgagaactgtcctgtaggcattcacttaggaatcattcgaagtggaattgctcctggatacgttctccttgtactctgtttcctcctcctagtgtctctgtgtgaagaagccctcctcactcagccctcggcgaccctctggtaccctggacagctccccggggagcagtctaccgctaggcggcggctgctaagagaggaaccctcctgacg

SEQ ID NO: 56703 - DNA, 170 bp, Homo sapiens
  misc_feature 1..170: note = chr16:22825157-22825327
  misc_feature 1..170: note = hyper
  source 1..170: mol_type = genomic DNA
cgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcc

SEQ ID NO: 56704 - DNA, 75 bp, Homo sapiens; identical to SEQ ID NO: 36093
  misc_feature 1..75: note = chr16:22826252-22826327
  misc_feature 1..75: note = hyper
  source 1..75: mol_type = genomic DNA

SEQ ID NO: 56705 - DNA, 64 bp, Homo sapiens; identical to SEQ ID NO: 22267
  misc_feature 1..64: note = chr16:23313400-23313464
  misc_feature 1..64: note = hyper
  source 1..64: mol_type = genomic DNA

SEQ ID NO: 56706 - DNA, 31 bp, Homo sapiens; identical to SEQ ID NO: 22268
  misc_feature 1..31: note = chr16:23706520-23706551
  misc_feature 1..31: note = hyper
  source 1..31: mol_type = genomic DNA

SEQ ID NO: 56707 - DNA, 104 bp, Homo sapiens; identical to SEQ ID NO: 36097
  misc_feature 1..104: note = chr16:23765896-23766000
  misc_feature 1..104: note = hyper
  source 1..104: mol_type = genomic DNA

SEQ ID NO: 56708 - DNA, 30 bp, Homo sapiens; identical to SEQ ID NO: 36098
  misc_feature 1..30: note = chr16:23766456-23766486
  misc_feature 1..30: note = hyper
  source 1..30: mol_type = genomic DNA

SEQ ID NO: 56709 - DNA, 262 bp, Homo sapiens; identical to SEQ ID NO: 36099
  misc_feature 1..262: note = chr16:23846792-23847054
  misc_feature 1..262: note = hyper
  source 1..262: mol_type = genomic DNA

SEQ ID NO: 56710 - DNA, 47 bp, Homo sapiens; identical to SEQ ID NO: 22271
  misc_feature 1..47: note = chr16:23847956-23848003
  misc_feature 1..47: note = hyper
  source 1..47: mol_type = genomic DNA

SEQ ID NO: 56711 - DNA, 561 bp, Homo sapiens; identical to SEQ ID NO: 36105
  misc_feature 1..561: note = chr16:23848004-23848565
  misc_feature 1..561: note = hyper
  source 1..561: mol_type = genomic DNA

SEQ ID NO: 56712 - DNA, 90 bp, Homo sapiens; identical to SEQ ID NO: 22274
  misc_feature 1..90: note = chr16:24267025-24267115
  misc_feature 1..90: note = hyper
  source 1..90: mol_type = genomic DNA

SEQ ID NO: 56713 - DNA, 265 bp, Homo sapiens; identical to SEQ ID NO: 22275
  misc_feature 1..265: note = chr16:24267220-24267485
  misc_feature 1..265: note = hyper
  source 1..265: mol_type = genomic DNA

SEQ ID NO: 56714 - DNA, 21 bp, Homo sapiens
  misc_feature 1..21: note = chr16:24267578-24267599
  misc_feature 1..21: note = hyper
  source 1..21: mol_type = genomic DNA
ctattttttgccatccgccct

SEQ ID NO: 56715 - DNA, 153 bp, Homo sapiens; identical to SEQ ID NO: 36108
  misc_feature 1..153: note = chr16:24621912-24622065
  misc_feature 1..153: note = hyper
  source 1..153: mol_type = genomic DNA

SEQ ID NO: 56716 - DNA, 160 bp, Homo sapiens
  misc_feature 1..160: note = chr16:25702795-25702955
  misc_feature 1..160: note = hyper
  source 1..160: mol_type = genomic DNA
agagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaag

SEQ ID NO: 56717 - DNA, 650 bp, Homo sapiens
  misc_feature 1..650: note = chr16:25702992-25703642
  misc_feature 1..650: note = hyper
  source 1..650: mol_type = genomic DNA
cccggtgcgcggcaccggaggcaggcgttgggctttacctctctaaaagtactggggcaaaggaatggagaacacggcgtcccgagctcccaagggaggggagtaaacgaggtggggtggggaacaccccaagtgcgtgcgtgctgggggctggggggcacgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcgg

SEQ ID NO: 56718 - DNA, 16 bp, Homo sapiens
  misc_feature 1..16: note = chr16:25704628-25704644
  misc_feature 1..16: note = hyper
  source 1..16: mol_type = genomic DNA
tcggctgagagggctg

SEQ ID NO: 56719 - DNA, 43 bp, Homo sapiens; identical to SEQ ID NO: 36111
  misc_feature 1..43: note = chr16:28073999-28074042
  misc_feature 1..43: note = hyper
  source 1..43: mol_type = genomic DNA

SEQ ID NO: 56720 - DNA, 100 bp, Homo sapiens
  misc_feature 1..100: note = chr16:28074076-28074176
  misc_feature 1..100: note = hyper
  source 1..100: mol_type = genomic DNA
cgcccctccgaccggcagcgggggtgggcgccttcccggggcgcgggagcgtccccaaagccgcggggcgtccgcagcgggtaggagctctgccttgcac

SEQ ID NO: 56721 - DNA, 253 bp, Homo sapiens
  misc_feature 1..253: note = chr16:28074684-28074937
  misc_feature 1..253: note = hyper
  source 1..253: mol_type = genomic DNA
gcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtg

SEQ ID NO: 56722 - skipped

SEQ ID NO: 56723 - DNA, 190 bp, Homo sapiens
  misc_feature 1..190: note = chr16:28075197-28075387
  misc_feature 1..190: note = hyper
  source 1..190: mol_type = genomic DNA
ccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggacc

SEQ ID NO: 56724 - DNA, 120 bp, Homo sapiens; identical to SEQ ID NO: 36115
  misc_feature 1..120: note = chr16:28304473-28304593
  misc_feature 1..120: note = hyper
  source 1..120: mol_type = genomic DNA

SEQ ID NO: 56725 - DNA, 51 bp, Homo sapiens; identical to SEQ ID NO: 36116
  misc_feature 1..51: note = chr16:28891741-28891792
  misc_feature 1..51: note = hyper
  source 1..51: mol_type = genomic DNA

SEQ ID NO: 56726 - DNA, 89 bp, Homo sapiens
  misc_feature 1..89: note = chr16:29888658-29888747
  misc_feature 1..89: note = hyper
  source 1..89: mol_type = genomic DNA
cagtgtgaggtcgggcccagaggagagaaggcggcggcgcggctgaggtccccgcagctgggccaagactcgggcgctgggaccgtccc

SEQ ID NO: 56727 - DNA, 30 bp, Homo sapiens; identical to SEQ ID NO: 36118
  misc_feature 1..30: note = chr16:30023074-30023104
  misc_feature 1..30: note = hyper
  source 1..30: mol_type = genomic DNA

SEQ ID NO: 56728 - DNA, 30 bp, Homo sapiens; identical to SEQ ID NO: 36119
  misc_feature 1..30: note = chr16:31022167-31022197
  misc_feature 1..30: note = hyper
  source 1..30: mol_type = genomic DNA

SEQ ID NO: 56729 - DNA, 138 bp, Homo sapiens; identical to SEQ ID NO: 36120
  misc_feature 1..138: note = chr16:31226609-31226747
  misc_feature 1..138: note = hyper
  source 1..138: mol_type = genomic DNA

SEQ ID NO: 56730 - DNA, 47 bp, Homo sapiens; identical to SEQ ID NO: 36121
  misc_feature 1..47: note = chr16:31227038-31227085
  misc_feature 1..47: note = hyper
  source 1..47: mol_type = genomic DNA

SEQ ID NO: 56731 - DNA, 93 bp, Homo sapiens; identical to SEQ ID NO: 36123
  misc_feature 1..93: note = chr16:31483566-31483659
  misc_feature 1..93: note = hyper
  source 1..93: mol_type = genomic DNA

SEQ ID NO: 56732 - DNA, 156 bp, Homo sapiens; identical to SEQ ID NO: 36124
  misc_feature 1..156: note = chr16:31498557-31498713
  misc_feature 1..156: note = hyper
  source 1..156: mol_type = genomic DNA

SEQ ID NO: 56733 - DNA, 91 bp, Homo sapiens; identical to SEQ ID NO: 36125
  misc_feature 1..91: note = chr16:31499538-31499629
  misc_feature 1..91: note = hyper
  source 1..91: mol_type = genomic DNA

SEQ ID NO: 56734 - DNA, 249 bp, Homo sapiens; identical to SEQ ID NO: 36126
  misc_feature 1..249: note = chr16:31540812-31541061
  misc_feature 1..249: note = hyper
  source 1..249: mol_type = genomic DNA

SEQ ID NO: 56735 - DNA, 80 bp, Homo sapiens; identical to SEQ ID NO: 22284
  misc_feature 1..80: note = chr16:31580480-31580560
  misc_feature 1..80: note = hyper
  source 1..80: mol_type = genomic DNA

SEQ ID NO: 56736 - DNA, 753 bp, Homo sapiens
  misc_feature 1..753: note = chr16:47176772-47177525
  misc_feature 1..753: note = hyper
  source 1..753: mol_type = genomic DNA
caaattagtaagaaccgaacaccagcggcggggaattctgagacctctggcggagcgcgaggagcgccgcgtcccgggaagcacccgagcagcagcgctccccgggggccgggacaagccgggtccgcggcgcccgcgcgccgcccccggagcccgcagtggtgccgcagcctccgtggccgcagcaggtgggacccggctggcccagcaggccccgttccccgccgcgaggtgcaggcgccgcggggctattcgaaaaccactgcacgacgtcacggccgcggcttttattgttctcgtggaattactttttgccatcacatctggagaaagagcggcctccgctccacgacaggaatctcacaactttgcaaagggatgcgcggaattctacggaagcggcgcgagggcgcagcccggagggccctgctgggcccaggggcctcctggccgccttcccgacccgatccctcttcccacacgcgccccgcgaacgtcggccggactcgcaggggtcggaagcggcgcgcccggagagccggcggagccgggcagggctcgcgccccgcggtccgctccgagtagccgcgagccccgccagacaaagaggcgcgtcgggtcccgggcgcgggtaagggacgcagaggcgcgggcagggcggcgcgccagcctcggcccgcagggggcgccgtccgtggccccagccccggtccttacctttgaggaccgagcagagccgctccagggccatgt

SEQ ID NO: 56737 - DNA, 158 bp, Homo sapiens
  misc_feature 1..158: note = chr16:47177606-47177764
  misc_feature 1..158: note = hyper
  source 1..158: mol_type = genomic DNA
ggccccactccgtccccatcgccggccagcagctgcctccccgctcccctgaggagagctcaggtcctgcggcccgccatgcccgagccccacagtgggctcccgcgcggcccgagcaccccgacgggcgccgcctcctgctccgcggcgccccgtcc

SEQ ID NO: 56738 - DNA, 31 bp, Homo sapiens; identical to SEQ ID NO: 36129
  misc_feature 1..31: note = chr16:47177824-47177855
  misc_feature 1..31: note = hyper
  source 1..31: mol_type = genomic DNA

SEQ ID NO: 56739 - DNA, 33 bp, Homo sapiens; identical to SEQ ID NO: 36130
  misc_feature 1..33: note = chr16:47178260-47178293
  misc_feature 1..33: note = hyper
  source 1..33: mol_type = genomic DNA

SEQ ID NO: 56740 - skipped

SEQ ID NO: 56741 - DNA, 62 bp, Homo sapiens; identical to SEQ ID NO: 22286
  misc_feature 1..62: note = chr16:49309108-49309170
  misc_feature 1..62: note = hyper
  source 1..62: mol_type = genomic DNA

SEQ ID NO: 56742 - DNA, 197 bp, Homo sapiens
  misc_feature 1..197: note = chr16:49309262-49309459
  misc_feature 1..197: note = hyper
  source 1..197: mol_type = genomic DNA
ctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgcagaataggaaac

SEQ ID NO: 56743 - DNA, 78 bp, Homo sapiens
  misc_feature 1..78: note = chr16:49311445-49311523
  misc_feature 1..78: note = hyper
  source 1..78: mol_type = genomic DNA
tatctctgtgggtcccggaggcacagggctgcaagggcgcccgctagagctgctccacggcttaccggattgcatgcg

SEQ ID NO: 56744 - DNA, 232 bp, Homo sapiens
  misc_feature 1..232: note = chr16:49312299-49312531
  misc_feature 1..232: note = hyper
  source 1..232: mol_type = genomic DNA
gccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagct

SEQ ID NO: 56745 - DNA, 157 bp, Homo sapiens
  misc_feature 1..157: note = chr16:49313206-49313363
  misc_feature 1..157: note = hyper
  source 1..157: mol_type = genomic DNA
taggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccc

SEQ ID NO: 56746 - DNA, 312 bp, Homo sapiens
  misc_feature 1..312: note = chr16:49313710-49314022
  misc_feature 1..312: note = hyper
  source 1..312: mol_type = genomic DNA
ctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatt

SEQ ID NO: 56747 - DNA, 301 bp, Homo sapiens; identical to SEQ ID NO: 22290
  misc_feature 1..301: note = chr16:49314118-49314419
  misc_feature 1..301: note = hyper
  source 1..301: mol_type = genomic DNA

SEQ ID NO: 56748 - DNA, 223 bp, Homo sapiens
  misc_feature 1..223: note = chr16:49314561-49314784
  misc_feature 1..223: note = hyper
  source 1..223: mol_type = genomic DNA
cctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgagg

SEQ ID NO: 56749 - DNA, 204 bp, Homo sapiens
  misc_feature 1..204: note = chr16:49315072-49315276
  misc_feature 1..204: note = hyper
  source 1..204: mol_type = genomic DNA
ccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggc

SEQ ID NO: 56750 - DNA, 613 bp, Homo sapiens
  misc_feature 1..613: note = chr16:49315306-49315919
  misc_feature 1..613: note = hyper
  source 1..613: mol_type = genomic DNA
cattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcgg

SEQ ID NO: 56751 - DNA, 43 bp, Homo sapiens
  misc_feature 1..43: note = chr16:49316580-49316623
  misc_feature 1..43: note = hyper
  source 1..43: mol_type = genomic DNA
gggagatcattgaacccctacggagtaccgggtactgggccgg

SEQ ID NO: 56752 - DNA, 49 bp, Homo sapiens; identical to SEQ ID NO: 36138
  misc_feature 1..49: note = chr16:49317153-49317202
  misc_feature 1..49: note = hyper
  source 1..49: mol_type = genomic DNA

SEQ ID NO: 56753 - DNA, 35 bp, Homo sapiens; identical to SEQ ID NO: 12458
  misc_feature 1..35: note = chr16:49317700-49317735
  misc_feature 1..35: note = hyper
  source 1..35: mol_type = genomic DNA

SEQ ID NO: 56754 - DNA, 30 bp, Homo sapiens; identical to SEQ ID NO: 36140
  misc_feature 1..30: note = chr16:50699376-50699406
  misc_feature 1..30: note = hyper
  source 1..30: mol_type = genomic DNA

SEQ ID NO: 56755 - DNA, 96 bp, Homo sapiens; identical to SEQ ID NO: 36141
  misc_feature 1..96: note = chr16:51167714-51167810
  misc_feature 1..96: note = hyper
  source 1..96: mol_type = genomic DNA

SEQ ID NO: 56756 - DNA, 18 bp, Homo sapiens
  misc_feature 1..18: note = chr16:51184406-51184424
  misc_feature 1..18: note = hyper
  source 1..18: mol_type = genomic DNA
tggcggccagcagcactc

SEQ ID NO: 56757 - DNA, 112 bp, Homo sapiens
  misc_feature 1..112: note = chr16:51184695-51184807
  misc_feature 1..112: note = hyper
  source 1..112: mol_type = genomic DNA
gcggtcaggccggggcgacctccacccgcacccacgcctcatggggctcccgggtcttggccgcggctgggatccccggaaaagcagggacggagaagccaggccggcatgc

SEQ ID NO: 56758 - DNA, 302 bp, Homo sapiens; identical to SEQ ID NO: 22295
  misc_feature 1..302: note = chr16:51185542-51185844
  misc_feature 1..302: note = hyper
  source 1..302: mol_type = genomic DNA

SEQ ID NO: 56759 - DNA, 49 bp, Homo sapiens
  misc_feature 1..49: note = chr16:51186280-51186329
  misc_feature 1..49: note = hyper
  source 1..49: mol_type = genomic DNA
cggcccggctccgcccaggacccctcccggacctcccccccggctgccc

SEQ ID NO: 56760 - DNA, 188 bp, Homo sapiens
  misc_feature 1..188: note = chr16:51186939-51187127
  misc_feature 1..188: note = hyper
  source 1..188: mol_type = genomic DNA
aactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactc

SEQ ID NO: 56761 - DNA, 134 bp, Homo sapiens; identical to SEQ ID NO: 36149
  misc_feature 1..134: note = chr16:51187416-51187550
  misc_feature 1..134: note = hyper
  source 1..134: mol_type = genomic DNA

SEQ ID NO: 56762 - DNA, 79 bp, Homo sapiens; identical to SEQ ID NO: 36150
  misc_feature 1..79: note = chr16:51189282-51189361
  misc_feature 1..79: note = hyper
  source 1..79: mol_type = genomic DNA

SEQ ID NO: 56763 - DNA, 49 bp, Homo sapiens; identical to SEQ ID NO: 36153
  misc_feature 1..49: note = chr16:54317177-54317226
  misc_feature 1..49: note = hyper
  source 1..49: mol_type = genomic DNA

SEQ ID NO: 56764 - DNA, 80 bp, Homo sapiens; identical to SEQ ID NO: 36154
  misc_feature 1..80: note = chr16:54318670-54318750
  misc_feature 1..80: note = hyper
  source 1..80: mol_type = genomic DNA

SEQ ID NO: 56765 - DNA, 43 bp, Homo sapiens; identical to SEQ ID NO: 22299
  misc_feature 1..43: note = chr16:54319377-54319420
  misc_feature 1..43: note = hyper
  source 1..43: mol_type = genomic DNA

SEQ ID NO: 56766 - DNA, 77 bp, Homo sapiens
  misc_feature 1..77: note = chr16:54319468-54319545
  misc_feature 1..77: note = hyper
  source 1..77: mol_type = genomic DNA
ggcagccgcggccggatgctgcaccccggggctgtccttcagctcatactgcgcgccctgtacgcacatggagaagg

SEQ ID NO: 56767 - DNA, 47 bp, Homo sapiens; identical to SEQ ID NO: 36157
  misc_feature 1..47: note = chr16:54320739-54320786
  misc_feature 1..47: note = hyper
  source 1..47: mol_type = genomic DNA

SEQ ID NO: 56768 - DNA, 30 bp, Homo sapiens; identical to SEQ ID NO: 36158
  misc_feature 1..30: note = chr16:54321354-54321384
  misc_feature 1..30: note = hyper
  source 1..30: mol_type = genomic DNA

SEQ ID NO: 56769 - DNA, 83 bp, Homo sapiens
  misc_feature 1..83: note = chr16:54628867-54628950
  misc_feature 1..83: note = hyper
  source 1..83: mol_type = genomic DNA
tccccacccccgccgcccacccgccctcaggttttaaatttggaagatattgtggaaatggacaaactcgcctttgcctgctg

SEQ ID NO: 56770 - DNA, 34 bp, Homo sapiens; identical to SEQ ID NO: 36162
  misc_feature 1..34: note = chr16:54962651-54962685
  misc_feature 1..34: note = hyper
  source 1..34: mol_type = genomic DNA

SEQ ID NO: 56771 - DNA, 33 bp, Homo sapiens; identical to SEQ ID NO: 36163
  misc_feature 1..33: note = chr16:54963623-54963656
  misc_feature 1..33: note = hyper
  source 1..33: mol_type = genomic DNA

SEQ ID NO: 56772 - DNA, 44 bp, Homo sapiens; identical to SEQ ID NO: 36164
  misc_feature 1..44: note = chr16:54964141-54964185
  misc_feature 1..44: note = hyper
  source 1..44: mol_type = genomic DNA

SEQ ID NO: 56773 - DNA, 21 bp, Homo sapiens
  misc_feature 1..21: note = chr16:54965114-54965135
  misc_feature 1..21: note = hyper
  source 1..21: mol_type = genomic DNA
cctatccgcagggctacttgt

SEQ ID NO: 56774 - DNA, 38 bp, Homo sapiens
  misc_feature 1..38: note = chr16:54966792-54966830
  misc_feature 1..38: note = hyper
  source 1..38: mol_type = genomic DNA
cgaccccgagggccccgaagcaggttggtggacatggg

SEQ ID NO: 56775 - DNA, 95 bp, Homo sapiens; identical to SEQ ID NO: 36168
  misc_feature 1..95: note = chr16:54971471-54971566
  misc_feature 1..95: note = hyper
  source 1..95: mol_type = genomic DNA

SEQ ID NO: 56776 - DNA, 46 bp, Homo sapiens; identical to SEQ ID NO: 36169
  misc_feature 1..46: note = chr16:54972930-54972976
  misc_feature 1..46: note = hyper
  source 1..46: mol_type = genomic DNA

SEQ ID NO: 56777 - DNA, 129 bp, Homo sapiens; identical to SEQ ID NO: 36171
  misc_feature 1..129: note = chr16:55357444-55357573
  misc_feature 1..129: note = hyper
  source 1..129: mol_type = genomic DNA

SEQ ID NO: 56778 - DNA, 315 bp, Homo sapiens
  misc_feature 1..315: note = chr16:55357611-55357926
  misc_feature 1..315: note = hyper
  source 1..315: mol_type = genomic DNA
cggagcgcaggggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtc

SEQ ID NO: 56779 - DNA, 230 bp, Homo sapiens; identical to SEQ ID NO: 22305
  misc_feature 1..230: note = chr16:55358086-55358316
  misc_feature 1..230: note = hyper
  source 1..230: mol_type = genomic DNA

SEQ ID NO: 56780 - DNA, 110 bp, Homo sapiens; identical to SEQ ID NO: 36174
  misc_feature 1..110: note = chr16:55358566-55358676
  misc_feature 1..110: note = hyper
  source 1..110: mol_type = genomic DNA

SEQ ID NO: 56781 - DNA, 14 bp, Homo sapiens
  misc_feature 1..14: note = chr16:55358784-55358798
  misc_feature 1..14: note = hyper
  source 1..14: mol_type = genomic DNA
cggaccccacgggc

SEQ ID NO: 56782 - DNA, 54 bp, Homo sapiens
  misc_feature 1..54: note = chr16:55359071-55359125
  misc_feature 1..54: note = hyper
  source 1..54: mol_type = genomic DNA
taggggacagactgggtggagggagtgcctagtgcacggcgcctgcctctgatc

SEQ ID NO: 56783 - DNA, 27 bp, Homo sapiens
  misc_feature 1..27: note = chr16:55362982-55363009
  misc_feature 1..27: note = hyper
  source 1..27: mol_type = genomic DNA
ggtgcacccccagcccggcctaggcca

SEQ ID NO: 56784 - DNA, 33 bp, Homo sapiens
  misc_feature 1..33: note = chr16:55363223-55363256
  misc_feature 1..33: note = hyper
  source 1..33: mol_type = genomic DNA
gtagtgggcccccagcggcgctgggagtatcta

SEQ ID NO: 56785 - DNA, 260 bp, Homo sapiens; identical to SEQ ID NO: 22306
  misc_feature 1..260: note = chr16:55364843-55365103
  misc_feature 1..260: note = hyper
  source 1..260: mol_type = genomic DNA

SEQ ID NO: 56786 - DNA, 27 bp, Homo sapiens
  misc_feature 1..27: note = chr16:55365434-55365461
  misc_feature 1..27: note = hyper
  source 1..27: mol_type = genomic DNA
cgtttccaacgccgggtcccggccagg

SEQ ID NO: 56787 - DNA, 27 bp, Homo sapiens
  misc_feature 1..27: note = chr16:55404972-55404999
  misc_feature 1..27: note = hyper
  source 1..27: mol_type = genomic DNA
tctttgagcatcaaacgtgtcctcctt

SEQ ID NO: 56788 - DNA, 19 bp, Homo sapiens
  misc_feature 1..19: note = chr16:55512935-55512954
  misc_feature 1..19: note = hyper
  source 1..19: mol_type = genomic DNA
cggccggggaaaagaggtg

SEQ ID NO: 56789 - DNA, 138 bp, Homo sapiens; identical to SEQ ID NO: 12486
  misc_feature 1..138: note = chr16:55513226-55513364
  misc_feature 1..138: note = hyper
  source 1..138: mol_type = genomic DNA

SEQ ID NO: 56790 - DNA, 57 bp, Homo sapiens; identical to SEQ ID NO: 36183
  misc_feature 1..57: note = chr16:55513482-55513539
  misc_feature 1..57: note = hyper
  source 1..57: mol_type = genomic DNA

SEQ ID NO: 56791 - DNA, 251 bp, Homo sapiens; identical to SEQ ID NO: 36184
  misc_feature 1..251: note = chr16:55514076-55514327
  misc_feature 1..251: note = hyper
  source 1..251: mol_type = genomic DNA

SEQ ID NO: 56792 - DNA, 197 bp, Homo sapiens
  misc_feature 1..197: note = chr16:55689918-55690115
  misc_feature 1..197: note = hyper
  source 1..197: mol_type = genomic DNA
ccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggt

SEQ ID NO: 56793 - DNA, 40 bp, Homo sapiens
  misc_feature 1..40: note = chr16:56224517-56224557
  misc_feature 1..40: note = hyper
  source 1..40: mol_type = genomic DNA
cctgtccctccactccgggcaccctggcctccccagggtg

SEQ ID NO: 56794 - DNA, 113 bp, Homo sapiens; identical to SEQ ID NO: 36191
  misc_feature 1..113: note = chr16:56224880-56224993
  misc_feature 1..113: note = hyper
  source 1..113: mol_type = genomic DNA

SEQ ID NO: 56795 - DNA, 490 bp, Homo sapiens; identical to SEQ ID NO: 36192
  misc_feature 1..490: note = chr16:56225199-56225689
  misc_feature 1..490: note = hyper
  source 1..490: mol_type = genomic DNA

SEQ ID NO: 56796 - DNA, 45 bp, Homo sapiens; identical to SEQ ID NO: 36193
  misc_feature 1..45: note = chr16:56226280-56226325
  misc_feature 1..45: note = hyper
  source 1..45: mol_type = genomic DNA

SEQ ID NO: 56797 - skipped

SEQ ID NO: 56798 - DNA, 10 bp, Homo sapiens
  misc_feature 1..10: note = chr16:56228581-56228591
  misc_feature 1..10: note = hyper
  source 1..10: mol_type = genomic DNA
gaggggagtg

SEQ ID NO: 56799 - DNA, 215 bp, Homo sapiens; identical to SEQ ID NO: 36196
  misc_feature 1..215: note = chr16:56623169-56623384
  misc_feature 1..215: note = hyper
  source 1..215: mol_type = genomic DNA

SEQ ID NO: 56800 - DNA, 202 bp, Homo sapiens; identical to SEQ ID NO: 36197
  misc_feature 1..202: note = chr16:56623667-56623869
  misc_feature 1..202: note = hyper
  source 1..202: mol_type = genomic DNA

SEQ ID NO: 56801 - DNA, 47 bp, Homo sapiens; identical to SEQ ID NO: 22317
  misc_feature 1..47: note = chr16:56651275-56651322
  misc_feature 1..47: note = hyper
  source 1..47: mol_type = genomic DNA

SEQ ID NO: 56802 - DNA, 47 bp, Homo sapiens; identical to SEQ ID NO: 22318
  misc_feature 1..47: note = chr16:56659128-56659175
  misc_feature 1..47: note = hyper
  source 1..47: mol_type = genomic DNA

SEQ ID NO: 56803 - DNA, 101 bp, Homo sapiens
  misc_feature 1..101: note = chr16:56659673-56659774
  misc_feature 1..101: note = hyper
  source 1..101: mol_type = genomic DNA
cagccagttgcagggctccattctgctttccaactgcctgactgcttgttcgtctcactggtgtgagctccagcatcccctttgctcgaaatggaccccaa

SEQ ID NO: 56804 - DNA, 549 bp, Homo sapiens; identical to SEQ ID NO: 36200
  misc_feature 1..549: note = chr16:56665957-56666506
  misc_feature 1..549: note = hyper
  source 1..549: mol_type = genomic DNA

SEQ ID NO: 56805 - DNA, 374 bp, Homo sapiens; identical to SEQ ID NO: 36204
  misc_feature 1..374: note = chr16:56677138-56677512
  misc_feature 1..374: note = hyper
  source 1..374: mol_type = genomic DNA

SEQ ID NO: 56806 - DNA, 52 bp, Homo sapiens; identical to SEQ ID NO: 36205
  misc_feature 1..52: note = chr16:56701956-56702008
  misc_feature 1..52: note = hyper
  source 1..52: mol_type = genomic DNA

SEQ ID NO: 56807 - DNA, 23 bp, Homo sapiens
  misc_feature 1..23: note = chr16:56709814-56709837
  misc_feature 1..23: note = hyper
  source 1..23: mol_type = genomic DNA
cagcatagcccctcccgcacgag

SEQ ID NO: 56808 - DNA, 19 bp, Homo sapiens
  misc_feature 1..19: note = chr16:56710030-56710049
  misc_feature 1..19: note = hyper
  source 1..19: mol_type = genomic DNA
accacgcctcccacctgcc

SEQ ID NO: 56809 - DNA, 69 bp, Homo sapiens
  misc_feature 1..69: note = chr16:58018565-58018634
  misc_feature 1..69: note = hyper
  source 1..69: mol_type = genomic DNA
tcgcaacaggtaccacgagggaaagctggcgcccatcgcgccaggcatcaaccgagtggactggccctg

SEQ ID NO: 56810 - DNA, 380 bp, Homo sapiens
  misc_feature 1..380: note = chr16:58018845-58019225
  misc_feature 1..380: note = hyper
  source 1..380: mol_type = genomic DNA
gtggcacttgcggtgggtggagccgagacgtgcgcgcggatctggaggcaggactgcccttggggagggggcggagccaggcggagccttcgggccgggggctttgccctggtggggcagcggaggcgggacctgttctccgtacacgtgtgggtggggctggattgtgggcggggctggattgtgggcggggcttagatgaggaggcggggcttgtcctgggggggggcggatgagcgctcgagaggggctttctgttcgcagcggagggtctcagcggctacgcggtgcggtacttgaagcccgacgtgacccagacctggcgggtagggagcgctgcgcgcagacccgtccctgagcggggagcgggggtcctggtg

SEQ ID NO: 56811 - DNA, 54 bp, Homo sapiens
  misc_feature 1..54: note = chr16:58019430-58019484
  misc_feature 1..54: note = hyper
  source 1..54: mol_type = genomic DNA
cccctgcctttcgactccctgtaagtgacgccacgcgcccggggaccccatatc

SEQ ID NO: 56812 - skipped

SEQ ID NO: 56813 - DNA, 283 bp, Homo sapiens
  misc_feature 1..283: note = chr16:58497469-58497752
  misc_feature 1..283: note = hyper
  source 1..283: mol_type = genomic DNA
cgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccg

SEQ ID NO: 56814 - DNA, 346 bp, Homo sapiens
  misc_feature 1..346: note = chr16:58497829-58498175
  misc_feature 1..346: note = hyper
  source 1..346: mol_type = genomic DNA
ccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgt

SEQ ID NO: 56815 - DNA, 366 bp, Homo sapiens; identical to SEQ ID NO: 22331
  misc_feature 1..366: note = chr16:58498204-58498570
  misc_feature 1..366: note = hyper
  source 1..366: mol_type = genomic DNA

SEQ ID NO: 56816 - DNA, 30 bp, Homo sapiens; identical to SEQ ID NO: 36212
  misc_feature 1..30: note = chr16:58499185-58499215
  misc_feature 1..30: note = hyper
  source 1..30: mol_type = genomic DNA

SEQ ID NO: 56817 - DNA, 31 bp, Homo sapiens
  misc_feature 1..31: note = chr16:62068517-62068548
  misc_feature 1..31: note = hyper
  source 1..31: mol_type = genomic DNA
cccccagatatcatgacgccaggtgaaagaa

SEQ ID NO: 56818 - DNA, 75 bp, Homo sapiens; identical to SEQ ID NO: 36214
  misc_feature 1..75: note = chr16:62069009-62069084
  misc_feature 1..75: note = hyper
  source 1..75: mol_type = genomic DNA

SEQ ID NO: 56819 - DNA, 138 bp, Homo sapiens; identical to SEQ ID NO: 12513
  misc_feature 1..138: note = chr16:62069136-62069274
  misc_feature 1..138: note = hyper
  source 1..138: mol_type = genomic DNA

SEQ ID NO: 56820 - DNA, 35 bp, Homo sapiens; identical to SEQ ID NO: 12514
  misc_feature 1..35: note = chr16:62069336-62069371
  misc_feature 1..35: note = hyper
  source 1..35: mol_type = genomic DNA

SEQ ID NO: 56821 - DNA, 13 bp, Homo sapiens
  misc_feature 1..13: note = chr16:62070773-62070786
  misc_feature 1..13: note = hyper
  source 1..13: mol_type = genomic DNA
taggaggaagagg

SEQ ID NO: 56822 - DNA, 126 bp, Homo sapiens
  misc_feature 1..126: note = chr16:65155091-65155217
  misc_feature 1..126: note = hyper
  source 1..126: mol_type = genomic DNA
acaaacgggcgccagagctcccgcagagactcgggctggagggctgtagcgcaccgcagcctgctgccccagaaccacagtcggcggccccaaacccacgctattaaagtgcgggcaatctccttc

SEQ ID NO: 56823 - DNA, 648 bp, Homo sapiens
  misc_feature 1..648: note = chr16:65155737-65156385
  misc_feature 1..648: note = hyper
  source 1..648: mol_type = genomic DNA
gaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctg

SEQ ID NO: 56824 - DNA, 173 bp, Homo sapiens
  misc_feature 1..173: note = chr16:65156489-65156662
  misc_feature 1..173: note = hyper
  source 1..173: mol_type = genomic DNA
cactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagct

SEQ ID NO: 56825 - DNA, 23 bp, Homo sapiens
  misc_feature 1..23: note = chr16:65156872-65156895
  misc_feature 1..23: note = hyper
  source 1..23: mol_type = genomic DNA
aagggcctaatggggcgcagcgc

SEQ ID NO: 56826 - DNA, 347 bp, Homo sapiens; identical to SEQ ID NO: 36221
  misc_feature 1..347: note = chr16:65156939-65157286
  misc_feature 1..347: note = hyper
  source 1..347: mol_type = genomic DNA

SEQ ID NO: 56827 - DNA, 15 bp, Homo sapiens
  misc_feature 1..15: note = chr16:65157823-65157838
  misc_feature 1..15: note = hyper
  source 1..15: mol_type = genomic DNA
gtaaccccccaacct

SEQ ID NO: 56828 - DNA, 15 bp, Homo sapiens
  misc_feature 1..15: note = chr16:65157863-65157878
  misc_feature 1..15: note = hyper
  source 1..15: mol_type = genomic DNA
cgcgaggacattgac

SEQ ID NO: 56829 - DNA, 275 bp, Homo sapiens
  misc_feature 1..275: note = chr16:66461511-66461786
  misc_feature 1..275: note = hyper
  source 1..275: mol_type = genomic DNA
cggagcgggatcccgggtctcccgcggaccctcgaccccgggctggccactgggatctgcgcgagccgaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaa

SEQ ID NO: 56830 - DNA, 149 bp, Homo sapiens
  misc_feature 1..149: note = chr16:66461840-66461989
  misc_feature 1..149: note = hyper
  source 1..149: mol_type = genomic DNA
taggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggac

SEQ ID NO: 56831 - DNA, 148 bp, Homo sapiens
  misc_feature 1..148: note = chr16:66612734-66612882
  misc_feature 1..148: note = hyper
  source 1..148: mol_type = genomic DNA
ccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccga

SEQ ID NO: 56832 - DNA, 175 bp, Homo sapiens; identical to SEQ ID NO: 36226
  misc_feature 1..175: note = chr16:66638277-66638452
  misc_feature 1..175: note = hyper
  source 1..175: mol_type = genomic DNA

SEQ ID NO: 56833 - DNA, 85 bp, Homo sapiens; identical to SEQ ID NO: 36227
  misc_feature 1..85: note = chr16:66878235-66878320
  misc_feature 1..85: note = hyper
  source 1..85: mol_type = genomic DNA

SEQ ID NO: 56834 - DNA, 106 bp, Homo sapiens; identical to SEQ ID NO: 12525
  misc_feature 1..106: note = chr16:66878819-66878925
  misc_feature 1..106: note = hyper
  source 1..106: mol_type = genomic DNA

SEQ ID NO: 56835 - DNA, 39 bp, Homo sapiens; identical to SEQ ID NO: 36229
  misc_feature 1..39: note = chr16:66958838-66958877
  misc_feature 1..39: note = hyper
  source 1..39: mol_type = genomic DNA

SEQ ID NO: 56836 - DNA, 178 bp, Homo sapiens; identical to SEQ ID NO: 36230
  misc_feature 1..178: note = chr16:67184208-67184386
  misc_feature 1..178: note = hyper
  source 1..178: mol_type = genomic DNA

SEQ ID NO: 56837 - DNA, 68 bp, Homo sapiens; identical to SEQ ID NO: 36231
  misc_feature 1..68: note = chr16:67189168-67189236
  misc_feature 1..68: note = hyper
  source 1..68: mol_type = genomic DNA

SEQ ID NO: 56838 - DNA, 81 bp, Homo sapiens
  misc_feature 1..81: note = chr16:67197617-67197698
  misc_feature 1..81: note = hyper
  source 1..81: mol_type = genomic DNA
ccactcggtgctggacgccttccgcgcgcactgcccgcgcctgcgcacctataccctcaagctcacgcgcgagccgcatcc

SEQ ID NO: 56839 - DNA, 240 bp, Homo sapiens; identical to SEQ ID NO: 22345
  misc_feature 1..240: note = chr16:67197769-67198009
  misc_feature 1..240: note = hyper
  source 1..240: mol_type = genomic DNA

SEQ ID NO: 56840 - DNA, 243 bp, Homo sapiens
  misc_feature 1..243: note = chr16:67198039-67198282
  misc_feature 1..243: note = hyper
  source 1..243: mol_type = genomic DNA
cctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgccc

SEQ ID NO: 56841 - DNA, 360 bp, Homo sapiens
  misc_feature 1..360: note = chr16:67198557-67198917
  misc_feature 1..360: note = hyper
  source 1..360: mol_type = genomic DNA
gtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaacccc

SEQ ID NO: 56842 - DNA, 146 bp, Homo sapiens; identical to SEQ ID NO: 36234
  misc_feature 1..146: note = chr16:67199375-67199521
  misc_feature 1..146: note = hyper
  source 1..146: mol_type = genomic DNA

SEQ ID NO: 56843 - DNA, 44 bp, Homo sapiens; identical to SEQ ID NO: 36235
  misc_feature 1..44: note = chr16:67360535-67360579
  misc_feature 1..44: note = hyper
  source 1..44: mol_type = genomic DNA

SEQ ID NO: 56844 - DNA, 30 bp, Homo sapiens; identical to SEQ ID NO: 36236
  misc_feature 1..30: note = chr16:67427344-67427374
  misc_feature 1..30: note = hyper
  source 1..30: mol_type = genomic DNA

SEQ ID NO: 56845 - DNA, 40 bp, Homo sapiens; identical to SEQ ID NO: 36237
  misc_feature 1..40: note = chr16:67433365-67433405
  misc_feature 1..40: note = hyper
  source 1..40: mol_type = genomic DNA

SEQ ID NO: 56846 - DNA, 30 bp, Homo sapiens; identical to SEQ ID NO: 36238
  misc_feature 1..30: note = chr16:67572408-67572438
  misc_feature 1..30: note = hyper
  source 1..30: mol_type = genomic DNA

SEQ ID NO: 56847 - DNA, 63 bp, Homo sapiens; identical to SEQ ID NO: 36239
  misc_feature 1..63: note = chr16:67679073-67679136
  misc_feature 1..63: note = hyper
  source 1..63: mol_type = genomic DNA

SEQ ID NO: 56848 - DNA, 103 bp, Homo sapiens; identical to SEQ ID NO: 36240
  misc_feature 1..103: note = chr16:67700928-67701031
  misc_feature 1..103: note = hyper
  source 1..103: mol_type = genomic DNA

SEQ ID NO: 56849 - DNA, 99 bp, Homo sapiens; identical to SEQ ID NO: 36241
  misc_feature 1..99: note = chr16:67877035-67877134
  misc_feature 1..99: note = hyper
  source 1..99: mol_type = genomic DNA

SEQ ID NO: 56850 - DNA, 45 bp, Homo sapiens; identical to SEQ ID NO: 12529
  misc_feature 1..45: note = chr16:68118410-68118455
  misc_feature 1..45: note = hyper
  source 1..45: mol_type = genomic DNA

SEQ ID NO: 56851 - DNA, 156 bp, Homo sapiens; identical to SEQ ID NO: 36243
  misc_feature 1..156: note = chr16:68118759-68118915
  misc_feature 1..156: note = hyper
  source 1..156: mol_type = genomic DNA

SEQ ID NO: 56852 - DNA, 224 bp, Homo sapiens; identical to SEQ ID NO: 36244
  misc_feature 1..224: note = chr16:68504068-68504292
  misc_feature 1..224: note = hyper
  source 1..224: mol_type = genomic DNA

SEQ ID NO: 56853 - DNA, 65 bp, Homo sapiens
  misc_feature 1..65: note = chr16:68544194-68544259
  misc_feature 1..65: note = hyper
  source 1..65: mol_type = genomic DNA
cggcccggacacccacgggccaccgcgtcgaggcagcgcgagccccgggcgccccctgcaggttg

SEQ ID NO: 56854 - DNA, 48 bp, Homo sapiens; identical to SEQ ID NO: 22352
  misc_feature 1..48: note = chr16:68676360-68676408
  misc_feature 1..48: note = hyper
  source 1..48: mol_type = genomic DNA

SEQ ID NO: 56855 - DNA, 55 bp, Homo sapiens
  misc_feature 1..55: note = chr16:68676984-68677039
  misc_feature 1..55: note = hyper
  source 1..55: mol_type = genomic DNA
taattcaggggatgtggggatgctagaaagagagacggctcgccagacatctgag

SEQ ID NO: 56856 - DNA, 99 bp, Homo sapiens; identical to SEQ ID NO: 36248
  misc_feature 1..99: note = chr16:68679959-68680058
  misc_feature 1..99: note = hyper
  source 1..99: mol_type = genomic DNA

SEQ ID NO: 56857 - DNA, 26 bp, Homo sapiens
  misc_feature 1..26: note = chr16:68771298-68771324
  misc_feature 1..26: note = hyper
  source 1..26: mol_type = genomic DNA
ctcggcgtccccggccagccatgggc

SEQ ID NO: 56858 - DNA, 71 bp, Homo sapiens
  misc_feature 1..71: note = chr16:71459956-71460027
  misc_feature 1..71: note = hyper
  source 1..71: mol_type = genomic DNA
cgtgcttgccggttcttgccaccctccgccgcttgcaccggacccaggcgctcatcccccgcttcccccgc

SEQ ID NO: 56859 - DNA, 166 bp, Homo sapiens
  misc_feature 1..166: note = chr16:71460351-71460517
  misc_feature 1..166: note = hyper
  source 1..166: mol_type = genomic DNA
gcaggcattttcttacaggaggtagcaagcttgtctaagcagaggccctcttagcgcagtgggcagcgcgtcagtctcataatctgaaggtcctgagttcgagcctcagagagggcagctgttttgttgtgctacgaatgcagcaaatgttcggatgtaacccagc

SEQ ID NO: 56860 - DNA, 28 bp, Homo sapiens
  misc_feature 1..28: note = chr16:73100271-73100299
  misc_feature 1..28: note = hyper
  source 1..28: mol_type = genomic DNA
cggagccagcgtgcgcgtccctaatgcc

SEQ ID NO: 56861 - skipped

SEQ ID NO: 56862 - DNA, 107 bp, Homo sapiens; identical to SEQ ID NO: 36254
  misc_feature 1..107: note = chr16:75528762-75528869
  misc_feature 1..107: note = hyper
  source 1..107: mol_type = genomic DNA

SEQ ID NO: 56863 - DNA, 412 bp, Homo sapiens; identical to SEQ ID NO: 36255
  misc_feature 1..412: note = chr16:75528922-75529334
  misc_feature 1..412: note = hyper
  source 1..412: mol_type = genomic DNA

SEQ ID NO: 56864 - DNA, 41 bp, Homo sapiens; identical to SEQ ID NO: 36256
  misc_feature 1..41: note = chr16:76311161-76311202
  misc_feature 1..41: note = hyper
  source 1..41: mol_type = genomic DNA

SEQ ID NO: 56865 - DNA, 65 bp, Homo sapiens; identical to SEQ ID NO: 36257
  misc_feature 1..65: note = chr16:77246006-77246071
  misc_feature 1..65: note = hyper
  source 1..65: mol_type = genomic DNA

SEQ ID NO: 56866 - DNA, 623 bp, Homo sapiens; identical to SEQ ID NO: 36258
  misc_feature 1..623: note = chr16:77246307-77246930
  misc_feature 1..623: note = hyper
  source 1..623: mol_type = genomic DNA

SEQ ID NO: 56867 - DNA, 59 bp, Homo sapiens; identical to SEQ ID NO: 36260
  misc_feature 1..59: note = chr16:77469028-77469087
  misc_feature 1..59: note = hyper
  source 1..59: mol_type = genomic DNA

SEQ ID NO: 56868 - DNA, 266 bp, Homo sapiens; identical to SEQ ID NO: 36261
  misc_feature 1..266: note = chr16:77822153-77822419
  misc_feature 1..266: note = hyper
  source 1..266: mol_type = genomic DNA

SEQ ID NO: 56869 - DNA, 169 bp, Homo sapiens; identical to SEQ ID NO: 22359
  misc_feature 1..169: note = chr16:77822420-77822589
  misc_feature 1..169: note = hyper
  source 1..169: mol_type = genomic DNA

SEQ ID NO: 56870 - DNA, 273 bp, Homo sapiens
  misc_feature 1..273: note = chr16:77822874-77823147
  misc_feature 1..273: note = hyper
  source 1..273: mol_type = genomic DNA
gggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgc

SEQ ID NO: 56871 - DNA, 184 bp, Homo sapiens
  misc_feature 1..184: note = chr16:78079785-78079969
  misc_feature 1..184: note = hyper
  source 1..184: mol_type = genomic DNA
ggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcg

SEQ ID NO: 56872 - DNA, 105 bp, Homo sapiens
  misc_feature 1..105: note = chr16:78080054-78080159
  misc_feature 1..105: note = hyper
  source 1..105: mol_type = genomic DNA
ctgaagtgttggccgcgagcggagctgctgcagcgctggcttccccgggccgctgcgggtggacttggacaacataaagggctgattgagcggggccactttttc

SEQ ID NO: 56873 - DNA, 167 bp, Homo sapiens; identical to SEQ ID NO: 36265
  misc_feature 1..167: note = chr16:79632650-79632817
  misc_feature 1..167: note = hyper
  source 1..167: mol_type = genomic DNA

SEQ ID NO: 56874 - DNA, 95 bp, Homo sapiens; identical to SEQ ID NO: 36266
  misc_feature 1..95: note = chr16:79633073-79633168
  misc_feature 1..95: note = hyper
  source 1..95: mol_type = genomic DNA

SEQ ID NO: 56875 - DNA, 59 bp, Homo sapiens; identical to SEQ ID NO: 36267
  misc_feature 1..59: note = chr16:79633469-79633528
  misc_feature 1..59: note = hyper
  source 1..59: mol_type = genomic DNA

SEQ ID NO: 56876 - DNA, 51 bp, Homo sapiens; identical to SEQ ID NO: 36268
  misc_feature 1..51: note = chr16:79633792-79633843
  misc_feature 1..51: note = hyper
  source 1..51: mol_type = genomic DNA

SEQ ID NO: 56877 - DNA, 30 bp, Homo sapiens; identical to SEQ ID NO: 36269
  misc_feature 1..30: note = chr16:79634970-79635000
  misc_feature 1..30: note = hyper
  source 1..30: mol_type = genomic DNA

SEQ ID NO: 56878 - DNA, 32 bp, Homo sapiens; identical to SEQ ID NO: 36270
  misc_feature 1..32: note = chr16:79635617-79635649
  misc_feature 1..32: note = hyper
  source 1..32: mol_type = genomic DNA

SEQ ID NO: 56879 - DNA, 58 bp, Homo sapiens; identical to SEQ ID NO: 36271
  misc_feature 1..58: note = chr16:79804242-79804300
  misc_feature 1..58: note = hyper
  source 1..58: mol_type = genomic DNA

SEQ ID NO: 56880 - DNA, 369 bp, Homo sapiens; identical to SEQ ID NO: 36272
  misc_feature 1..369: note = chr16:80574670-80575039
  misc_feature 1..369: note = hyper
  source 1..369: mol_type = genomic DNA

SEQ ID NO: 56881 - DNA, 30 bp, Homo sapiens; identical to SEQ ID NO: 36274
  misc_feature 1..30: note = chr16:81779906-81779936
  misc_feature 1..30: note = hyper
  source 1..30: mol_type = genomic DNA

SEQ ID NO: 56882 - DNA, 30 bp, Homo sapiens; identical to SEQ ID NO: 36275
  misc_feature 1..30: note = chr16:81813567-81813597
  misc_feature 1..30: note = hyper
  source 1..30: mol_type = genomic DNA

SEQ ID NO: 56883 - DNA, 48 bp, Homo sapiens
  misc_feature 1..48: note = chr16:82660312-82660360
  misc_feature 1..48: note = hyper
  source 1..48: mol_type = genomic DNA
tggccgccagtcccccgtgcaattccattctctggaaaagtggaatca

SEQ ID NO: 56884 - DNA, 72 bp, Homo sapiens
  misc_feature 1..72: note = chr16:82660496-82660568
  misc_feature 1..72: note = hyper
  source 1..72: mol_type = genomic DNA
aaggaatccgtcttgtaaagccattggtcctggtcatcagcctctacccaatgctttcgtgatgctgctgct

SEQ ID NO: 56885 - DNA, 124 bp, Homo sapiens; identical to SEQ ID NO: 36277
  misc_feature 1..124: note = chr16:82660780-82660904
  misc_feature 1..124: note = hyper
  source 1..124: mol_type = genomic DNA

SEQ ID NO: 56886 - DNA, 161 bp, Homo sapiens; identical to SEQ ID NO: 36278
  misc_feature 1..161: note = chr16:82661251-82661412
  misc_feature 1..161: note = hyper
  source 1..161: mol_type = genomic DNA

SEQ ID NO: 56887 - DNA, 292 bp, Homo sapiens; identical to SEQ ID NO: 36279
  misc_feature 1..292: note = chr16:82661468-82661760
  misc_feature 1..292: note = hyper
  source 1..292: mol_type = genomic DNA

SEQ ID NO: 56888 - DNA, 30 bp, Homo sapiens; identical to SEQ ID NO: 36280
  misc_feature 1..30: note = chr16:84001873-84001903
  misc_feature 1..30: note = hyper
  source 1..30: mol_type = genomic DNA

SEQ ID NO: 56889 - DNA, 52 bp, Homo sapiens; identical to SEQ ID NO: 36281
  misc_feature 1..52: note = chr16:84402140-84402192
  misc_feature 1..52: note = hyper
  source 1..52: mol_type = genomic DNA

SEQ ID NO: 56890 - DNA, 125 bp, Homo sapiens; identical to SEQ ID NO: 36282
  misc_feature 1..125: note = chr16:84633325-84633450
  misc_feature 1..125: note = hyper
  source 1..125: mol_type = genomic DNA

SEQ ID NO: 56891 - DNA, 285 bp, Homo sapiens
  misc_feature 1..285: note = chr16:84853376-84853661
  misc_feature 1..285: note = hyper
  source 1..285: mol_type = genomic DNA
agccggccctggaggccagcggccccgccttcctcgcccacccggcgcccgcgcctcagctgccccccgcctccttcagcccgctgagcctgcggggcggggccgggggcggggccggtgatgctcggtcctaccagcgccgccagcgatctgggggcgtggcctccgggctccggggagcctacaagaggcggtacgctgagccccggcacccactcgcatcccagggcgtctccggctgctcctattgagctgtctgctcgctgtgcccgctgtgcctgctgt

SEQ ID NO: 56892 - DNA, 183 bp, Homo sapiens; identical to SEQ ID NO: 36284
  misc_feature 1..183: note = chr16:85203399-85203582
  misc_feature 1..183: note = hyper
  source 1..183: mol_type = genomic DNA

SEQ ID NO: 56893 - DNA, 360 bp, Homo sapiens; identical to SEQ ID NO: 36285
  misc_feature 1..360: note = chr16:85932306-85932666
  misc_feature 1..360: note = hyper
  source 1..360: mol_type = genomic DNA

SEQ ID NO: 56894 - skipped

SEQ ID NO: 56895 - DNA, 159 bp, Homo sapiens
  misc_feature 1..159: note = chr16:85932669-85932828
  misc_feature 1..159: note = hyper
  source 1..159: mol_type = genomic DNA
cgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggca

SEQ ID NO: 56896 - DNA, 115 bp, Homo sapiens
  misc_feature 1..115: note = chr16:85932858-85932973
  misc_feature 1..115: note = hyper
  source 1..115: mol_type = genomic DNA
tgtcccgcgcggtccggtcccgcggggtccccgacgccaggcggggcgtgggggtggaactacctaccgtaatgtccccgggcgcagctcagtggccacccgtgtccctctctgc

SEQ ID NO: 56897 - DNA, 30 bp, Homo sapiens; identical to SEQ ID NO: 36288
  misc_feature 1..30: note = chr16:86081925-86081955
  misc_feature 1..30: note = hyper
  source 1..30: mol_type = genomic DNA

SEQ ID NO: 56898 - DNA, 70 bp, Homo sapiens
  misc_feature 1..70: note = chr16:86320284-86320354
  misc_feature 1..70: note = hyper
  source 1..70: mol_type = genomic DNA
gggctccagaaaccccgaccctcgcaggggagagccagccgaaccagacgtgtgggggcagcagccgccg

SEQ ID NO: 56899 - DNA, 98 bp, Homo sapiens
  misc_feature 1..98: note = chr16:86320391-86320489
  misc_feature 1..98: note = hyper
  source 1..98: mol_type = genomic DNA
ttgggtccagggacccaagacggggatctgggaggagggggatgcccttggggcctgagacccgggcggtttccgaagcgaagtagttacccagaacc

SEQ ID NO: 56900 - DNA, 265 bp, Homo sapiens
  misc_feature 1..265: note = chr16:86320490-86320755
  misc_feature 1..265: note = hyper
  source 1..265: mol_type = genomic DNA
ctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctcc

SEQ ID NO: 56901 - DNA, 220 bp, Homo sapiens
  misc_feature 1..220: note = chr16:86320800-86321020
  misc_feature 1..220: note = hyper
  source 1..220: mol_type = genomic DNA
caggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtct

SEQ ID NO: 56902 - DNA, 243 bp, Homo sapiens; identical to SEQ ID NO: 22372
  misc_feature 1..243: note = chr16:86531046-86531289
  misc_feature 1..243: note = hyper
  source 1..243: mol_type = genomic DNA

SEQ ID NO: 56903 - DNA, 52 bp, Homo sapiens
  misc_feature 1..52: note = chr16:86531573-86531625
  misc_feature 1..52: note = hyper
  source 1..52: mol_type = genomic DNA
gtccctcccgccgcgcagggtctccgcgggcgcgccccgccccaaatagagc

SEQ ID NO: 56904 - DNA, 324 bp, Homo sapiens; identical to SEQ ID NO: 36295
  misc_feature 1..324: note = chr16:86539103-86539427
  misc_feature 1..324: note = hyper
  source 1..324: mol_type = genomic DNA

SEQ ID NO: 56905 - DNA, 36 bp, Homo sapiens; identical to SEQ ID NO: 36296
  misc_feature 1..36: note = chr16:86539463-86539499
  misc_feature 1..36: note = hyper
  source 1..36: mol_type = genomic DNA

SEQ ID NO: 56906 - DNA, 101 bp, Homo sapiens; identical to SEQ ID NO: 36299
  misc_feature 1..101: note = chr16:86543663-86543764
  misc_feature 1..101: note = hyper
  source 1..101: mol_type = genomic DNA

SEQ ID NO: 56907 - DNA, 163 bp, Homo sapiens; identical to SEQ ID NO: 36301
  misc_feature 1..163: note = chr16:86599222-86599385
  misc_feature 1..163: note = hyper
  source 1..163: mol_type = genomic DNA

SEQ ID NO: 56908 - DNA, 148 bp, Homo sapiens
  misc_feature 1..148: note = chr16:86599844-86599992
  misc_feature 1..148: note = hyper
  source 1..148: mol_type = genomic DNA
ttgtagggtttacctctaaaacctcgataggttatccttgacgaccccgagcctggaaactccctgttgatgattaattatttgattaaataagtataacatccaggagaggccctgccattccaatccagcgcgtttgctttgaatc

SEQ ID NO: 56909 - DNA, 168 bp, Homo sapiens
  misc_feature 1..168: note = chr16:86600315-86600483
  misc_feature 1..168: note = hyper
  source 1..168: mol_type = genomic DNA
ctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctc

SEQ ID NO: 56910 - DNA, 272 bp, Homo sapiens
  misc_feature 1..272: note = chr16:86600686-86600958
  misc_feature 1..272: note = hyper
  source 1..272: mol_type = genomic DNA
gcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactc

SEQ ID NO: 56911 - DNA, 73 bp, Homo sapiens
  misc_feature 1..73: note = chr16:86601213-86601286
  misc_feature 1..73: note = hyper
  source 1..73: mol_type = genomic DNA
gaagatcaccttgaacggcatctaccagttcatcatggaccgcttccccttctaccgggagaacaagcagggc

SEQ ID NO: 56912 - DNA, 84 bp, Homo sapiens; identical to SEQ ID NO: 12569
  misc_feature 1..84: note = chr16:86775022-86775106
  misc_feature 1..84: note = hyper
  source 1..84: mol_type = genomic DNA

SEQ ID NO: 56913 - DNA, 30 bp, Homo sapiens; identical to SEQ ID NO: 36307
  misc_feature 1..30: note = chr16:87622644-87622674
  misc_feature 1..30: note = hyper
  source 1..30: mol_type = genomic DNA

SEQ ID NO: 56914 - DNA, 33 bp, Homo sapiens; identical to SEQ ID NO: 22379
  misc_feature 1..33: note = chr16:87635070-87635103
  misc_feature 1..33: note = hyper
  source 1..33: mol_type = genomic DNA

SEQ ID NO: 56915 - DNA, 66 bp, Homo sapiens
  misc_feature 1..66: note = chr16:87635133-87635199
  misc_feature 1..66: note = hyper
  source 1..66: mol_type = genomic DNA
gcctccacacccccatcagcccactgcaccggtctgctgccatttcccgcacgcatttcaggaggg

SEQ ID NO: 56916 - DNA, 37 bp, Homo sapiens; identical to SEQ ID NO: 36309
  misc_feature 1..37: note = chr16:87635424-87635461
  misc_feature 1..37: note = hyper
  source 1..37: mol_type = genomic DNA

SEQ ID NO: 56917 - DNA, 294 bp, Homo sapiens; identical to SEQ ID NO: 36310
  misc_feature 1..294: note = chr16:87636197-87636491
  misc_feature 1..294: note = hyper
  source 1..294: mol_type = genomic DNA

SEQ ID NO: 56918 - DNA, 413 bp, Homo sapiens
  misc_feature 1..413: note = chr16:87636907-87637320
  misc_feature 1..413: note = hyper
  source 1..413: mol_type = genomic DNA
ctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtgggg

SEQ ID NO: 56919 - DNA, 78 bp, Homo sapiens; identical to SEQ ID NO: 36313
  misc_feature 1..78: note = chr16:87637599-87637677
  misc_feature 1..78: note = hyper
  source 1..78: mol_type = genomic DNA

SEQ ID NO: 56920 - DNA, 120 bp, Homo sapiens; identical to SEQ ID NO: 36314
  misc_feature 1..120: note = chr16:88449303-88449423
  misc_feature 1..120: note = hyper
  source 1..120: mol_type = genomic DNA

SEQ ID NO: 56921 - DNA, 302 bp, Homo sapiens; identical to SEQ ID NO: 36315
  misc_feature 1..302: note = chr16:88449693-88449995
  misc_feature 1..302: note = hyper
  source 1..302: mol_type = genomic DNA

SEQ ID NO: 56922 - DNA, 65 bp, Homo sapiens; identical to SEQ ID NO: 12576
  misc_feature 1..65: note = chr16:88450363-88450428
  misc_feature 1..65: note = hyper
  source 1..65: mol_type = genomic DNA

SEQ ID NO: 56923 - DNA, 178 bp, Homo sapiens; identical to SEQ ID NO: 36317
  misc_feature 1..178: note = chr16:89006356-89006534
  misc_feature 1..178: note = hyper
  source 1..178: mol_type = genomic DNA

SEQ ID NO: 56924 - DNA, 30 bp, Homo sapiens; identical to SEQ ID NO: 36318
  misc_feature 1..30: note = chr16:89006819-89006849
  misc_feature 1..30: note = hyper
  source 1..30: mol_type = genomic DNA

SEQ ID NO: 56925 - DNA, 11 bp, Homo sapiens
  misc_feature 1..11: note = chr16:89007509-89007520
  misc_feature 1..11: note = hyper
  source 1..11: mol_type = genomic DNA
tggtccccgcc

SEQ ID NO: 56926 - DNA, 222 bp, Homo sapiens
  misc_feature 1..222: note = chr16:89007558-89007780
  misc_feature 1..222: note = hyper
  source 1..222: mol_type = genomic DNA
ccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgcccc

SEQ ID NO: 56927 - DNA, 14 bp, Homo sapiens
  misc_feature 1..14: note = chr16:89267320-89267334
  misc_feature 1..14: note = hyper
  source 1..14: mol_type = genomic DNA
gccagcccaaagcc

SEQ ID NO: 56928 - DNA, 444 bp, Homo sapiens
  misc_feature 1..444: note = chr16:89267364-89267808
  misc_feature 1..444: note = hyper
  source 1..444: mol_type = genomic DNA
agcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcag

SEQ ID NO: 56929 - DNA, 95 bp, Homo sapiens; identical to SEQ ID NO: 36321
  misc_feature 1..95: note = chr16:89268397-89268492
  misc_feature 1..95: note = hyper
  source 1..95: mol_type = genomic DNA

SEQ ID NO: 56930 - DNA, 30 bp, Homo sapiens; identical to SEQ ID NO: 36322
  misc_feature 1..30: note = chr16:89268813-89268843
  misc_feature 1..30: note = hyper
  source 1..30: mol_type = genomic DNA

SEQ ID NO: 56931 - DNA, 61 bp, Homo sapiens; identical to SEQ ID NO: 36323
  misc_feature 1..61: note = chr16:89778723-89778784
  misc_feature 1..61: note = hyper
  source 1..61: mol_type = genomic DNA

SEQ ID NO: 56932 - DNA, 83 bp, Homo sapiens; identical to SEQ ID NO: 36324
  misc_feature 1..83: note = chr16:89992890-89992973
  misc_feature 1..83: note = hyper
  source 1..83: mol_type = genomic DNA

SEQ ID NO: 56933 - DNA, 208 bp, Homo sapiens; identical to SEQ ID NO: 36325
  misc_feature 1..208: note = chr17:1083533-1083741
  misc_feature 1..208: note = hyper
  source 1..208: mol_type = genomic DNA

SEQ ID NO: 56934 - DNA, 136 bp, Homo sapiens
  misc_feature 1..136: note = chr17:1174413-1174549
  misc_feature 1..136: note = hyper
  source 1..136: mol_type = genomic DNA
cacggcccagtgcggtggccgaggggccgggcctagcacaggcctccgggggaagctggcgccgctgtccgggggcttcctctgccgggccgcctccctggccgcggggctacctgcgatccgcccccgggatggg

SEQ ID NO: 56935 - DNA, 30 bp, Homo sapiens; identical to SEQ ID NO: 36328
  misc_feature 1..30: note = chr17:1811643-1811673
  misc_feature 1..30: note = hyper
  source 1..30: mol_type = genomic DNA

SEQ ID NO: 56936 - DNA, 212 bp, Homo sapiens; identical to SEQ ID NO: 36329
  misc_feature 1..212: note = chr17:1901506-1901718
  misc_feature 1..212: note = hyper
  source 1..212: mol_type = genomic DNA

SEQ ID NO: 56937 - DNA, 50 bp, Homo sapiens; identical to SEQ ID NO: 36330
  misc_feature 1..50: note = chr17:1901920-1901970
  misc_feature 1..50: note = hyper
  source 1..50: mol_type = genomic DNA

SEQ ID NO: 56938 - DNA, 272 bp, Homo sapiens; identical to SEQ ID NO: 36331
  misc_feature 1..272: note = chr17:1927434-1927706
  misc_feature 1..272: note = hyper
  source 1..272: mol_type = genomic DNA

SEQ ID NO: 56939 - DNA, 176 bp, Homo sapiens; identical to SEQ ID NO: 36332
  misc_feature 1..176: note = chr17:1927990-1928166
  misc_feature 1..176: note = hyper
  source 1..176: mol_type = genomic DNA

SEQ ID NO: 56940 - DNA, 34 bp, Homo sapiens; identical to SEQ ID NO: 36333
  misc_feature 1..34: note = chr17:1957561-1957595
  misc_feature 1..34: note = hyper
  source 1..34: mol_type = genomic DNA

SEQ ID NO: 56941 - DNA, 132 bp, Homo sapiens; identical to SEQ ID NO: 36334
  misc_feature 1..132: note = chr17:1959132-1959264
  misc_feature 1..132: note = hyper
  source 1..132: mol_type = genomic DNA

SEQ ID NO: 56942 - DNA, 32 bp, Homo sapiens; identical to SEQ ID NO: 22391
  misc_feature 1..32: note = chr17:1959436-1959468
  misc_feature 1..32: note = hyper
  source 1..32: mol_type = genomic DNA

SEQ ID NO: 56943 - DNA, 45 bp, Homo sapiens
  misc_feature 1..45: note = chr17:1959520-1959565
  misc_feature 1..45: note = hyper
  source 1..45: mol_type = genomic DNA
aactggggcaacttctcccgaggcgggaggcgctggttcctcggc

SEQ ID NO: 56944 - DNA, 49 bp, Homo sapiens; identical to SEQ ID NO: 36336
  misc_feature 1..49: note = chr17:2627535-2627584
  misc_feature 1..49: note = hyper
  source 1..49: mol_type = genomic DNA

SEQ ID NO: 56945 - DNA, 517 bp, Homo sapiens; identical to SEQ ID NO: 36337
  misc_feature 1..517: note = chr17:2627798-2628315
  misc_feature 1..517: note = hyper
  source 1..517: mol_type = genomic DNA

SEQ ID NO: 56946 - DNA, 89 bp, Homo sapiens; identical to SEQ ID NO: 36338
  misc_feature 1..89: note = chr17:2652543-2652632
  misc_feature 1..89: note = hyper
  source 1..89: mol_type = genomic DNA

SEQ ID NO: 56947 - DNA, 61 bp, Homo sapiens; identical to SEQ ID NO: 36339
  misc_feature 1..61: note = chr17:2659604-2659665
  misc_feature 1..61: note = hyper
  source 1..61: mol_type = genomic DNA

SEQ ID NO: 56948 - DNA, 294 bp, Homo sapiens; identical to SEQ ID NO: 36340
  misc_feature 1..294: note = chr17:2680204-2680498
  misc_feature 1..294: note = hyper
  source 1..294: mol_type = genomic DNA

SEQ ID NO: 56949 - DNA, 136 bp, Homo sapiens; identical to SEQ ID NO: 36341
  misc_feature 1..136: note = chr17:2756282-2756418
  misc_feature 1..136: note = hyper
  source 1..136: mol_type = genomic DNA

SEQ ID NO: 56950 - DNA, 48 bp, Homo sapiens
  misc_feature 1..48: note = chr17:3438866-3438914
  misc_feature 1..48: note = hyper
  source 1..48: mol_type = genomic DNA
cgaagtagaagccttcgtgttggtacttggggttgaagaaggccccct

SEQ ID NO: 56951 - DNA, 74 bp, Homo sapiens; identical to SEQ ID NO: 36343
  misc_feature 1..74: note = chr17:3599635-3599709
  misc_feature 1..74: note = hyper
  source 1..74: mol_type = genomic DNA

SEQ ID NO: 56952 - DNA, 183 bp, Homo sapiens; identical to SEQ ID NO: 36344
  misc_feature 1..183: note = chr17:3866983-3867166
  misc_feature 1..183: note = hyper
  source 1..183: mol_type = genomic DNA

SEQ ID NO: 56953 - DNA, 116 bp, Homo sapiens
  misc_feature 1..116: note = chr17:4544491-4544607
  misc_feature 1..116: note = hyper
  source 1..116: mol_type = genomic DNA
agaaagcgagaggaccgacggcggctccagtgactgctgagtttccagacaagggagctttgtgcaatgaggggcgcacaggagcatgccctcaattccaaggagatcgggtagcg

SEQ ID NO: 56954 - DNA, 294 bp, Homo sapiens
  misc_feature 1..294: note = chr17:4544710-4545004
  misc_feature 1..294: note = hyper
  source 1..294: mol_type = genomic DNA
gagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataaccc

SEQ ID NO: 56955 - DNA, 154 bp, Homo sapiens; identical to SEQ ID NO: 36346
  misc_feature 1..154: note = chr17:4981395-4981549
  misc_feature 1..154: note = hyper
  source 1..154: mol_type = genomic DNA

SEQ ID NO: 56956 - DNA, 34 bp, Homo sapiens; identical to SEQ ID NO: 36347
  misc_feature 1..34: note = chr17:4981951-4981985
  misc_feature 1..34: note = hyper
  source 1..34: mol_type = genomic DNA

SEQ ID NO: 56957 - DNA, 74 bp, Homo sapiens
  misc_feature 1..74: note = chr17:5000354-5000428
  misc_feature 1..74: note = hyper
  source 1..74: mol_type = genomic DNA
cccagtgggaaggagcggggacgattctggcgatcacatgaggaagggagcagcctcagcagcgcaggtggaca

SEQ ID NO: 56958 - DNA, 57 bp, Homo sapiens; identical to SEQ ID NO: 36349
  misc_feature 1..57: note = chr17:5000879-5000936
  misc_feature 1..57: note = hyper
  source 1..57: mol_type = genomic DNA

SEQ ID NO: 56959 - DNA, 58 bp, Homo sapiens; identical to SEQ ID NO: 36350
  misc_feature 1..58: note = chr17:5001149-5001207
  misc_feature 1..58: note = hyper
  source 1..58: mol_type = genomic DNA

SEQ ID NO: 56960 - DNA, 37 bp, Homo sapiens; identical to SEQ ID NO: 36351
  misc_feature 1..37: note = chr17:5973300-5973337
  misc_feature 1..37: note = hyper
  source 1..37: mol_type = genomic DNA

SEQ ID NO: 56961 - DNA, 270 bp, Homo sapiens; identical to SEQ ID NO: 36352
  misc_feature 1..270: note = chr17:5973825-5974095
  misc_feature 1..270: note = hyper
  source 1..270: mol_type = genomic DNA

SEQ ID NO: 56962 - DNA, 366 bp, Homo sapiens
  misc_feature 1..366: note = chr17:6616271-6616637
  misc_feature 1..366: note = hyper
  source 1..366: mol_type = genomic DNA
gatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagct

SEQ ID NO: 56963 - DNA, 197 bp, Homo sapiens; identical to SEQ ID NO: 22405
  misc_feature 1..197: note = chr17:6616686-6616883
  misc_feature 1..197: note = hyper
  source 1..197: mol_type = genomic DNA

SEQ ID NO: 56964 - DNA, 27 bp, Homo sapiens
  misc_feature 1..27: note = chr17:6616884-6616911
  misc_feature 1..27: note = hyper
  source 1..27: mol_type = genomic DNA
cttcgggccagccctctaggggcagcc

SEQ ID NO: 56965 - DNA, 36 bp, Homo sapiens; identical to SEQ ID NO: 36355
  misc_feature 1..36: note = chr17:6679303-6679339
  misc_feature 1..36: note = hyper
  source 1..36: mol_type = genomic DNA

SEQ ID NO: 56966 - DNA, 214 bp, Homo sapiens; identical to SEQ ID NO: 36356
  misc_feature 1..214: note = chr17:6679581-6679795
  misc_feature 1..214: note = hyper
  source 1..214: mol_type = genomic DNA

SEQ ID NO: 56967 - DNA, 30 bp, Homo sapiens; identical to SEQ ID NO: 36357
  misc_feature 1..30: note = chr17:6735130-6735160
  misc_feature 1..30: note = hyper
  source 1..30: mol_type = genomic DNA

SEQ ID NO: 56968 - DNA, 230 bp, Homo sapiens; identical to SEQ ID NO: 36358
  misc_feature 1..230: note = chr17:6926198-6926428
  misc_feature 1..230: note = hyper
  source 1..230: mol_type = genomic DNA

SEQ ID NO: 56969 - DNA, 36 bp, Homo sapiens; identical to SEQ ID NO: 36359
  misc_feature 1..36: note = chr17:7197656-7197692
  misc_feature 1..36: note = hyper
  source 1..36: mol_type = genomic DNA

SEQ ID NO: 56970 - DNA, 181 bp, Homo sapiens; identical to SEQ ID NO: 36361
  misc_feature 1..181: note = chr17:7554612-7554793
  misc_feature 1..181: note = hyper
  source 1..181: mol_type = genomic DNA

SEQ ID NO: 56971 - DNA, 30 bp, Homo sapiens; identical to SEQ ID NO: 36362
  misc_feature 1..30: note = chr17:7621433-7621463
  misc_feature 1..30: note = hyper
  source 1..30: mol_type = genomic DNA

SEQ ID NO: 56972 - DNA, 49 bp, Homo sapiens; identical to SEQ ID NO: 36363
  misc_feature 1..49: note = chr17:7976269-7976318
  misc_feature 1..49: note = hyper
  source 1..49: mol_type = genomic DNA

SEQ ID NO: 56973 - DNA, 589 bp, Homo sapiens; identical to SEQ ID NO: 36364
  misc_feature 1..589: note = chr17:8055166-8055755
  misc_feature 1..589: note = hyper
  source 1..589: mol_type = genomic DNA

SEQ ID NO: 56974 - DNA, 63 bp, Homo sapiens
  misc_feature 1..63: note = chr17:8230272-8230335
  misc_feature 1..63: note = hyper
  source 1..63: mol_type = genomic DNA
gtcgtctccaagccacggtctcaccaccctccatcagcctcgggcgacaccaaggggaacaga

SEQ ID NO: 56975 - DNA, 127 bp, Homo sapiens
  misc_feature 1..127: note = chr17:8230694-8230821
  misc_feature 1..127: note = hyper
  source 1..127: mol_type = genomic DNA
tagccactcctccttcccacccacccgcagcactctcgaggtcgcaacggcagtcaccaggtcccggggcctgcgttcagctgcttgatccgactaggtttggcttcggacccgaatgggtcagctc

SEQ ID NO: 56976 - DNA, 38 bp, Homo sapiens; identical to SEQ ID NO: 36367
  misc_feature 1..38: note = chr17:8533161-8533199
  misc_feature 1..38: note = hyper
  source 1..38: mol_type = genomic DNA

SEQ ID NO: 56977 - DNA, 38 bp, Homo sapiens
  misc_feature 1..38: note = chr17:8868582-8868620
  misc_feature 1..38: note = hyper
  source 1..38: mol_type = genomic DNA
ccctacgacacagggcgtcctgtgtcagaggcaggagg

SEQ ID NO: 56978 - DNA, 86 bp, Homo sapiens
  misc_feature 1..86: note = chr17:8869385-8869471
  misc_feature 1..86: note = hyper
  source 1..86: mol_type = genomic DNA
ggtctggggtaggggcttaggggaaagacgagaaagaggaagctccgacgagctgcttccttctctcactgcgacccacttcctct

SEQ ID NO: 56979 - DNA, 475 bp, Homo sapiens
  misc_feature 1..475: note = chr17:8906518-8906993
  misc_feature 1..475: note = hyper
  source 1..475: mol_type = genomic DNA
ccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgc

SEQ ID NO: 56980 - DNA, 153 bp, Homo sapiens; identical to SEQ ID NO: 22414
  misc_feature 1..153: note = chr17:8907575-8907728
  misc_feature 1..153: note = hyper
  source 1..153: mol_type = genomic DNA

SEQ ID NO: 56981 - DNA, 22 bp, Homo sapiens
  misc_feature 1..22: note = chr17:8907776-8907798
  misc_feature 1..22: note = hyper
  source 1..22: mol_type = genomic DNA
cgggtgacggaggctttatcct

SEQ ID NO: 56982 - DNA, 123 bp, Homo sapiens; identical to SEQ ID NO: 36374
  misc_feature 1..123: note = chr17:8925590-8925713
  misc_feature 1..123: note = hyper
  source 1..123: mol_type = genomic DNA

SEQ ID NO: 56983 - DNA, 151 bp, Homo sapiens
  misc_feature 1..151: note = chr17:10102264-10102415
  misc_feature 1..151: note = hyper
  source 1..151: mol_type = genomic DNA
cggagggctgcgcgctccctcgcagaggggcctgtcactggggagaggggctcccactcgcgcccccaccgccggggaccgcgggaatggaaacgcccctctgttctgtgcctgctttgtaggcctggcggcccgtggcgtgcgggcggct

SEQ ID NO: 56984 - DNA, 432 bp, Homo sapiens; identical to SEQ ID NO: 36378
  misc_feature 1..432: note = chr17:10632918-10633350
  misc_feature 1..432: note = hyper
  source 1..432: mol_type = genomic DNA

SEQ ID NO: 56985 - DNA, 60 bp, Homo sapiens; identical to SEQ ID NO: 36379
  misc_feature 1..60: note = chr17:11145224-11145284
  misc_feature 1..60: note = hyper
  source 1..60: mol_type = genomic DNA

SEQ ID NO: 56986 - DNA, 32 bp, Homo sapiens; identical to SEQ ID NO: 36380
  misc_feature 1..32: note = chr17:11501937-11501969
  misc_feature 1..32: note = hyper
  source 1..32: mol_type = genomic DNA

SEQ ID NO: 56987 - DNA, 50 bp, Homo sapiens; identical to SEQ ID NO: 36381
  misc_feature 1..50: note = chr17:12568739-12568789
  misc_feature 1..50: note = hyper
  source 1..50: mol_type = genomic DNA

SEQ ID NO: 56988 - DNA, 33 bp, Homo sapiens; identical to SEQ ID NO: 36382
  misc_feature 1..33: note = chr17:12877698-12877731
  misc_feature 1..33: note = hyper
  source 1..33: mol_type = genomic DNA

SEQ ID NO: 56989 - DNA, 103 bp, Homo sapiens; identical to SEQ ID NO: 36383
  misc_feature 1..103: note = chr17:13503842-13503945
  misc_feature 1..103: note = hyper
  source 1..103: mol_type = genomic DNA

SEQ ID NO: 56990 - DNA, 115 bp, Homo sapiens
  misc_feature 1..115: note = chr17:13504195-13504310
  misc_feature 1..115: note = hyper
  source 1..115: mol_type = genomic DNA
gccgccggccacaccgccagctccctcgggcctccggccaggacgccgccaccaggggcccccgcctcctcgccgccgccggacagccccacgacggggccggacagggtctggc

SEQ ID NO: 56991 - DNA, 89 bp, Homo sapiens
  misc_feature 1..89: note = chr17:13504681-13504770
  misc_feature 1..89: note = hyper
  source 1..89: mol_type = genomic DNA
gggtccgtgcttaagaaaccatcgtcttagactcgcccaagtcctgagcttggggcagccttggcccctcggttccccgcaagagtcgc

SEQ ID NO: 56992 - DNA, 230 bp, Homo sapiens
  misc_feature 1..230: note = chr17:13505188-13505418
  misc_feature 1..230: note = hyper
  source 1..230: mol_type = genomic DNA
cggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaat

SEQ ID NO: 56993 - DNA, 152 bp, Homo sapiens; identical to SEQ ID NO: 36387
  misc_feature 1..152: note = chr17:14200755-14200907
  misc_feature 1..152: note = hyper
  source 1..152: mol_type = genomic DNA

SEQ ID NO: 56994 - DNA, 111 bp, Homo sapiens
  misc_feature 1..111: note = chr17:14200930-14201041
  misc_feature 1..111: note = hyper
  source 1..111: mol_type = genomic DNA
cgcagctgctaacccccgaggggccgcctcgctggcgaggggagcgggaggaaggtccggattccggtggcaggaactggggctctgggccaccggttcaggctgccccag

SEQ ID NO: 56995 - DNA, 27 bp, Homo sapiens
  misc_feature 1..27: note = chr17:14201181-14201208
  misc_feature 1..27: note = hyper
  source 1..27: mol_type = genomic DNA
cggaaaatactgcggggatggtttggc

SEQ ID NO: 56996 - DNA, 244 bp, Homo sapiens; identical to SEQ ID NO: 36389
  misc_feature 1..244: note = chr17:14203027-14203271
  misc_feature 1..244: note = hyper
  source 1..244: mol_type = genomic DNA

SEQ ID NO: 56997 - DNA, 201 bp, Homo sapiens
  misc_feature 1..201: note = chr17:14204011-14204212
  misc_feature 1..201: note = hyper
  source 1..201: mol_type = genomic DNA
catctgggcaactaccgccaaggctggcttctagggaacgagtgcggaaatgcgtgcgggtgtgggagcgcaccactcagtagggtaggacctctcccagcgctaggtcactgcagcattcttcccaccatctgctcctgtcaccagcccctaactccgcccctttgggcccgccccttgttccgaagccaatagcaaccc

SEQ ID NO: 56998 - DNA, 103 bp, Homo sapiens; identical to SEQ ID NO: 36391
  misc_feature 1..103: note = chr17:14204731-14204834
  misc_feature 1..103: note = hyper
  source 1..103: mol_type = genomic DNA

SEQ ID NO: 56999 - DNA, 566 bp, Homo sapiens; identical to SEQ ID NO: 36392
  misc_feature 1..566: note = chr17:14205251-14205817
  misc_feature 1..566: note = hyper
  source 1..566: mol_type = genomic DNA

SEQ ID NO: 57000 - DNA, 134 bp, Homo sapiens; identical to SEQ ID NO: 36393
  misc_feature 1..134: note = chr17:14206209-14206343
  misc_feature 1..134: note = hyper
  source 1..134: mol_type = genomic DNA

SEQ ID NO: 57001 - skipped

SEQ ID NO: 57002 - DNA, 30 bp, Homo sapiens; identical to SEQ ID NO: 12624
  misc_feature 1..30: note = chr17:15164652-15164682
  misc_feature 1..30: note = hyper
  source 1..30: mol_type = genomic DNA

SEQ ID NO: 57003 - DNA, 786 bp, Homo sapiens; identical to SEQ ID NO: 36396
  misc_feature 1..786: note = chr17:15166015-15166801
  misc_feature 1..786: note = hyper
  source 1..786: mol_type = genomic DNA

SEQ ID NO: 57004 - DNA, 86 bp, Homo sapiens; identical to SEQ ID NO: 36397
  misc_feature 1..86: note = chr17:15244447-15244533
  misc_feature 1..86: note = hyper
  source 1..86: mol_type = genomic DNA

SEQ ID NO: 57005 - DNA, 63 bp, Homo sapiens; identical to SEQ ID NO: 22428
  misc_feature 1..63: note = chr17:15244987-15245050
  misc_feature 1..63: note = hyper
  source 1..63: mol_type = genomic DNA

SEQ ID NO: 57006 - DNA, 253 bp, Homo sapiens; identical to SEQ ID NO: 36399
  misc_feature 1..253: note = chr17:15820777-15821030
  misc_feature 1..253: note = hyper
  source 1..253: mol_type = genomic DNA

SEQ ID NO: 57007 - DNA, 84 bp, Homo sapiens; identical to SEQ ID NO: 36400
  misc_feature 1..84: note = chr17:15847883-15847967
  misc_feature 1..84: note = hyper
  source 1..84: mol_type = genomic DNA

SEQ ID NO: 57008 - DNA, 30 bp, Homo sapiens; identical to SEQ ID NO: 36401
  misc_feature 1..30: note = chr17:15849181-15849211
  misc_feature 1..30: note = hyper
  source 1..30: mol_type = genomic DNA

SEQ ID NO: 57009 - DNA, 25 bp, Homo sapiens
  misc_feature 1..25: note = chr17:16310306-16310331
  misc_feature 1..25: note = hyper
  source 1..25: mol_type = genomic DNA
cgtcccaaggcgcctggctcaccgc

SEQ ID NO: 57010 - DNA, 393 bp, Homo sapiens; identical to SEQ ID NO: 36403
  misc_feature 1..393: note = chr17:16472011-16472404
  misc_feature 1..393: note = hyper
  source 1..393: mol_type = genomic DNA

SEQ ID NO: 57011 - DNA, 149 bp, Homo sapiens; identical to SEQ ID NO: 36404
  misc_feature 1..149: note = chr17:16472622-16472771
  misc_feature 1..149: note = hyper
  source 1..149: mol_type = genomic DNA

SEQ ID NO: 57012 - DNA, 39 bp, Homo sapiens; identical to SEQ ID NO: 36405
  misc_feature 1..39: note = chr17:16492416-16492455
  misc_feature 1..39: note = hyper
  source 1..39: mol_type = genomic DNA

SEQ ID NO: 57013 - DNA, 64 bp, Homo sapiens; identical to SEQ ID NO: 36406
  misc_feature 1..64: note = chr17:16570208-16570272
  misc_feature 1..64: note = hyper
  source 1..64: mol_type = genomic DNA

SEQ ID NO: 57014 - DNA, 45 bp, Homo sapiens
  misc_feature 1..45: note = chr17:16570654-16570699
  misc_feature 1..45: note = hyper
  source 1..45: mol_type = genomic DNA
ctgaggagctgaggggctgaggcggctgaggggctgaggctggtg

SEQ ID NO: 57015 - DNA, 145 bp, Homo sapiens
  misc_feature 1..145: note = chr17:16570794-16570939
  misc_feature 1..145: note = hyper
  source 1..145: mol_type = genomic DNA
ggggctgaaaggctgaagggcgggcagcgtgccgggtccctgcggctgggtccaccgcacgtcacgtggcagaatcccggggctgctttctctccggctgctcagccacttgttttctcactgtgaacctcgtgggctcctgctc

SEQ ID NO: 57016 - DNA, 30 bp, Homo sapiens; identical to SEQ ID NO: 36408
  misc_feature 1..30: note = chr17:17204181-17204211
  misc_feature 1..30: note = hyper
  source 1..30: mol_type = genomic DNA

SEQ ID NO: 57017 - DNA, 63 bp, Homo sapiens; identical to SEQ ID NO: 36409
  misc_feature 1..63: note = chr17:17398606-17398669
  misc_feature 1..63: note = hyper
  source 1..63: mol_type = genomic DNA

SEQ ID NO: 57018 - DNA, 74 bp, Homo sapiens; identical to SEQ ID NO: 12631
  misc_feature 1..74: note = chr17:17398902-17398976
  misc_feature 1..74: note = hyper
  source 1..74: mol_type = genomic DNA

SEQ ID NO: 57019 - DNA, 30 bp, Homo sapiens; identical to SEQ ID NO: 36411
  misc_feature 1..30: note = chr17:18314944-18314974
  misc_feature 1..30: note = hyper
  source 1..30: mol_type = genomic DNA

SEQ ID NO: 57020 - DNA, 10 bp, Homo sapiens
  misc_feature 1..10: note = chr17:18538275-18538285
  misc_feature 1..10: note = hyper
  source 1..10: mol_type = genomic DNA
cctcctaccc

SEQ ID NO: 57021 - DNA, 618 bp, Homo sapiens; identical to SEQ ID NO: 36413
  misc_feature 1..618: note = chr17:19436820-19437438
  misc_feature 1..618: note = hyper
  source 1..618: mol_type = genomic DNA

SEQ ID NO: 57022 - DNA, 222 bp, Homo sapiens; identical to SEQ ID NO: 36414
  misc_feature 1..222: note = chr17:19483136-19483358
  misc_feature 1..222: note = hyper
  source 1..222: mol_type = genomic DNA

SEQ ID NO: 57023 - DNA, 34 bp, Homo sapiens; identical to SEQ ID NO: 36415
  misc_feature 1..34: note = chr17:20747407-20747441
  misc_feature 1..34: note = hyper
  source 1..34: mol_type = genomic DNA

SEQ ID NO: 57024 - DNA, 121 bp, Homo sapiens; identical to SEQ ID NO: 36416
  misc_feature 1..121: note = chr17:20755828-20755949
  misc_feature 1..121: note = hyper
  source 1..121: mol_type = genomic DNA

SEQ ID NO: 57025 - DNA, 43 bp, Homo sapiens; identical to SEQ ID NO: 36417
  misc_feature 1..43: note = chr17:20755950-20755993
  misc_feature 1..43: note = hyper
  source 1..43: mol_type = genomic DNA

SEQ ID NO: 57026 - DNA, 166 bp, Homo sapiens; identical to SEQ ID NO: 36418
  misc_feature 1..166: note = chr17:26120495-26120661
  misc_feature 1..166: note = hyper
  source 1..166: mol_type = genomic DNA

SEQ ID NO: 57027 - DNA, 78 bp, Homo sapiens; identical to SEQ ID NO: 22437
  misc_feature 1..78: note = chr17:26554556-26554634
  misc_feature 1..78: note = hyper
  source 1..78: mol_type = genomic DNA

SEQ ID NO: 57028 - DNA, 48 bp, Homo sapiens; identical to SEQ ID NO: 22438
  misc_feature 1..48: note = chr17:26554705-26554753
  misc_feature 1..48: note = hyper
  source 1..48: mol_type = genomic DNA

SEQ ID NO: 57029 - DNA, 178 bp, Homo sapiens; identical to SEQ ID NO: 12638
  misc_feature 1..178: note = chr17:26554791-26554969
  misc_feature 1..178: note = hyper
  source 1..178: mol_type = genomic DNA

SEQ ID NO: 57030 - DNA, 335 bp, Homo sapiens; identical to SEQ ID NO: 36421
  misc_feature 1..335: note = chr17:26578290-26578625
  misc_feature 1..335: note = hyper
  source 1..335: mol_type = genomic DNA

SEQ ID NO: 57031 - DNA, 202 bp, Homo sapiens; identical to SEQ ID NO: 36422
  misc_feature 1..202: note = chr17:27038906-27039108
  misc_feature 1..202: note = hyper
  source 1..202: mol_type = genomic DNA

SEQ ID NO: 57032 - skipped

SEQ ID NO: 57033 - DNA, 37 bp, Homo sapiens
  misc_feature 1..37: note = chr17:27332416-27332453
  misc_feature 1..37: note = hyper
  source 1..37: mol_type = genomic DNA
ggggaagcgggaccacgggccgccagctggaccgtcc

SEQ ID NO: 57034 - DNA, 50 bp, Homo sapiens
  misc_feature 1..50: note = chr17:27332660-27332710
  misc_feature 1..50: note = hyper
  source 1..50: mol_type = genomic DNA
cgcgaagcccgcgccccgcccggcttggccggcgccgggggcagcgcagc

SEQ ID NO: 57035 - DNA, 30 bp, Homo sapiens; identical to SEQ ID NO: 36425
  misc_feature 1..30: note = chr17:27466437-27466467
  misc_feature 1..30: note = hyper
  source 1..30: mol_type = genomic DNA

SEQ ID NO: 57036 - DNA, 113 bp, Homo sapiens; identical to SEQ ID NO: 36426
  misc_feature 1..113: note = chr17:27940225-27940338
  misc_feature 1..113: note = hyper
  source 1..113: mol_type = genomic DNA

SEQ ID NO: 57037 - DNA, 671 bp, Homo sapiens; identical to SEQ ID NO: 36428
  misc_feature 1..671: note = chr17:27949457-27950128
  misc_feature 1..671: note = hyper
  source 1..671: mol_type = genomic DNA

SEQ ID NO: 57038 - DNA, 36 bp, Homo sapiens; identical to SEQ ID NO: 36429
  misc_feature 1..36: note = chr17:28088606-28088642
  misc_feature 1..36: note = hyper
  source 1..36: mol_type = genomic DNA

SEQ ID NO: 57039 - DNA, 251 bp, Homo sapiens
  misc_feature 1..251: note = chr17:28562765-28563016
  misc_feature 1..251: note = hyper
  source 1..251: mol_type = genomic DNA
tctgatctctagatagccgccgccaaagagctcttgaagaatttttgcgtcactttgaggcgaataaacttaatgcttccccgcggccgcggctccgcgctcccgctggatggggttgcgctcgccagggaggggccgcgctacggggcggggtgcgcgcccgaccccagagccaggaggggagggacccccgacacacacacacgctcgcagggaggagcggagcgcggagcagccggcagggcagggcc

SEQ ID NO: 57040 - DNA, 61 bp, Homo sapiens; identical to SEQ ID NO: 36431
  misc_feature 1..61: note = chr17:28563999-28564060
  misc_feature 1..61: note = hyper
  source 1..61: mol_type = genomic DNA

SEQ ID NO: 57041 - DNA, 175 bp, Homo sapiens; identical to SEQ ID NO: 36432
  misc_feature 1..175: note = chr17:28705281-28705456
  misc_feature 1..175: note = hyper
  source 1..175: mol_type = genomic DNA

SEQ ID NO: 57042 - DNA, 127 bp, Homo sapiens; identical to SEQ ID NO: 36433
  misc_feature 1..127: note = chr17:29020895-29021022
  misc_feature 1..127: note = hyper
  source 1..127: mol_type = genomic DNA

SEQ ID NO: 57043 - DNA, 260 bp, Homo sapiens
  misc_feature 1..260: note = chr17:29249457-29249717
  misc_feature 1..260: note = hyper
  source 1..260: mol_type = genomic DNA
cgcccgagtccgggctctcgatgtctgcgcacccaggcgcgccccacgccctcggactcagacatcccagccagggctaaacgtcgggcccaggccgccgacagtcctgtgccccctgcccgctcccagacgccccccgaaggcctccccagcgccccacctcggggacgccgagggccccctaactcagcctccccacctgcagctccgcgccgagccccgcggtgcgccccccgcgccctcctctcggttccttctga

SEQ ID NO: 57044 - skipped

SEQ ID NO: 57045 - DNA, 30 bp, Homo sapiens; identical to SEQ ID NO: 36435
  misc_feature 1..30: note = chr17:29335681-29335711
  misc_feature 1..30: note = hyper
  source 1..30: mol_type = genomic DNA

SEQ ID NO: 57046 - DNA, 73 bp, Homo sapiens; identical to SEQ ID NO: 22447
  misc_feature 1..73: note = chr17:29718142-29718215
  misc_feature 1..73: note = hyper
  source 1..73: mol_type = genomic DNA

SEQ ID NO: 57047 - DNA, 271 bp, Homo sapiens
  misc_feature 1..271: note = chr17:29718269-29718540
  misc_feature 1..271: note = hyper
  source 1..271: mol_type = genomic DNA
cccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtc

SEQ ID NO: 57048 - DNA, 409 bp, Homo sapiens
  misc_feature 1..409: note = chr17:29718778-29719187
  misc_feature 1..409: note = hyper
  source 1..409: mol_type = genomic DNA
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccggg

SEQ ID NO: 57049 - DNA, 243 bp, Homo sapiens; identical to SEQ ID NO: 36438
  misc_feature 1..243: note = chr17:29886485-29886728
  misc_feature 1..243: note = hyper
  source 1..243: mol_type = genomic DNA

SEQ ID NO: 57050 - DNA, 76 bp, Homo sapiens; identical to SEQ ID NO: 36439
  misc_feature 1..76: note = chr17:30846530-30846606
  misc_feature 1..76: note = hyper
  source 1..76: mol_type = genomic DNA

SEQ ID NO: 57051 - DNA, 118 bp, Homo sapiens; identical to SEQ ID NO: 1281
  misc_feature 1..118: note = chr17:31618291-31618409
  misc_feature 1..118: note = hyper
  source 1..118: mol_type = genomic DNA

SEQ ID NO: 57052 - DNA, 15 bp, Homo sapiens
  misc_feature 1..15: note = chr17:31618410-31618425
  misc_feature 1..15: note = hyper
  source 1..15: mol_type = genomic DNA
cggagggcaactcac

SEQ ID NO: 57053 - DNA, 78 bp, Homo sapiens
  misc_feature 1..78: note = chr17:31619319-31619397
  misc_feature 1..78: note = hyper
  source 1..78: mol_type = genomic DNA
gggcgcccgcccggggctgagcgccgcctcagcccgcagcccctggcagtggcctctcccgagcgcctcccaggcttt

SEQ ID NO: 57054 - DNA, 264 bp, Homo sapiens; identical to SEQ ID NO: 22454
  misc_feature 1..264: note = chr17:31619687-31619951
  misc_feature 1..264: note = hyper
  source 1..264: mol_type = genomic DNA

SEQ ID NO: 57055 - DNA, 421 bp, Homo sapiens
  misc_feature 1..421: note = chr17:31620026-31620447
  misc_feature 1..421: note = hyper
  source 1..421: mol_type = genomic DNA
ccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 57056 - DNA, 28 bp, Homo sapiens
  misc_feature 1..28: note = chr17:32483992-32484020
  misc_feature 1..28: note = hyper
  source 1..28: mol_type = genomic DNA
tgggggatgtcagggcggccacgctgat

SEQ ID NO: 57057 - DNA, 70 bp, Homo sapiens
  misc_feature 1..70: note = chr17:32484049-32484119
  misc_feature 1..70: note = hyper
  source 1..70: mol_type = genomic DNA
ttcagagccgccgccgctcggttccttttcccatgatgttttggactccgaatgccgtttctcgccgccg

SEQ ID NO: 57058 - DNA, 57 bp, Homo sapiens; identical to SEQ ID NO: 12653
  misc_feature 1..57: note = chr17:32906021-32906078
  misc_feature 1..57: note = hyper
  source 1..57: mol_type = genomic DNA

SEQ ID NO: 57059 - DNA, 67 bp, Homo sapiens
  misc_feature 1..67: note = chr17:32906312-32906379
  misc_feature 1..67: note = hyper
  source 1..67: mol_type = genomic DNA
gcggaatcgcgaggtcggcccttggcccgagtctcattaaggagccgcgcgcgccgccaggctagga

SEQ ID NO: 57060 - DNA, 178 bp, Homo sapiens
  misc_feature 1..178: note = chr17:32906636-32906814
  misc_feature 1..178: note = hyper
  source 1..178: mol_type = genomic DNA
ggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgc

SEQ ID NO: 57061 - DNA, 153 bp, Homo sapiens; identical to SEQ ID NO: 12654
  misc_feature 1..153: note = chr17:32907265-32907418
  misc_feature 1..153: note = hyper
  source 1..153: mol_type = genomic DNA

SEQ ID NO: 57062 - DNA, 32 bp, Homo sapiens; identical to SEQ ID NO: 22458
  misc_feature 1..32: note = chr17:32907620-32907652
  misc_feature 1..32: note = hyper
  source 1..32: mol_type = genomic DNA

SEQ ID NO: 57063 - DNA, 52 bp, Homo sapiens; identical to SEQ ID NO: 22459
  misc_feature 1..52: note = chr17:32907753-32907805
  misc_feature 1..52: note = hyper
  source 1..52: mol_type = genomic DNA

SEQ ID NO: 57064 - DNA, 259 bp, Homo sapiens; identical to SEQ ID NO: 22460
  misc_feature 1..259: note = chr17:32907873-32908132
  misc_feature 1..259: note = hyper
  source 1..259: mol_type = genomic DNA

SEQ ID NO: 57065 - DNA, 273 bp, Homo sapiens
  misc_feature 1..273: note = chr17:32908374-32908647
  misc_feature 1..273: note = hyper
  source 1..273: mol_type = genomic DNA
gggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagg

SEQ ID NO: 57066 - DNA, 32 bp, Homo sapiens; identical to SEQ ID NO: 36452
  misc_feature 1..32: note = chr17:33672862-33672894
  misc_feature 1..32: note = hyper
  source 1..32: mol_type = genomic DNA

SEQ ID NO: 57067 - DNA, 164 bp, Homo sapiens; identical to SEQ ID NO: 36453
  misc_feature 1..164: note = chr17:33673326-33673490
  misc_feature 1..164: note = hyper
  source 1..164: mol_type = genomic DNA

SEQ ID NO: 57068 - DNA, 301 bp, Homo sapiens; identical to SEQ ID NO: 12660
  misc_feature 1..301: note = chr17:33700472-33700773
  misc_feature 1..301: note = hyper
  source 1..301: mol_type = genomic DNA

SEQ ID NO: 57069 - DNA, 402 bp, Homo sapiens; identical to SEQ ID NO: 12661
  misc_feature 1..402: note = chr17:33700974-33701376
  misc_feature 1..402: note = hyper
  source 1..402: mol_type = genomic DNA

SEQ ID NO: 57070 - DNA, 117 bp, Homo sapiens; identical to SEQ ID NO: 36456
  misc_feature 1..117: note = chr17:33775327-33775444
  misc_feature 1..117: note = hyper
  source 1..117: mol_type = genomic DNA

SEQ ID NO: 57071 - DNA, 399 bp, Homo sapiens; identical to SEQ ID NO: 36457
  misc_feature 1..399: note = chr17:35014243-35014642
  misc_feature 1..399: note = hyper
  source 1..399: mol_type = genomic DNA

SEQ ID NO: 57072 - DNA, 362 bp, Homo sapiens; identical to SEQ ID NO: 36458
  misc_feature 1..362: note = chr17:35060253-35060615
  misc_feature 1..362: note = hyper
  source 1..362: mol_type = genomic DNA

SEQ ID NO: 57073 - DNA, 372 bp, Homo sapiens; identical to SEQ ID NO: 36459
  misc_feature 1..372: note = chr17:35078532-35078904
  misc_feature 1..372: note = hyper
  source 1..372: mol_type = genomic DNA

SEQ ID NO: 57074 - DNA, 30 bp, Homo sapiens; identical to SEQ ID NO: 36460
  misc_feature 1..30: note = chr17:35165346-35165376
  misc_feature 1..30: note = hyper
  source 1..30: mol_type = genomic DNA

SEQ ID NO: 57075 - DNA, 52 bp, Homo sapiens; identical to SEQ ID NO: 22467
  misc_feature 1..52: note = chr17:35165593-35165645
  misc_feature 1..52: note = hyper
  source 1..52: mol_type = genomic DNA

SEQ ID NO: 57076 - DNA, 153 bp, Homo sapiens
  misc_feature 1..153: note = chr17:35165691-35165844
  misc_feature 1..153: note = hyper
  source 1..153: mol_type = genomic DNA
gccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggc

SEQ ID NO: 57077 - DNA, 141 bp, Homo sapiens
  misc_feature 1..141: note = chr17:35165845-35165986
  misc_feature 1..141: note = hyper
  source 1..141: mol_type = genomic DNA
cggggctccaggacccgtctgctcctggtgcccccagctcctcagggtccggccgggtcacctgggccgatccaggcgggcaggggcctcgctgctcctcccccgcagcccctctcgccctcccggggaccgtgtgcgggg

SEQ ID NO: 57078 - DNA, 17 bp, Homo sapiens
  misc_feature 1..17: note = chr17:35166016-35166033
  misc_feature 1..17: note = hyper
  source 1..17: mol_type = genomic DNA
tccgactggggaacttg

SEQ ID NO: 57079 - DNA, 30 bp, Homo sapiens; identical to SEQ ID NO: 36463
  misc_feature 1..30: note = chr17:35242096-35242126
  misc_feature 1..30: note = hyper
  source 1..30: mol_type = genomic DNA

SEQ ID NO: 57080 - DNA, 105 bp, Homo sapiens; identical to SEQ ID NO: 22469
  misc_feature 1..105: note = chr17:35285437-35285542
  misc_feature 1..105: note = hyper
  source 1..105: mol_type = genomic DNA

SEQ ID NO: 57081 - DNA, 129 bp, Homo sapiens; identical to SEQ ID NO: 22470
  misc_feature 1..129: note = chr17:35285666-35285795
  misc_feature 1..129: note = hyper
  source 1..129: mol_type = genomic DNA

SEQ ID NO: 57082 - DNA, 290 bp, Homo sapiens; identical to SEQ ID NO: 36465
  misc_feature 1..290: note = chr17:35289328-35289618
  misc_feature 1..290: note = hyper
  source 1..290: mol_type = genomic DNA

SEQ ID NO: 57083 - DNA, 283 bp, Homo sapiens
  misc_feature 1..283: note = chr17:35290655-35290938
  misc_feature 1..283: note = hyper
  source 1..283: mol_type = genomic DNA
ctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagg

SEQ ID NO: 57084 - DNA, 289 bp, Homo sapiens
  misc_feature 1..289: note = chr17:35291540-35291829
  misc_feature 1..289: note = hyper
  source 1..289: mol_type = genomic DNA
atctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaa

SEQ ID NO: 57085 - DNA, 29 bp, Homo sapiens
  misc_feature 1..29: note = chr17:35292626-35292655
  misc_feature 1..29: note = hyper
  source 1..29: mol_type = genomic DNA
gcccaggttcactgcgactccgcttcccc

SEQ ID NO: 57086 - DNA, 35 bp, Homo sapiens; identical to SEQ ID NO: 36469
  misc_feature 1..35: note = chr17:35292896-35292931
  misc_feature 1..35: note = hyper
  source 1..35: mol_type = genomic DNA

SEQ ID NO: 57087 - DNA, 307 bp, Homo sapiens; identical to SEQ ID NO: 22472
  misc_feature 1..307: note = chr17:35294154-35294461
  misc_feature 1..307: note = hyper
  source 1..307: mol_type = genomic DNA

SEQ ID NO: 57088 - DNA, 542 bp, Homo sapiens; identical to SEQ ID NO: 22473
  misc_feature 1..542: note = chr17:35294505-35295047
  misc_feature 1..542: note = hyper
  source 1..542: mol_type = genomic DNA

SEQ ID NO: 57089 - DNA, 465 bp, Homo sapiens; identical to SEQ ID NO: 22474
  misc_feature 1..465: note = chr17:35295160-35295625
  misc_feature 1..465: note = hyper
  source 1..465: mol_type = genomic DNA

SEQ ID NO: 57090 - DNA, 127 bp, Homo sapiens
  misc_feature 1..127: note = chr17:35296016-35296143
  misc_feature 1..127: note = hyper
  source 1..127: mol_type = genomic DNA
cattctccaggccttcggggttgtttgccctccaggcagagcccaggctccctcccggccactaccttttccgaccccgagcggtcttggcggtaagctccgagccttttgcgtagagtgtctgggc

SEQ ID NO: 57091 - DNA, 436 bp, Homo sapiens
  misc_feature 1..436: note = chr17:35296292-35296728
  misc_feature 1..436: note = hyper
  source 1..436: mol_type = genomic DNA
cttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccag

SEQ ID NO: 57092 - DNA, 258 bp, Homo sapiens; identical to SEQ ID NO: 22478
  misc_feature 1..258: note = chr17:35296888-35297146
  misc_feature 1..258: note = hyper
  source 1..258: mol_type = genomic DNA

SEQ ID NO: 57093 - DNA, 460 bp, Homo sapiens; identical to SEQ ID NO: 36474
  misc_feature 1..460: note = chr17:35297147-35297607
  misc_feature 1..460: note = hyper
  source 1..460: mol_type = genomic DNA

SEQ ID NO: 57094 - DNA, 58 bp, Homo sapiens
  misc_feature 1..58: note = chr17:35298153-35298211
  misc_feature 1..58: note = hyper
  source 1..58: mol_type = genomic DNA
ggagaccggcctcaacatgcgcgtcattcaggtcaggccccggcgcgcctctccatcc

SEQ ID NO: 57095 - DNA, 66 bp, Homo sapiens; identical to SEQ ID NO: 22481
  misc_feature 1..66: note = chr17:35299185-35299251
  misc_feature 1..66: note = hyper
  source 1..66: mol_type = genomic DNA

SEQ ID NO: 57096 - DNA, 30 bp, Homo sapiens; identical to SEQ ID NO: 36480
  misc_feature 1..30: note = chr17:35301109-35301139
  misc_feature 1..30: note = hyper
  source 1..30: mol_type = genomic DNA

SEQ ID NO: 57097 - DNA, 26 bp, Homo sapiens
  misc_feature 1..26: note = chr17:35303314-35303340
  misc_feature 1..26: note = hyper
  source 1..26: mol_type = genomic DNA
cgattcttctaacaacgtggttgtgg

SEQ ID NO: 57098 - DNA, 16 bp, Homo sapiens
  misc_feature 1..16: note = chr17:35303535-35303551
  misc_feature 1..16: note = hyper
  source 1..16: mol_type = genomic DNA
gcggagctcccgcagg

SEQ ID NO: 57099 - DNA, 617 bp, Homo sapiens
  misc_feature 1..617: note = chr17:36102404-36103021
  misc_feature 1..617: note = hyper
  source 1..617: mol_type = genomic DNA
tttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaata

SEQ ID NO: 57100 - DNA, 31 bp, Homo sapiens; identical to SEQ ID NO: 22485
  misc_feature 1..31: note = chr17:36103540-36103571
  misc_feature 1..31: note = hyper
  source 1..31: mol_type = genomic DNA

SEQ ID NO: 57101 - DNA, 434 bp, Homo sapiens
  misc_feature 1..434: note = chr17:36103601-36104035
  misc_feature 1..434: note = hyper
  source 1..434: mol_type = genomic DNA
cctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgc

SEQ ID NO: 57102 - DNA, 444 bp, Homo sapiens
  misc_feature 1..444: note = chr17:36104779-36105223
  misc_feature 1..444: note = hyper
  source 1..444: mol_type = genomic DNA
ctcctccaaggcctgaaccagcacctccttggtgaccccggagctcagcagggcgctcaggagttcttgctggagcgacgtgagcttggacaccattttccaaggacggaaaaagaagggggtgagggggtgggtgggtgcgagagaggagggtggaggggagtttcacaagcaaaccccaaatccaggaacccctccacccttcagcctccagacacctgttactccccggggtcccggaggctcctccgaaaggagtcagaaaacttctaacttgccatgatcgccaccattaggccatataagatatgcaaattagtgggaagggcccagctttcggctggatgcaaatgatggtggggagggggaaacccggagagagggagagccggaggggcagacctggagagcagaagacctgggccgggagcggggctttgccag

SEQ ID NO: 57103 - DNA, 132 bp, Homo sapiens
  misc_feature 1..132: note = chr17:36105596-36105728
  misc_feature 1..132: note = hyper
  source 1..132: mol_type = genomic DNA
gcatgccctggagggactccatttatttctacctcggttactacctccaggccccagaacctccctggcctggtctggcggtttgggtttgcagaactgcccgccagagagcgtaggcgagggtgaaggagt

SEQ ID NO: 57104 - DNA, 75 bp, Homo sapiens; identical to SEQ ID NO: 36488
  misc_feature 1..75: note = chr17:36715017-36715092
  misc_feature 1..75: note = hyper
  source 1..75: mol_type = genomic DNA

SEQ ID NO: 57105 - DNA, 136 bp, Homo sapiens; identical to SEQ ID NO: 36489
  misc_feature 1..136: note = chr17:36729051-36729187
  misc_feature 1..136: note = hyper
  source 1..136: mol_type = genomic DNA

SEQ ID NO: 57106 - DNA, 46 bp, Homo sapiens; identical to SEQ ID NO: 36490
  misc_feature 1..46: note = chr17:36829977-36830023
  misc_feature 1..46: note = hyper
  source 1..46: mol_type = genomic DNA

SEQ ID NO: 57107 - DNA, 40 bp, Homo sapiens; identical to SEQ ID NO: 36491
  misc_feature 1..40: note = chr17:36905467-36905507
  misc_feature 1..40: note = hyper
  source 1..40: mol_type = genomic DNA

SEQ ID NO: 57108 - DNA, 297 bp, Homo sapiens
  misc_feature 1..297: note = chr17:37366040-37366337
  misc_feature 1..297: note = hyper
  source 1..297: mol_type = genomic DNA
cccccactctgcatccgggcagcgccagcagtgccccagcacccccgcagcccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggctt

SEQ ID NO: 57109 - skipped

SEQ ID NO: 57110 - DNA, 296 bp, Homo sapiens
  misc_feature 1..296: note = chr17:37381850-37382146
  misc_feature 1..296: note = hyper
  source 1..296: mol_type = genomic DNA
gttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggc

SEQ ID NO: 57111 - DNA, 52 bp, Homo sapiens; identical to SEQ ID NO: 36498
  misc_feature 1..52: note = chr17:37388387-37388439
  misc_feature 1..52: note = hyper
  source 1..52: mol_type = genomic DNA

SEQ ID NO: 57112 - DNA, 131 bp, Homo sapiens; identical to SEQ ID NO: 36499
  misc_feature 1..131: note = chr17:37752808-37752939
  misc_feature 1..131: note = hyper
  source 1..131: mol_type = genomic DNA

SEQ ID NO: 57113 - DNA, 361 bp, Homo sapiens; identical to SEQ ID NO: 36500
  misc_feature 1..361: note = chr17:37753021-37753382
  misc_feature 1..361: note = hyper
  source 1..361: mol_type = genomic DNA

SEQ ID NO: 57114 - DNA, 144 bp, Homo sapiens; identical to SEQ ID NO: 36501
  misc_feature 1..144: note = chr17:37755368-37755512
  misc_feature 1..144: note = hyper
  source 1..144: mol_type = genomic DNA

SEQ ID NO: 57115 - DNA, 117 bp, Homo sapiens; identical to SEQ ID NO: 36502
  misc_feature 1..117: note = chr17:37756218-37756335
  misc_feature 1..117: note = hyper
  source 1..117: mol_type = genomic DNA

SEQ ID NO: 57116 - DNA, 30 bp, Homo sapiens; identical to SEQ ID NO: 36503
  misc_feature 1..30: note = chr17:37760128-37760158
  misc_feature 1..30: note = hyper
  source 1..30: mol_type = genomic DNA

SEQ ID NO: 57117 - DNA, 121 bp, Homo sapiens
  misc_feature 1..121: note = chr17:37760367-37760488
  misc_feature 1..121: note = hyper
  source 1..121: mol_type = genomic DNA
ccaggtggcacccaccgaggcacagtccgggcaggggtggggctgcccccaggtctccatccccacccctcaccccaggaggggacagaatggccgcggggaggaggagccggcgagctca

SEQ ID NO: 57118 - DNA, 98 bp, Homo sapiens
  misc_feature 1..98: note = chr17:37760561-37760659
  misc_feature 1..98: note = hyper
  source 1..98: mol_type = genomic DNA
caaaccctccctccccaaaccgaccccccaacagtttgccattccatacaaatttggaaacaggtttttaaaaaacagcatgacgcacaacggggacg

SEQ ID NO: 57119 - DNA, 762 bp, Homo sapiens
  misc_feature 1..762: note = chr17:37761235-37761997
  misc_feature 1..762: note = hyper
  source 1..762: mol_type = genomic DNA
tcaagaaagagggagcgcctggctcctttttgcctcggcagctgggtgtctgtttttaaaataataatgagagggggaaacgcgttccattgctcagctgcccccttaccaacgccttgggcctgcagggaggagggggaggaggaaacctcagcgaagatattgggaatgggggaggggtgcctccagggagcccccggagagaggtccctggagaagcactccttgggagagaggaggagggaaccccttggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgc

SEQ ID NO: 57120 - DNA, 446 bp, Homo sapiens; identical to SEQ ID NO: 22498
  misc_feature 1..446: note = chr17:37762334-37762780
  misc_feature 1..446: note = hyper
  source 1..446: mol_type = genomic DNA

SEQ ID NO: 57121 - DNA, 45 bp, Homo sapiens; identical to SEQ ID NO: 36506
  misc_feature 1..45: note = chr17:37763928-37763973
  misc_feature 1..45: note = hyper
  source 1..45: mol_type = genomic DNA

SEQ ID NO: 57122 - DNA, 186 bp, Homo sapiens; identical to SEQ ID NO: 36507
  misc_feature 1..186: note = chr17:37783470-37783656
  misc_feature 1..186: note = hyper
  source 1..186: mol_type = genomic DNA

SEQ ID NO: 57123 - DNA, 30 bp, Homo sapiens; identical to SEQ ID NO: 36508
  misc_feature 1..30: note = chr17:37794096-37794126
  misc_feature 1..30: note = hyper
  source 1..30: mol_type = genomic DNA

SEQ ID NO: 57124 - DNA, 269 bp, Homo sapiens; identical to SEQ ID NO: 36509
  misc_feature 1..269: note = chr17:37856457-37856726
  misc_feature 1..269: note = hyper
  source 1..269: mol_type = genomic DNA

SEQ ID NO: 57125 - DNA, 94 bp, Homo sapiens; identical to SEQ ID NO: 36510
  misc_feature 1..94: note = chr17:37857113-37857207
  misc_feature 1..94: note = hyper
  source 1..94: mol_type = genomic DNA

SEQ ID NO: 57126 - DNA, 306 bp, Homo sapiens; identical to SEQ ID NO: 36511
  misc_feature 1..306: note = chr17:38264389-38264695
  misc_feature 1..306: note = hyper
  source 1..306: mol_type = genomic DNA

SEQ ID NO: 57127 - DNA, 86 bp, Homo sapiens
  misc_feature 1..86: note = chr17:38347474-38347560
  misc_feature 1..86: note = hyper
  source 1..86: mol_type = genomic DNA
cctttcgctcctcatcgccttgcactgccatcttcccacccactcccctcaccccctggcgccctggccgcccctccgctgccgtg

SEQ ID NO: 57128 - DNA, 25 bp, Homo sapiens
  misc_feature 1..25: note = chr17:38347753-38347778
  misc_feature 1..25: note = hyper
  source 1..25: mol_type = genomic DNA
cggccgtcggcgggatggggggccg

SEQ ID NO: 57129 - DNA, 114 bp, Homo sapiens; identical to SEQ ID NO: 36514
  misc_feature 1..114: note = chr17:38478719-38478833
  misc_feature 1..114: note = hyper
  source 1..114: mol_type = genomic DNA

SEQ ID NO: 57130 - DNA, 30 bp, Homo sapiens; identical to SEQ ID NO: 36515
  misc_feature 1..30: note = chr17:39683809-39683839
  misc_feature 1..30: note = hyper
  source 1..30: mol_type = genomic DNA

SEQ ID NO: 57131 - DNA, 104 bp, Homo sapiens
  misc_feature 1..104: note = chr17:40332839-40332943
  misc_feature 1..104: note = hyper
  source 1..104: mol_type = genomic DNA
acttgccccccagctcgaacctcaagccccgacctccgtcccactcacgcgttccgtcaaaacgggtggcgatggtgtccaggaaggtgttttgcggggccagc

SEQ ID NO: 57132 - DNA, 30 bp, Homo sapiens; identical to SEQ ID NO: 36517
  misc_feature 1..30: note = chr17:40400826-40400856
  misc_feature 1..30: note = hyper
  source 1..30: mol_type = genomic DNA

SEQ ID NO: 57133 - DNA, 88 bp, Homo sapiens; identical to SEQ ID NO: 22502
  misc_feature 1..88: note = chr17:40464190-40464278
  misc_feature 1..88: note = hyper
  source 1..88: mol_type = genomic DNA

SEQ ID NO: 57134 - DNA, 70 bp, Homo sapiens
  misc_feature 1..70: note = chr17:40464317-40464387
  misc_feature 1..70: note = hyper
  source 1..70: mol_type = genomic DNA
cgccaagatgcttctcaaccctcggggccaggggcagtcccagagccgcaacaaccgtcccatcctcctc

SEQ ID NO: 57135 - DNA, 36 bp, Homo sapiens; identical to SEQ ID NO: 36519
  misc_feature 1..36: note = chr17:40573790-40573826
  misc_feature 1..36: note = hyper
  source 1..36: mol_type = genomic DNA

SEQ ID NO: 57136 - DNA, 30 bp, Homo sapiens; identical to SEQ ID NO: 36520
  misc_feature 1..30: note = chr17:40669662-40669692
  misc_feature 1..30: note = hyper
  source 1..30: mol_type = genomic DNA

SEQ ID NO: 57137 - DNA, 106 bp, Homo sapiens; identical to SEQ ID NO: 36521
  misc_feature 1..106: note = chr17:40912947-40913053
  misc_feature 1..106: note = hyper
  source 1..106: mol_type = genomic DNA

SEQ ID NO: 57138 - DNA, 261 bp, Homo sapiens; identical to SEQ ID NO: 36522
  misc_feature 1..261: note = chr17:40932562-40932823
  misc_feature 1..261: note = hyper
  source 1..261: mol_type = genomic DNA

SEQ ID NO: 57139 - DNA, 59 bp, Homo sapiens; identical to SEQ ID NO: 12713
  misc_feature 1..59: note = chr17:40932843-40932902
  misc_feature 1..59: note = hyper
  source 1..59: mol_type = genomic DNA

SEQ ID NO: 57140 - DNA, 30 bp, Homo sapiens; identical to SEQ ID NO: 36524
  misc_feature 1..30: note = chr17:40933234-40933264
  misc_feature 1..30: note = hyper
  source 1..30: mol_type = genomic DNA

SEQ ID NO: 57141 - DNA, 80 bp, Homo sapiens; identical to SEQ ID NO: 36525
  misc_feature 1..80: note = chr17:41723454-41723534
  misc_feature 1..80: note = hyper
  source 1..80: mol_type = genomic DNA

SEQ ID NO: 57142 - DNA, 56 bp, Homo sapiens; identical to SEQ ID NO: 36526
  misc_feature 1..56: note = chr17:41723778-41723834
  misc_feature 1..56: note = hyper
  source 1..56: mol_type = genomic DNA

SEQ ID NO: 57143 - DNA, 32 bp, Homo sapiens; identical to SEQ ID NO: 36527
  misc_feature 1..32: note = chr17:41832619-41832651
  misc_feature 1..32: note = hyper
  source 1..32: mol_type = genomic DNA

SEQ ID NO: 57144 - DNA, 217 bp, Homo sapiens; identical to SEQ ID NO: 36528
  misc_feature 1..217: note = chr17:41983831-41984048
  misc_feature 1..217: note = hyper
  source 1..217: mol_type = genomic DNA

SEQ ID NO: 57145 - DNA, 81 bp, Homo sapiens; identical to SEQ ID NO: 36529
  misc_feature 1..81: note = chr17:41984266-41984347
  misc_feature 1..81: note = hyper
  source 1..81: mol_type = genomic DNA

SEQ ID NO: 57146 - DNA, 209 bp, Homo sapiens; identical to SEQ ID NO: 36530
  misc_feature 1..209: note = chr17:41984363-41984572
  misc_feature 1..209: note = hyper
  source 1..209: mol_type = genomic DNA

SEQ ID NO: 57147 - DNA, 79 bp, Homo sapiens
  misc_feature 1..79: note = chr17:42061257-42061336
  misc_feature 1..79: note = hyper
  source 1..79: mol_type = genomic DNA
ccgggctgagtgttccgaggcgagcggctgctgtttgcgcagctaagtggcgtctgtgtacccagcggggcgcagcggt

SEQ ID NO: 57148 - DNA, 39 bp, Homo sapiens
  misc_feature 1..39: note = chr17:42061381-42061420
  misc_feature 1..39: note = hyper
  source 1..39: mol_type = genomic DNA
cacggccgcgccgccccatttgcacgccccggccgccgg

SEQ ID NO: 57149 - DNA, 88 bp, Homo sapiens; identical to SEQ ID NO: 36533
  misc_feature 1..88: note = chr17:42082176-42082264
  misc_feature 1..88: note = hyper
  source 1..88: mol_type = genomic DNA

SEQ ID NO: 57150 - DNA, 53 bp, Homo sapiens
  misc_feature 1..53: note = chr17:42082469-42082522
  misc_feature 1..53: note = hyper
  source 1..53: mol_type = genomic DNA
cggcgtgggccgtgacgcagcgaggggatggggttgtgcggccacctgtcctc

SEQ ID NO: 57151 - DNA, 138 bp, Homo sapiens; identical to SEQ ID NO: 36535
  misc_feature 1..138: note = chr17:42082805-42082943
  misc_feature 1..138: note = hyper
  source 1..138: mol_type = genomic DNA

SEQ ID NO: 57152 - DNA, 160 bp, Homo sapiens; identical to SEQ ID NO: 36536
  misc_feature 1..160: note = chr17:42083143-42083303
  misc_feature 1..160: note = hyper
  source 1..160: mol_type = genomic DNA

SEQ ID NO: 57153 - DNA, 98 bp, Homo sapiens; identical to SEQ ID NO: 36537
  misc_feature 1..98: note = chr17:42083525-42083623
  misc_feature 1..98: note = hyper
  source 1..98: mol_type = genomic DNA

SEQ ID NO: 57154 - DNA, 30 bp, Homo sapiens; identical to SEQ ID NO: 36538
  misc_feature 1..30: note = chr17:42091732-42091762
  misc_feature 1..30: note = hyper
  source 1..30: mol_type = genomic DNA

SEQ ID NO: 57155 - DNA, 97 bp, Homo sapiens; identical to SEQ ID NO: 36539
  misc_feature 1..97: note = chr17:42393478-42393575
  misc_feature 1..97: note = hyper
  source 1..97: mol_type = genomic DNA

SEQ ID NO: 57156 - DNA, 82 bp, Homo sapiens; identical to SEQ ID NO: 22513
  misc_feature 1..82: note = chr17:42394024-42394106
  misc_feature 1..82: note = hyper
  source 1..82: mol_type = genomic DNA

SEQ ID NO: 57157 - DNA, 22 bp, Homo sapiens
  misc_feature 1..22: note = chr17:42635273-42635295
  misc_feature 1..22: note = hyper
  source 1..22: mol_type = genomic DNA
tgcaccagttctatccgctggt

SEQ ID NO: 57158 - DNA, 185 bp, Homo sapiens
  misc_feature 1..185: note = chr17:42733526-42733711
  misc_feature 1..185: note = hyper
  source 1..185: mol_type = genomic DNA
cggtgcctgccagtccgggccaatcccgaacacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggagggg

SEQ ID NO: 57159 - DNA, 22 bp, Homo sapiens
  misc_feature 1..22: note = chr17:42733884-42733906
  misc_feature 1..22: note = hyper
  source 1..22: mol_type = genomic DNA
cggggtgcgggctgagggagcc

SEQ ID NO: 57160 - DNA, 66 bp, Homo sapiens; identical to SEQ ID NO: 36543
  misc_feature 1..66: note = chr17:42906582-42906648
  misc_feature 1..66: note = hyper
  source 1..66: mol_type = genomic DNA

SEQ ID NO: 57161 - DNA, 182 bp, Homo sapiens; identical to SEQ ID NO: 36544
  misc_feature 1..182: note = chr17:42907014-42907196
  misc_feature 1..182: note = hyper
  source 1..182: mol_type = genomic DNA

SEQ ID NO: 57162 - DNA, 200 bp, Homo sapiens; identical to SEQ ID NO: 22519
  misc_feature 1..200: note = chr17:42907951-42908151
  misc_feature 1..200: note = hyper
  source 1..200: mol_type = genomic DNA

SEQ ID NO: 57163 - DNA, 80 bp, Homo sapiens; identical to SEQ ID NO: 12729
  misc_feature 1..80: note = chr17:42988684-42988764
  misc_feature 1..80: note = hyper
  source 1..80: mol_type = genomic DNA

SEQ ID NO: 57164 - DNA, 150 bp, Homo sapiens
  misc_feature 1..150: note = chr17:43044508-43044658
  misc_feature 1..150: note = hyper
  source 1..150: mol_type = genomic DNA
ccccaagggcaagtccgtgcacctgggagccctgcgctctgactagttgggttcatttcccgcatttccagtagcgttccagacggtgcccagcagcgtctgtcttggagcgggaacccaggaactgaggatcggcgatgtccgctggct

SEQ ID NO: 57165 - DNA, 119 bp, Homo sapiens
  misc_feature 1..119: note = chr17:43044688-43044807
  misc_feature 1..119: note = hyper
  source 1..119: mol_type = genomic DNA
gggccgctgtggggtgggatctccacctgcgtccgcctggcgcccccgccaactccgatcaggtacccatttgccccgggctccctgggtgccctgggcccagcccagccccatgcccc

SEQ ID NO: 57166 - skipped

SEQ ID NO: 57167 - DNA, 150 bp, Homo sapiens; identical to SEQ ID NO: 22521
  misc_feature 1..150: note = chr17:43045116-43045266
  misc_feature 1..150: note = hyper
  source 1..150: mol_type = genomic DNA

SEQ ID NO: 57168 - DNA, 141 bp, Homo sapiens; identical to SEQ ID NO: 36550
  misc_feature 1..141: note = chr17:43045371-43045512
  misc_feature 1..141: note = hyper
  source 1..141: mol_type = genomic DNA

SEQ ID NO: 57169 - DNA, 233 bp, Homo sapiens; identical to SEQ ID NO: 36551
  misc_feature 1..233: note = chr17:43047752-43047985
  misc_feature 1..233: note = hyper
  source 1..233: mol_type = genomic DNA

SEQ ID NO: 57170 - DNA, 38 bp, Homo sapiens
  misc_feature 1..38: note = chr17:43339899-43339937
  misc_feature 1..38: note = hyper
  source 1..38: mol_type = genomic DNA
catgaccaaggaactcagcaccccgtgtgccccagctc

SEQ ID NO: 57171 - DNA, 25 bp, Homo sapiens
  misc_feature 1..25: note = chr17:43974231-43974256
  misc_feature 1..25: note = hyper
  source 1..25: mol_type = genomic DNA
gtgatgaacctggtacgcacggttt

SEQ ID NO: 57172 - DNA, 42 bp, Homo sapiens
  misc_feature 1..42: note = chr17:43974358-43974400
  misc_feature 1..42: note = hyper
  source 1..42: mol_type = genomic DNA
gaatttctggggaatggcttggctgcccgcccgggaccaggc

SEQ ID NO: 57173 - DNA, 102 bp, Homo sapiens; identical to SEQ ID NO: 36555
  misc_feature 1..102: note = chr17:44919159-44919261
  misc_feature 1..102: note = hyper
  source 1..102: mol_type = genomic DNA

SEQ ID NO: 57174 - DNA, 88 bp, Homo sapiens; identical to SEQ ID NO: 36556
  misc_feature 1..88: note = chr17:44928630-44928718
  misc_feature 1..88: note = hyper
  source 1..88: mol_type = genomic DNA

SEQ ID NO: 57175 - DNA, 101 bp, Homo sapiens; identical to SEQ ID NO: 36557
  misc_feature 1..101: note = chr17:44929256-44929357
  misc_feature 1..101: note = hyper
  source 1..101: mol_type = genomic DNA

SEQ ID NO: 57176 - DNA, 130 bp, Homo sapiens; identical to SEQ ID NO: 36558
  misc_feature 1..130: note = chr17:44929573-44929703
  misc_feature 1..130: note = hyper
  source 1..130: mol_type = genomic DNA

SEQ ID NO: 57177 - DNA, 34 bp, Homo sapiens; identical to SEQ ID NO: 12740
  misc_feature 1..34: note = chr17:45055871-45055905
  misc_feature 1..34: note = hyper
  source 1..34: mol_type = genomic DNA

SEQ ID NO: 57178 - DNA, 117 bp, Homo sapiens; identical to SEQ ID NO: 36560
  misc_feature 1..117: note = chr17:45056144-45056261
  misc_feature 1..117: note = hyper
  source 1..117: mol_type = genomic DNA

SEQ ID NO: 57179 - DNA, 37 bp, Homo sapiens; identical to SEQ ID NO: 36561
  misc_feature 1..37: note = chr17:45056814-45056851
  misc_feature 1..37: note = hyper
  source 1..37: mol_type = genomic DNA

SEQ ID NO: 57180 - DNA, 30 bp, Homo sapiens; identical to SEQ ID NO: 36562
  misc_feature 1..30: note = chr17:45331645-45331675
  misc_feature 1..30: note = hyper
  source 1..30: mol_type = genomic DNA

SEQ ID NO: 57181 - DNA, 304 bp, Homo sapiens
  misc_feature 1..304: note = chr17:45810546-45810850
  misc_feature 1..304: note = hyper
  source 1..304: mol_type = genomic DNA
ggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagac

SEQ ID NO: 57182 - DNA, 78 bp, Homo sapiens
  misc_feature 1..78: note = chr17:45811341-45811419
  misc_feature 1..78: note = hyper
  source 1..78: mol_type = genomic DNA
ctgtgcccgcgccggaacaagaacgtctcgtctgtttttctggctcgacaatgcttctgactccgtgtccctcactgc

SEQ ID NO: 57183 - DNA, 288 bp, Homo sapiens
  misc_feature 1..288: note = chr17:45867027-45867315
  misc_feature 1..288: note = hyper
  source 1..288: mol_type = genomic DNA
acttgtactttcaaccacgtcccccactccaaaattctgcgcctccctcaagccagttcctcctctgcttcctcctcgcagcagccggcgcgtctttgttccgtccaggcatcttcaacgcgtccctccctctggacgctgccgaggaaatactgaagtggtagaggatgtggggaggccgtccaagagtggaggtgtcccgggcctgctctctccaggaggaggagtgcaggctggggtccacctccccggtccagcagtgctggggaggggaccccgcacgtgtgc

SEQ ID NO: 57184 - DNA, 24 bp, Homo sapiens
  misc_feature 1..24: note = chr17:45867460-45867484
  misc_feature 1..24: note = hyper
  source 1..24: mol_type = genomic DNA
ctcaaagaccgccagctctggggg

SEQ ID NO: 57185 - DNA, 156 bp, Homo sapiens; identical to SEQ ID NO: 36565
  misc_feature 1..156: note = chr17:46089946-46090102
  misc_feature 1..156: note = hyper
  source 1..156: mol_type = genomic DNA

SEQ ID NO: 57186 - DNA, 30 bp, Homo sapiens; identical to SEQ ID NO: 36566
  misc_feature 1..30: note = chr17:46507708-46507738
  misc_feature 1..30: note = hyper
  source 1..30: mol_type = genomic DNA

SEQ ID NO: 57187 - DNA, 36 bp, Homo sapiens; identical to SEQ ID NO: 36567
  misc_feature 1..36: note = chr17:46619087-46619123
  misc_feature 1..36: note = hyper
  source 1..36: mol_type = genomic DNA

SEQ ID NO: 57188 - DNA, 259 bp, Homo sapiens; identical to SEQ ID NO: 22534
  misc_feature 1..259: note = chr17:46621094-46621353
  misc_feature 1..259: note = hyper
  source 1..259: mol_type = genomic DNA

SEQ ID NO: 57189 - DNA, 77 bp, Homo sapiens
  misc_feature 1..77: note = chr17:46621779-46621856
  misc_feature 1..77: note = hyper
  source 1..77: mol_type = genomic DNA
gaaccccaacaggctcgccaccattttttttaaacctccttccactgctttttctccccctcttctagctgcccctc

SEQ ID NO: 57190 - DNA, 102 bp, Homo sapiens; identical to SEQ ID NO: 22535
  misc_feature 1..102: note = chr17:46621909-46622011
  misc_feature 1..102: note = hyper
  source 1..102: mol_type = genomic DNA

SEQ ID NO: 57191 - DNA, 78 bp, Homo sapiens; identical to SEQ ID NO: 22536
  misc_feature 1..78: note = chr17:46655070-46655148
  misc_feature 1..78: note = hyper
  source 1..78: mol_type = genomic DNA

SEQ ID NO: 57192 - DNA, 216 bp, Homo sapiens; identical to SEQ ID NO: 22537
  misc_feature 1..216: note = chr17:46655178-46655394
  misc_feature 1..216: note = hyper
  source 1..216: mol_type = genomic DNA

SEQ ID NO: 57193 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 57194 - DNA, 50 bp, Homo sapiens; identical to SEQ ID NO: 22539
  misc_feature 1..50: note = chr17:46659859-46659909
  misc_feature 1..50: note = hyper
  source 1..50: mol_type = genomic DNA

SEQ ID NO: 57195 - DNA, 191 bp, Homo sapiens
  misc_feature 1..191: note = chr17:46663552-46663743
  misc_feature 1..191: note = hyper
  source 1..191: mol_type = genomic DNA
agacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaag

SEQ ID NO: 57196 - DNA, 553 bp, Homo sapiens; identical to SEQ ID NO: 36577
  misc_feature 1..553: note = chr17:46670978-46671531
  misc_feature 1..553: note = hyper
  source 1..553: mol_type = genomic DNA

SEQ ID NO: 57197 - DNA, 200 bp, Homo sapiens
  misc_feature 1..200: note = chr17:46674970-46675170
  misc_feature 1..200: note = hyper
  source 1..200: mol_type = genomic DNA
tatctcctaactgagatgcccacccagcaccctgtgggagattggggcagggggcgctcactagttctgtgtcccggggtgggcgcccaggggagccggggcgacggcgacgggaagtctcactcactgttgcacgaattcatccgctgcatccacgggtagaccggagtggagcacttctgctcttctgtctcgccgaa

SEQ ID NO: 57198 - DNA, 157 bp, Homo sapiens
  misc_feature 1..157: note = chr17:46675600-46675757
  misc_feature 1..157: note = hyper
  source 1..157: mol_type = genomic DNA
tatatccgagattgggttttagctgaggggggatggcgaggtgccagtgagggccagaaggaaatacaaccatctgatccaacactgaccaatggcagaggcaggaattgtcaaatagcacccaggaggagcgcagcccgcacgagggacccgcgca

SEQ ID NO: 57199 - DNA, 1002 bp, Homo sapiens; identical to SEQ ID NO: 36579
  misc_feature 1..1002: note = chr17:46687804-46688806
  misc_feature 1..1002: note = hyper
  source 1..1002: mol_type = genomic DNA

SEQ ID NO: 57200 - DNA, 378 bp, Homo sapiens; identical to SEQ ID NO: 36580
  misc_feature 1..378: note = chr17:46689986-46690364
  misc_feature 1..378: note = hyper
  source 1..378: mol_type = genomic DNA

SEQ ID NO: 57201 - DNA, 38 bp, Homo sapiens
  misc_feature 1..38: note = chr17:46690429-46690467
  misc_feature 1..38: note = hyper
  source 1..38: mol_type = genomic DNA
cgctgcggtgggaggcccggctcctggccccgctagcg

SEQ ID NO: 57202 - DNA, 41 bp, Homo sapiens; identical to SEQ ID NO: 22546
  misc_feature 1..41: note = chr17:46690664-46690705
  misc_feature 1..41: note = hyper
  source 1..41: mol_type = genomic DNA

SEQ ID NO: 57203 - DNA, 53 bp, Homo sapiens; identical to SEQ ID NO: 36582
  misc_feature 1..53: note = chr17:46690852-46690905
  misc_feature 1..53: note = hyper
  source 1..53: mol_type = genomic DNA

SEQ ID NO: 57204 - DNA, 63 bp, Homo sapiens
  misc_feature 1..63: note = chr17:46691442-46691505
  misc_feature 1..63: note = hyper
  source 1..63: mol_type = genomic DNA
ggaaatgtttctaagcgacccccttcaagggaaagaaaaaagaaagaagaaagaaagataaga

SEQ ID NO: 57205 - DNA, 213 bp, Homo sapiens
  misc_feature 1..213: note = chr17:46691592-46691805
  misc_feature 1..213: note = hyper
  source 1..213: mol_type = genomic DNA
tgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgta

SEQ ID NO: 57206 - DNA, 255 bp, Homo sapiens; identical to SEQ ID NO: 22548
  misc_feature 1..255: note = chr17:46692110-46692365
  misc_feature 1..255: note = hyper
  source 1..255: mol_type = genomic DNA

SEQ ID NO: 57207 - DNA, 141 bp, Homo sapiens; identical to SEQ ID NO: 36585
  misc_feature 1..141: note = chr17:46702566-46702707
  misc_feature 1..141: note = hyper
  source 1..141: mol_type = genomic DNA

SEQ ID NO: 57208 - skipped

SEQ ID NO: 57209 - DNA, 10 bp, Homo sapiens
  misc_feature 1..10: note = chr17:46713949-46713959
  misc_feature 1..10: note = hyper
  source 1..10: mol_type = genomic DNA
tctgtggtct

SEQ ID NO: 57210 - DNA, 58 bp, Homo sapiens; identical to SEQ ID NO: 22549
  misc_feature 1..58: note = chr17:46714072-46714130
  misc_feature 1..58: note = hyper
  source 1..58: mol_type = genomic DNA

SEQ ID NO: 57211 - DNA, 154 bp, Homo sapiens; identical to SEQ ID NO: 12768
  misc_feature 1..154: note = chr17:46714131-46714285
  misc_feature 1..154: note = hyper
  source 1..154: mol_type = genomic DNA

SEQ ID NO: 57212 - DNA, 301 bp, Homo sapiens; identical to SEQ ID NO: 36589
  misc_feature 1..301: note = chr17:46723899-46724200
  misc_feature 1..301: note = hyper
  source 1..301: mol_type = genomic DNA

SEQ ID NO: 57213 - DNA, 43 bp, Homo sapiens; identical to SEQ ID NO: 36590
  misc_feature 1..43: note = chr17:46755656-46755699
  misc_feature 1..43: note = hyper
  source 1..43: mol_type = genomic DNA

SEQ ID NO: 57214 - DNA, 205 bp, Homo sapiens; identical to SEQ ID NO: 22551
  misc_feature 1..205: note = chr17:46795436-46795641
  misc_feature 1..205: note = hyper
  source 1..205: mol_type = genomic DNA

SEQ ID NO: 57215 - DNA, 147 bp, Homo sapiens; identical to SEQ ID NO: 22552
  misc_feature 1..147: note = chr17:46797582-46797729
  misc_feature 1..147: note = hyper
  source 1..147: mol_type = genomic DNA

SEQ ID NO: 57216 - DNA, 172 bp, Homo sapiens; identical to SEQ ID NO: 36596
  misc_feature 1..172: note = chr17:46799288-46799460
  misc_feature 1..172: note = hyper
  source 1..172: mol_type = genomic DNA

SEQ ID NO: 57217 - DNA, 30 bp, Homo sapiens; identical to SEQ ID NO: 36598
  misc_feature 1..30: note = chr17:46800233-46800263
  misc_feature 1..30: note = hyper
  source 1..30: mol_type = genomic DNA

SEQ ID NO: 57218 - DNA, 112 bp, Homo sapiens
  misc_feature 1..112: note = chr17:46800489-46800601
  misc_feature 1..112: note = hyper
  source 1..112: mol_type = genomic DNA
gcctggggggaggggcggggtgtcctgcttttgggctagaggcccggggccgctcccgagctttctcccctcttccctggagagcgactgttcgggagggtgagaatggtat

SEQ ID NO: 57219 - DNA, 293 bp, Homo sapiens
  misc_feature 1..293: note = chr17:46800668-46800961
  misc_feature 1..293: note = hyper
  source 1..293: mol_type = genomic DNA
gtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactact

SEQ ID NO: 57220 - DNA, 30 bp, Homo sapiens; identical to SEQ ID NO: 36601
  misc_feature 1..30: note = chr17:46801636-46801666
  misc_feature 1..30: note = hyper
  source 1..30: mol_type = genomic DNA

SEQ ID NO: 57221 - DNA, 202 bp, Homo sapiens
  misc_feature 1..202: note = chr17:46802257-46802459
  misc_feature 1..202: note = hyper
  source 1..202: mol_type = genomic DNA
catctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcag

SEQ ID NO: 57222 - DNA, 30 bp, Homo sapiens; identical to SEQ ID NO: 36604
  misc_feature 1..30: note = chr17:46803786-46803816
  misc_feature 1..30: note = hyper
  source 1..30: mol_type = genomic DNA

SEQ ID NO: 57223 - DNA, 352 bp, Homo sapiens; identical to SEQ ID NO: 36606
  misc_feature 1..352: note = chr17:46805572-46805924
  misc_feature 1..352: note = hyper
  source 1..352: mol_type = genomic DNA

SEQ ID NO: 57224 - DNA, 107 bp, Homo sapiens; identical to SEQ ID NO: 36607
  misc_feature 1..107: note = chr17:46806788-46806895
  misc_feature 1..107: note = hyper
  source 1..107: mol_type = genomic DNA

SEQ ID NO: 57225 - DNA, 143 bp, Homo sapiens
  misc_feature 1..143: note = chr17:46810273-46810416
  misc_feature 1..143: note = hyper
  source 1..143: mol_type = genomic DNA
cctgcacaacccaggcgtcctgatcttccagactgactgggctgagcctggccttcccctaaccccacagatgcctttgtgtcctgctgggagcctcctggcagaccctccgggagcccggagcctcccccagctttctttac

SEQ ID NO: 57226 - DNA, 138 bp, Homo sapiens; identical to SEQ ID NO: 22559
  misc_feature 1..138: note = chr17:46810958-46811096
  misc_feature 1..138: note = hyper
  source 1..138: mol_type = genomic DNA

SEQ ID NO: 57227 - DNA, 30 bp, Homo sapiens; identical to SEQ ID NO: 36610
  misc_feature 1..30: note = chr17:46812585-46812615
  misc_feature 1..30: note = hyper
  source 1..30: mol_type = genomic DNA

SEQ ID NO: 57228 - DNA, 71 bp, Homo sapiens; identical to SEQ ID NO: 36611
  misc_feature 1..71: note = chr17:46815930-46816001
  misc_feature 1..71: note = hyper
  source 1..71: mol_type = genomic DNA

SEQ ID NO: 57229 - DNA, 12 bp, Homo sapiens
  misc_feature 1..12: note = chr17:46816270-46816282
  misc_feature 1..12: note = hyper
  source 1..12: mol_type = genomic DNA
gggtcaggtctt

SEQ ID NO: 57230 - DNA, 230 bp, Homo sapiens; identical to SEQ ID NO: 22561
  misc_feature 1..230: note = chr17:46825054-46825284
  misc_feature 1..230: note = hyper
  source 1..230: mol_type = genomic DNA

SEQ ID NO: 57231 - DNA, 26 bp, Homo sapiens
  misc_feature 1..26: note = chr17:46830110-46830136
  misc_feature 1..26: note = hyper
  source 1..26: mol_type = genomic DNA
cccagggccccctccgggttctccca

SEQ ID NO: 57232 - DNA, 64 bp, Homo sapiens; identical to SEQ ID NO: 36619
  misc_feature 1..64: note = chr17:46830189-46830253
  misc_feature 1..64: note = hyper
  source 1..64: mol_type = genomic DNA

SEQ ID NO: 57233 - DNA, 40 bp, Homo sapiens; identical to SEQ ID NO: 36620
  misc_feature 1..40: note = chr17:46830483-46830523
  misc_feature 1..40: note = hyper
  source 1..40: mol_type = genomic DNA

SEQ ID NO: 57234 - DNA, 154 bp, Homo sapiens
  misc_feature 1..154: note = chr17:46832639-46832793
  misc_feature 1..154: note = hyper
  source 1..154: mol_type = genomic DNA
caacaggacctccaagccagcctcacgcacgcaggcctggctctctcctgcagaatccccacctgccctataactacccacttcagatatgggggaatggaggagatattccaatcacgccatctacctacagtttccacggccccttctgttg

SEQ ID NO: 57235 - DNA, 61 bp, Homo sapiens; identical to SEQ ID NO: 36623
  misc_feature 1..61: note = chr17:46918852-46918913
  misc_feature 1..61: note = hyper
  source 1..61: mol_type = genomic DNA

SEQ ID NO: 57236 - DNA, 129 bp, Homo sapiens
  misc_feature 1..129: note = chr17:47072676-47072805
  misc_feature 1..129: note = hyper
  source 1..129: mol_type = genomic DNA
acaaaaacaaaaatccgacaaacacgtggctgggtagaacaaaacgctcattggggagggtgggctctaaggtggtggaggatatagagaaaccgagttggaagccctcccccgcccctaagtcccagc

SEQ ID NO: 57237 - DNA, 95 bp, Homo sapiens
  misc_feature 1..95: note = chr17:47073465-47073560
  misc_feature 1..95: note = hyper
  source 1..95: mol_type = genomic DNA
cgggtccttccctcgggctccgggagccggaggatccggaatgagttggtcaaagccgagggaagggacccaggcggatccgcttccccctcccc

SEQ ID NO: 57238 - DNA, 35 bp, Homo sapiens
  misc_feature 1..35: note = chr17:47073953-47073988
  misc_feature 1..35: note = hyper
  source 1..35: mol_type = genomic DNA
ttccttgtctcccaccgttcctgtctcctggagtc

SEQ ID NO: 57239 - DNA, 181 bp, Homo sapiens; identical to SEQ ID NO: 22565
  misc_feature 1..181: note = chr17:47074228-47074409
  misc_feature 1..181: note = hyper
  source 1..181: mol_type = genomic DNA

SEQ ID NO: 57240 - DNA, 265 bp, Homo sapiens
  misc_feature 1..265: note = chr17:47074895-47075160
  misc_feature 1..265: note = hyper
  source 1..265: mol_type = genomic DNA
tctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggactt

SEQ ID NO: 57241 - DNA, 52 bp, Homo sapiens
  misc_feature 1..52: note = chr17:47075364-47075416
  misc_feature 1..52: note = hyper
  source 1..52: mol_type = genomic DNA
caactcctctcttcccgggcctgcggggtttggcctccgtacccaccctcga

SEQ ID NO: 57242 - DNA, 81 bp, Homo sapiens
  misc_feature 1..81: note = chr17:47075634-47075715
  misc_feature 1..81: note = hyper
  source 1..81: mol_type = genomic DNA
cagcccctccctatccgccggtggacgcccccccagctggaaaaccccggctcccgttcctcagtcttaggcctttccagg

SEQ ID NO: 57243 - DNA, 78 bp, Homo sapiens
  misc_feature 1..78: note = chr17:47076055-47076133
  misc_feature 1..78: note = hyper
  source 1..78: mol_type = genomic DNA
cagagaaaaataaagtttcattctgcacactgcctcccgccccgcgccccactttctgaggaacggggagccctttct

SEQ ID NO: 57244 - DNA, 262 bp, Homo sapiens; identical to SEQ ID NO: 36631
  misc_feature 1..262: note = chr17:47081179-47081441
  misc_feature 1..262: note = hyper
  source 1..262: mol_type = genomic DNA

SEQ ID NO: 57245 - DNA, 442 bp, Homo sapiens; identical to SEQ ID NO: 36632
  misc_feature 1..442: note = chr17:47210040-47210482
  misc_feature 1..442: note = hyper
  source 1..442: mol_type = genomic DNA

SEQ ID NO: 57246 - DNA, 36 bp, Homo sapiens; identical to SEQ ID NO: 36633
  misc_feature 1..36: note = chr17:47307637-47307673
  misc_feature 1..36: note = hyper
  source 1..36: mol_type = genomic DNA

SEQ ID NO: 57247 - DNA, 142 bp, Homo sapiens; identical to SEQ ID NO: 36634
  misc_feature 1..142: note = chr17:47308577-47308719
  misc_feature 1..142: note = hyper
  source 1..142: mol_type = genomic DNA

SEQ ID NO: 57248 - DNA, 95 bp, Homo sapiens; identical to SEQ ID NO: 36635
  misc_feature 1..95: note = chr17:47547802-47547897
  misc_feature 1..95: note = hyper
  source 1..95: mol_type = genomic DNA

SEQ ID NO: 57249 - DNA, 396 bp, Homo sapiens
  misc_feature 1..396: note = chr17:47573694-47574090
  misc_feature 1..396: note = hyper
  source 1..396: mol_type = genomic DNA
ggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctga

SEQ ID NO: 57250 - DNA, 1105 bp, Homo sapiens
  misc_feature 1..1105: note = chr17:47574149-47575254
  misc_feature 1..1105: note = hyper
  source 1..1105: mol_type = genomic DNA
gcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 57251 - DNA, 295 bp, Homo sapiens; identical to SEQ ID NO: 36637
  misc_feature 1..295: note = chr17:47928151-47928446
  misc_feature 1..295: note = hyper
  source 1..295: mol_type = genomic DNA

SEQ ID NO: 57252 - DNA, 103 bp, Homo sapiens; identical to SEQ ID NO: 36638
  misc_feature 1..103: note = chr17:47967958-47968061
  misc_feature 1..103: note = hyper
  source 1..103: mol_type = genomic DNA

SEQ ID NO: 57253 - DNA, 311 bp, Homo sapiens; identical to SEQ ID NO: 22574
  misc_feature 1..311: note = chr17:47987619-47987930
  misc_feature 1..311: note = hyper
  source 1..311: mol_type = genomic DNA

SEQ ID NO: 57254 - DNA, 85 bp, Homo sapiens; identical to SEQ ID NO: 36640
  misc_feature 1..85: note = chr17:48040403-48040488
  misc_feature 1..85: note = hyper
  source 1..85: mol_type = genomic DNA

SEQ ID NO: 57255 - DNA, 352 bp, Homo sapiens
  misc_feature 1..352: note = chr17:48041320-48041672
  misc_feature 1..352: note = hyper
  source 1..352: mol_type = genomic DNA
cctaggtctgggaaggtctgaagatcccggcggagctgccttcgttcggggccgggcaaattcgttgcagccgggttggcctcagggcctctcgccggctcgctatgtttccccggggcgccctggcaggccagccggcggtctgtcagtccagctcctggtgcgggcgcctcgttttggtccaccgggtccggggctgggacaccgagggaaaacttcagagctccgggccaccgagcctggaagttacgcgtcccccagcccacgcgtccccaatcccggggtatttcctgctccctcatccagcgaagttcagcgtcgcgtgtctccccagcggcgcagcctgcctcca

SEQ ID NO: 57256 - DNA, 56 bp, Homo sapiens
  misc_feature 1..56: note = chr17:48041721-48041777
  misc_feature 1..56: note = hyper
  source 1..56: mol_type = genomic DNA
tctctctctgtctctctctctcttcctccgtccccccaccccgtgtcccaagaatt

SEQ ID NO: 57257 - DNA, 72 bp, Homo sapiens; identical to SEQ ID NO: 22575
  misc_feature 1..72: note = chr17:48042069-48042141
  misc_feature 1..72: note = hyper
  source 1..72: mol_type = genomic DNA

SEQ ID NO: 57258 - DNA, 26 bp, Homo sapiens
  misc_feature 1..26: note = chr17:48042409-48042435
  misc_feature 1..26: note = hyper
  source 1..26: mol_type = genomic DNA
aactgaaaatcactgcgaatgacaat

SEQ ID NO: 57259 - DNA, 144 bp, Homo sapiens
  misc_feature 1..144: note = chr17:48048808-48048952
  misc_feature 1..144: note = hyper
  source 1..144: mol_type = genomic DNA
agccgtagggagcagcgggcctggagggaggccttggggctccatgatcgcgacccgggcagatctcgtaacttgctggaactggggtagggaaaggcagctgtccgggaaggaacttggagggggtctgctgggagagttggg

SEQ ID NO: 57260 - DNA, 248 bp, Homo sapiens
  misc_feature 1..248: note = chr17:48049059-48049307
  misc_feature 1..248: note = hyper
  source 1..248: mol_type = genomic DNA
ctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgaccgcggctggccgagggcgggtacactgacgtgtggagggtgagcccgactaggggaagaag

SEQ ID NO: 57261 - DNA, 44 bp, Homo sapiens
  misc_feature 1..44: note = chr17:48050526-48050570
  misc_feature 1..44: note = hyper
  source 1..44: mol_type = genomic DNA
ccagcctgcagctgcagcacctaaaccagcgtttccagcacacg

SEQ ID NO: 57262 - DNA, 222 bp, Homo sapiens; identical to SEQ ID NO: 12817
  misc_feature 1..222: note = chr17:48070683-48070905
  misc_feature 1..222: note = hyper
  source 1..222: mol_type = genomic DNA

SEQ ID NO: 57263 - DNA, 72 bp, Homo sapiens; identical to SEQ ID NO: 36647
  misc_feature 1..72: note = chr17:48071121-48071193
  misc_feature 1..72: note = hyper
  source 1..72: mol_type = genomic DNA

SEQ ID NO: 57264 - DNA, 122 bp, Homo sapiens; identical to SEQ ID NO: 36648
  misc_feature 1..122: note = chr17:48071583-48071705
  misc_feature 1..122: note = hyper
  source 1..122: mol_type = genomic DNA

SEQ ID NO: 57265 - DNA, 70 bp, Homo sapiens; identical to SEQ ID NO: 36650
  misc_feature 1..70: note = chr17:48585866-48585936
  misc_feature 1..70: note = hyper
  source 1..70: mol_type = genomic DNA

SEQ ID NO: 57266 - DNA, 75 bp, Homo sapiens; identical to SEQ ID NO: 36651
  misc_feature 1..75: note = chr17:48619216-48619291
  misc_feature 1..75: note = hyper
  source 1..75: mol_type = genomic DNA

SEQ ID NO: 57267 - DNA, 390 bp, Homo sapiens; identical to SEQ ID NO: 36652
  misc_feature 1..390: note = chr17:48619346-48619736
  misc_feature 1..390: note = hyper
  source 1..390: mol_type = genomic DNA

SEQ ID NO: 57268 - DNA, 146 bp, Homo sapiens
  misc_feature 1..146: note = chr17:48636435-48636581
  misc_feature 1..146: note = hyper
  source 1..146: mol_type = genomic DNA
atcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtg

SEQ ID NO: 57269 - DNA, 111 bp, Homo sapiens
  misc_feature 1..111: note = chr17:48637136-48637247
  misc_feature 1..111: note = hyper
  source 1..111: mol_type = genomic DNA
ttccttcttaggggtcctcgctctgctccgcagcccctcctggggatccgggctctgcggtccagcgcgacctgcctggggccacgtgttcaagcacgaagcccctgcgtg
